United States Patent 9,328,346 (POLYCOMB-ASSOCIATED NON-CODING RNAS) - sequence listing, part 119

SEQ ID NO: 191136 - RNA, 311701 nt, Homo sapiens
uuuuuuuuuuuuuaauccccgcaccaagcgcuuaaccucauugggguggaggagaaggcggcggcucucugguccgcagcggcaacaguaacgaaaaacagggcuguaaguacccggucagggggcggagggucagacccgagcccucucgcggcccuggccccucccgcgcaguggcgggcgccgggucugggugggggcgauguccagcgcugucaucggcucuugggugcacuuuggggggauggggcggcccugaggugggagccuggcgaggagcgggaugcgaggguuguuuauccaaccaguaggucgcugagcccaggcugcuuugcagagggaggggaucggcccuggggucagucgggcuuugugugccccucucuguuucccuuuuccagaccccacccgggcccccuuccuaacccgagucuccccugccgggugggagaagccagcgagcccggggcgcguuugaaaggaagggagggggcgagggagagaaacccacaacaacuagucauuggcgagugaugggugugaagaaagauccagagagaaggggugccgggaggcgggcggcccgggcucccguccugggcucccaaccgggccagacaaaagcugcgcgagcggcgccgagcggagcggccggcuugaugggaugcacaagguccccuugguucccggggccuucgaagagcuucuuucugaagcugggaaagcgaacaagugcugaguuaagccugugcagacuucucaacuugccuuuguuguucuuugguauuggcagagacgcucugacgaagaugagugugugaucuugcacguuagccuggcuagguacaauggagcuaaucgaauuuugcuuuccguuuuccgagcugcugggaugaguauggggcuuuccagaguuuaaauuauuacauaauauuuuuaaaauaguuguuugcuucuaaaauuaaaaaaaauuaauguggagucugaaagcacgcuguggugaguuugcagcugaguuugcagcugggugaguuucuguguaguggggugcguucauuaaauacugaccauucguagaaccugugagcucuuuaaacaugauacuuucauuuguagauguggcaaugagagcuucagauucucuaguccuuugggagaccgugaugcagaagagucagaagcgagaaauaguuucaugccgccauguaccuuggacccuauuugggugccacaguccguuuucaauucuggcauuagaaauuguuuuuauuacuacgauuauuuacgacgguaacugaccucucgauaugagggauccuggauauuggcuccguuugcucaucaagggauugggagaauagcaacauugauguugcgaccauauagauaaaaaguagcacagugccucagaguauugaauauuauuuauuuuuuacauuuguuaagaaauuuaaauuuugaugaucugguuaucuuguuaaauuguguaauacaccuuuuuagcaguuguuacugaaaucucaguuucuauaauucauuguuuauuaugggcuaccuuguaacaccauuuuagacuucuaaaguuuuaguuuuuaugaaggaguuuucagccauagcuuuuaauucucccagguaagguuaaccaaagucaggacuccuuagaggagacuuuguuggugguggaggugucaaauauuguaucucuguguuacaacugaauuggcaaauacagaaaaggcuuuugcuaaguuuucaccauaaauuuguguuagaacggaaaacccagaucuccuaguaugucaggcuuuugaauuaacccacagauuccacuuuauuuauguaaaagagguaaacuuuuuuuuuaauugauagcaaguaaaacucugaagccugguguauuaugcuuaaguaacuagugggauagaaucucuuuaaguguaguucagaugaugggaacuugcuuuuuauagagcaagauuucagacccuuaaaauaguuugacagggauguugagaaaugauuggccagaagaacaugaaguuugucauuuaaguguguuauauuuuguuuacugguuuuauuuauuauuuauuuuuauuuuuauuuuugaaacagaguuucacucuugucgcccaggcugaagugcaauggugcaaucucagcucacugcaaccuccaccuccuggguucaagugauucuccugccucagccgccugaguagcugggauuacaggcacccacaaccaugcccagcuaauuuuuguauuuuuaguagagacaggguuucacuauguuggccaggcuggucuugaacuccugaccuccugugaucagccugccuuggccuuccgaagugcugggauuacaggcgugagcaaucgcgcucggcccauguuuacugguuuuagauuuagauuuuuuuuuuuuuuuuuuuuugagauggagucucgcuauguuacccaggcuggaaugcaguggcgcgaucugggcucacugcaagcuccgccucccagguucaugccauucuccucccucagccucccgaguagcugggacuacaggugcccgccaccaugcccggcuaauuuuuuugcguuuucuuaguagagacgggguuucaccguguuagccaggauggccuugauauccugaccucaugauccgccugccucagccucccaaagugcugggauuacaggcgugagccaccacgccuggccuagauuuagauuuuuugcuuccgucuuguuuauuuucuuaaguagcuuagugucuugauuuauaaguugaaugagauggcuucuugggccugagacuuaaauuuacuguuugagacccaucuauucuuaauaaucuucuacuuaauaauuuuuagauuuuuauuuuguaguacuguugguaaauauaaacauuuaagugauuacaaauguuagauucaacugaguuacugaaacugucauuuuugguaacuaaaucuagcugucaaauaguggaaauaguagacagaaguaaaacuuaaauguuuaaaaacagaacauuuuacagauuuccuagaaaacaagagaagaggcugggugcaguggcuuacaucuguaaugcuagcauuuugggaggccaaggugggcggguugcauggaguuugagaccaaccugggcaacauggugaaacccugugucucuacagaaaauucaaaaauuagcuggggauaguggugugcaccuguagucccaacuacuuggggggaugaggugggaggaucuccugagucugggaggcugaggcuacagugagccgaaaucgugccacugcauuauagcuuggaugacagagugauaccuugucuaaaaacaaaaacaaaacaagggaaggaucuguuagucuuaaaaacaaaaacuaagcgaaguagaaaucaucgcugauacaguuuuugguuuguaagauguaaucuuaaaaaaugaacuaacuuuuuuacccauugccagcggggcaucaucaacaaaguacggguauauguguuugacuaaaugaccucuaaaaugcuggcauuuacugcuuguuucuagcuuguucuucaccuccccagggcuuuucugccggcuuuaugcccagaccauuacugccacacaaugauuuuccuccccaaauucuuaugacaguccucaucccaccuccccucauagauccuaaagaucuagcucaggugugcucaaauggugacauuucuuccauaacaccuuuguuaacuucugucuuguuuccugccuggaaguuuccucacuccuugcugcuuccuguuguauauaucaccuuccugcuuacuuagauucacucuugugcauuuacucuucucuagauccuugauggcacagggaguuuguagaacacauuguguguccucuguugcuuacuaagugacuaagugacuuguauaacuaauggaaacuguagaauguaugaaagaauaaacaaauguauccuaauguagacuaauauaauuugagcuuuggaggaguuguuagaggcccaguaguccagcauccuuccuuauguuugcuacauucugaucaucagugucacacugcaggcaucugucccuggacaggucuugguugccagaaauguuuuuagauuacuacuacagucugcucccucccuuucacguauugaccuuaguuauacuuccugaaggaaccugaauuaagucuguuucuucuucacauaauagcacuucauauuucccaugacagauaucacacuucuagaauuauugauuaauuuacuuauuaaacucucucuugaauugagcaucagguaccaagaggguacaguugaagagacauccauggccccugcacuucaggggcuugcagucuaguuagggagacaauaacaugaaucgauggcugauuauagugaagguaugcaaacagcccuaaaugguuaguccuuuccugguuugauauggcucaccaugcuuucuuuaggcaacucuuguuuuuuuuuuuuuuguuuuuuuuuugagacaguuuugcucuguugaucaagcuggagugcaguggcauggucauggcucacugcaaccuugaccuucuggacuuaaucaauccuccugcuucagccuuuugaguagcugggacuacaggcaugcaccaccacaccuggcuaauuuucuaaauuuuguuuuagaaguguuuuguagagauagggccucaccauguugcccaugcuggucucgaacugcugggcucaagugauccuccugccuuggccuaccaaagugcuaggaagccuggcccaacuauuccccuacaccggcccccaagacggagucuugcucugucaccaaggcuggagugcaguggcgugaugucagcucacugcagccuccaucucccagguucaagcaauucuccugccucagccuccugaguagcuugggacuacaggcgugguggcacaugccuggcuaauuuuuguuauauuucuaguagagacgggguuuuaccauguugggccaggcugaucucaaacuccugaccucaggugaucugccugccucugccucccaaagugcugggauugcaggugugacccacugcccccggccauuguuuuuuuuuuuuuuuaauguccuuuaaaugcagugucugaaacaaaacagaagauaugaccugaccagaauauacagcuguuuucuuagguuaggaaacugaaccaaugauuuucaaauuuccuugugcauucuggcucugccacuuacaagugcugugauuuuaggccaguuaaauaaucucaauauuuuagugucuucaucuguaaaaugagggugaggggagggcaguguuaauuguagcaccuaccuauagguuguugucaggauuaaaugagauaauacguguaaaguguugaggauagugacugguauguguuaagucgguaauacaugguaggaguuaauaaccauguaguaguaguugcaguaaucaagucacuggaaucucuuugggaccuuguuaaaauacaagcagccuggccuuauuuuauuaucuuccacccagggaauuuguaggggaccuggguagccacaguuuuaacagccuuuagaugauucuuagaugagccagagguggagaacucugcacuuuacauucgugauaucauuagcuuuuacaaauuaaaauuuuaaaauuccccaaguaauagaugaauagauguuccuaaaagauucaaacaaugcagauauagguaaaggcauggcucccaauuucagacuccuggagaaacacccacuuaccaguuuggaauguauccuuccacacacuguuacccuuuuuuuguagauuuauaaauaaaugucuucauaauaauaauggccagauuuaaaagauaaaaaugauuuuuaaugcacuuuuacagucauaaucuuuguucccuuccaagucuuaugagauggguaggggagauagcaucacgauccuaucaauuugcagaugagaaaucaaggucugcaaaugaaauucacccugauugaucuagauugagaacugggccuucugucucucagcuuaauguccuuuucacgugaaccaugcuguuuccuagcuacaucaucuuggcuuauauugaaguuguggcuuuugaagucuucuagucuuuuugccaugccaauagcugucaaaucagauuuccuccuuuccuuuagugcguauauacuugcuuuuagaaaaauacuacuuuuagaguauuuaaagaaaagaauagaaaaaaaguaaauucaagguuuuauauuuuuguguaucuguuaagauugaucuuuuggggaaagaaaucuagaacuggccuuguggccaucugauagcauggugcguuuaggugagccugucuucauucaggauagcugaggucaguguaggacuuucccucacuacuguccaauuaacucuccaggcagaaucaguuaaauauauuuauagucuuacugcaauaauguagcaauaauauggaaaguugagagaccaguggaggaaaaccacaucaaaccauuucaacaugagcuauuacuucccgauauaucacucuuugagacuguccauguguccauucuuuuuguaaguaauuuuaggucuugcauguuuuauggaugguuuucuuauaauuacauaguauauguaauuuuaaguuuuaauagcuuugucauuuugcuuaauauggcaaauuuugguaaacuguuugagauuuuuuuugggacagggucucacucugacgcccaggcuggagugaaguggcgcaaucucagcuuacugcaaccuccgccucccggauucaagcgauucuucugccucagccucccauguagcugagauuacaggugugcgccaccacgcccggcucauucuuguauuuuuaguaguuacagaguuucaccauguuggccaggcuggucucgaacuccugaccucaagugauccaccugccucagccucccaaaugcugggauuacaggugugaaccacugcaccuggccugagaguuuugacaggaagauuuucuuuuuucuuuuuuuuuuuuuuuuuagcaaaaagauaccugcucugucacccaggguggaguguggugguaugaucauggcuuacugcagccuugaccuuccaccucagccuccugaguagcugggauuagccaggugugcgccaccacccuugcuaauuuuuguauuuuuuguagagacagggucccacuauguugcccaggcuggucucaaacuccuggacucaagcaauccuccugccucacccucccaaagugcugggauuauaggcgugagccacugugucugaguaguuaucuuuuuuuuuuuauuauauguaauccaauagugauuaucuuuuuuguauaguuucuuuuguguuauucccuuaggauaaauucaaauaagugggauuauugaauuuaaggguaugagcuuuuuuugguuuguuuuuaaagaggcagggucuuacuauguugccuaggcuacucgaacuccugggcucagugauccucccaccucagccuccugaguagcugggacuguaggugcacaccagcacauccagccucauauuuaugacuuuuaauauguauugccacuagcuaaccaaaaauucguaccauuuaguaauuuucccagcaaucuaagaauguguuaguuucacaaaaauguuaccaacuucuggugaauauaauuuaaguauauuuuuugcuauuauaugagguguagcugguacauuauuuuuauuuuucauuacuuuuuguguuuauuuuaaaaaagaauaagcaaucaugagggccuucaguaugaugaaacuguaugaaacucacauuggguauuacaugcagguggucucuguuacuuccuugguuuccaauccugucuggcaugaccaaaacuauuccauuucuagaugggcauagaggaaaaugcagccuuugcuuugugggacagauuguuguaguuguccacaucagaaugugaucuuuuuacauuuuuguggccuaccuucuaguguuucuuuaaacaguugugugcuaggcuccuguguaaaauauuuaguaaucagaauaucugugggugugggcgauaccuguuuuuuuuuuuuuuuuaacagguuccccaagugcuucuggggcuacacaaguuugagagcagccucuggggacuaccuuuuagcgaauuuucuucauagacugugucuuuccuguggguagaggcagacucuguuacgaacaguagcccggacaugcuaacagaggccuguuguauagagaaaaugaauuguguagcagugccuuccuaaaugaagaguagcuggguucguucuuggaacaauaagccagucuuuccuaagagacuugaacugcauaaaaacagcuccuucucugauguuuuucuguggugcugguggcuguuuuauuuaaguucugguaagucauaguguucucccagcccaggccauauccugcucagccuuugguuagcugaaagguagcacauagaccuauugucacacuagcaauuaccaugagauagaacacucaccauuugccaggcaguuggaugggugcuagagguauacuucugccaauucuuacaguaacauuuaaaggcaggugcuauugucauuuuauaaugagagaaagcagagacuuggagaaguugaauaauuuguuaauugucacacaccugcagaauagcagaauuuggcuuuuaaaaucuucagcaugcuuuucauuuaucccauuuuuuuuuuuuccagcucagguuguucuuccuucaugaaggucagugggcugccuuggggaaagguaugcugccacuaucuggcagcaucuggaaaccacucacuagucaggagggauguagagaugcagacuucccacuaggguuuccacgaggauuagaucaggugacuguacaguccuuuuuagauuugagcuccugauaugaaaucuaaccuuagacaauccagauaacugaagaccugauaaaguuuuuuuuucuuucaaguguuuuauuguaguaaaauauacauaacauaaaauuguccauuuaaaccauuuuuuuguauuauacuuuaaguucuaggguacaugugcacaacgugcaggcucguuacauaguuauacaugugcaaugcuggcccgcugcacccaucagccugucauuuacauuagguauuucucccaaugcuauuccucccccggccccccaccccauggcagacccuagugugugacguuccccacccuguguccaaguguucucauuguucaguuccuaucugugagugagaacaugugguguuugguuuuuuguccuugcgauaguuugcucagaaugaugguuuccagcuucauccgugucccuacaaaggacaugaacucauccuuuuuuauggcugcauaguauuccaugguauauaugugccacauuuucuuaauccagucuaucauuguuggacauuuggguugguuccaagucuuuguuguugugaauugugccccaguaaacauacgugugcaugugucuuuauaguagcgugauuuauaauccuuuuuuuuuuuuuuuuuuugagauggaguuucccucuuguugcccaggcugaagugccauggugcaaucuuggcuuacugcaaccucugccuccugcguucaagugacucuucugccucagccuccggaguagcugagauuacaggcaugcgccaccaugccuggcuaauuuuguauuuuuaguagagacaggguuucuccauguuggccgggcuggucuugaacucccaaccucaggugaucugccugccuuguuccccucccagagugcugggauuacaggugugagccacugugccuggccuaaaccauuauuaaguaugcaauuaaguggcauuaauuacauuaaugcuauugugccaccauugccauaaucuguuuccaaaucuuuuccaucaucccaaauagaaacucuguagccauuaagcaauaacuccccauuccucugucucccagcaccugguaaccucugaucuacuuucugacucaauggauuugccuauucuggauauuucauauaaauggaaucauacaauauuuuccuuuugugacuggcuuauuucauuugcacaguguuuuuuuguuuuuguuuguuuguuuuuuuuugagacagagucucgcucugucgcccaggcuggagugcagugucgcaaucuuggcucacugcaagcucugccucccggguucacgccauucuccugccucagccucccgaguagcugggacuacaggcacccaccaccaagcccggcuaauuuuuuuguauuuuuaguagagacaggguuucacuguguuaaccaggauggucucaaucuucugaccuugugauccgccuaccucagccucccaaagugcugggauuacaggcgugagccaccgcaccuggccccauuugcgcaguguacuccauuguuggcugggcacaguggcucaugccuguaaucccagcauuuggggaggccaaggcggguggaucaccugaggucaggaguucaagaccagccugaccaacauggugaaacccugucucuacuaaauauacaaaaaauuagcugggugugguggugugugccuguaaucucagcuacuugggaggcugaggcaggagaauugcuugauccugggaggcggagguugcagugagccgagaucaugccacugcacuccagccucggcaaaaagagcaaaacucugucucaaaaaaaaaaaaaauaaaaaagaacaccauucuuuuuuuauugcugaguaauguucuauuguauggauauaccacauuuuguuuauccauuaauuuguugguggacguuggcuuguuucugcucuuuggcuauugugaauaauggugcagugaacacuauuguacaauaucuguuugaaucucuguuuucauuucuuuuggguauauaccuuggaguggaauuguugcgucauuugggugauucuauguuguaacuuucuggaacaauugcugaacuguuuuucacaguggcuguaccauuuuacauucugacuagcaauguacaaggguuccaguuucuccacauucucaccaacacaugucauuuucuguguuuuuuuuuaauuuuuauuuuuauuauaaccauucuauaauauaaguaguaucuuaauuugguuuugauuuuaauuuuccuaaugacuaaguuguuaggcaucuuuucauguguuuaucggucauuuguaugucuucuuuggagaaaugucuguucaagucuguuucuuauuuuuaaauuggauuguuugccuuuuuguuuuugaguuuuaugauugauuuauaucuuuugguuacaaguccuuugucagauauaugauuugcaaauauuuucucacucuggguagguugucuuuuuacuuucuugauaauguccucuuuuguugcuuguguuaucuccuuuuuuguuuuuuauucuuuuuaaaguuaucucuuacaggaaggauuccuuuuuucuuaaaaaaguuuuucaauucuuuuuuuuuuugagauggagucucacucugucgcccaggcuaggaugcgguggcauaaucucagcucacugcaaccucugccuccuggguucaagccauucuccugccucagccuccugaguaacugagauuacaggcaugcaccaccauuccuggcuaauuuuuguauuuuucauagagauggaguuucaccauguuggccaggcuggucugaaacucuucaccuugggugauccaccugccuuggcuucccaaagugcugccuauaaucauaggcaugagccaccacgccagccuaaauuuuuuuuuaagcuuuguguuuauguuagcauauauaagaauuuguugccaaauucaaaguaaugaagauuuaucccuauguuuuccucuaagauuuuauaauuuuagcucuuacuuugagguccuugauccacuuugaguuaauuuuuguacauggugugagguaggggucugacuucuuuuuuuuucauguagauagccaguuguccuaguaccauuuguugaagaccaauauaaauguuuuaguuacuuauuuucuguaucccugaguggcauuuauaguuugcuuuggguuuuugacuucauuuucuauucucucaaccucuccucuuuccuuauuuucuucccucaaaacaggagauguggauguuuuguguguguuauuguguugcugcuugauauaugaggcacuuaauaaauaugaauuccccuccuuucuuuuaacuuuguguuguuauuuaacuuuuaaauaguuugugucccaaaaacagauuguaaggaccuuugggguaggagaguauauguucuauuucuuucuuucucaauuuccuuuucucuugaggaguggacaucacucuggugccuagucuaguaccauacaggugguaugcuuaaccuauauugacugaauugugaagcugaacauagaucuauguggauauauuugggguaguugcagaaaaucguucuuaaaaaauuacugguugauguauuaaaaaguucuucaaaguuuuuuacucagguccuuuuaagucauuuuaccaaauguagggauugacgguaguaucuugaucuuuccaaugccuuaggacuuuuuugugugugacacaugguauuuggguaaguucuaguuagguagcauaauauguggcucauuuuauggaugucugaaauuuuuuaaaaaauuuauuauuauuauuguuauuuuuuugagagggaguuuugcucuuguugcccaggcuggagugcaguggugugaucuuggcucacugcaaccuccgccuccuguguucaagugauucucaugccucagccuccugaguagcugggauuacaggcaugagccaccucacccugcuaauuuuguauuuuuuuaguagagaugggguuucagcauauuggucagucuggugucgaacuccugaccucaggugauccacccgccucggccucccaaaguguugggauuacaggcaugagccacugcgccacccuaaaauuuauuauuauuauuauuauuauuauuauuauuauuauuuuugaaauggagucucacucugucacccagguuggagugcaguggcgcagucucagcccacuguaaucuccaccccauggguucaagcgagucuccugccucagccucccgaguagcugggauuacaggcgccugcacugugccuggcuaauuuuuguguuuuuaguagagaccggguuucuccaucuugaccagguucgucuugaacuccugaccuugugauccaccugccuuagccucccaaagugcugggauuacaggcaugagccaccaugcccggccucaaaauuuauuauuuuuuuagaaacaaggucucauaauaaugcucaggcugaucucaaacuccugggcucaagcaaugugccugccugugccucccaaaggguugggauaacaggcgugagccacugcgccuggccugaaaauuuguuaacuagcuauuuaagauucugguaacugaauuuugaauugagaaauauacucauuuuagagguuauuuuguaugucuagauuuugccuuuucauuuuugacaaaugcucuuagucucaaaaauuauuuugaguuugagcaaugaguauguauuacuuuucuaacaaaaaauuaaaauaaacagcauuagaaaauucuuguccagaaauuccagaaguuaacuagugaagucucugaucuuucucucugaaucuguauuaacauauuucccuccaucacacucuuuaguguuugguaguggcuaauguuacuugcccuaagagaucagaccucucuggggaguccguuuuguaaucuauaguccagaugucagugaagggaaagauucagcuugaagguuggccuuugcuuuuuguuuuccaguaaauuuugacucuuaagguauuucuuaguaucuuguuauguaaacacuuuuauuaucugagguguugguuauucaucuauugucuuuuuuagaagacauuuauuauuaauaguggaaacaaaggaaggaauuauuuuauucucuuuaguuccaagcaacauaacaacaucagagaggccagaguaaacacaguauuucauaugcuuuccagguaauugucaaucaacagagucauuuucuuucuuuucuuuucuuuucuuuucuuuuuuuuuuuuacagacgcaaucucgcuuuguugcccguguuggagugcaguguggugugaucauagcucacugcugccuagaacucuuggcuucaagugauccucccucuucagccuccuaaagugcugggauuggauuauaggugugagccacagugccuagcucucuaagagacugauuuaacaagaguuuaaacucccuuaguaggaagcaugauuuaugccagggagaguaggaaggagggaugcaaacuaucuuuugcuaucuccauccuucuuuauggagaaguugggcugguauguaucugaaucuauagcuauuguucuacuuuugugcauauauuuugucuaaaaagcuugacagaagcagcauucuuuucauuuaauaaauuauccuccaggcaugggauccuauucugaggaagauggcccucuaaaaaaugcucucaauaugagcugucugggcuuacugcugauugagcguaccuguuggcagugauuggcgugccaggcagauuuccuguggucugugacugcguuucuaaaguaaacauagugggaaaagcuugccauucugucuuucuuuucagaacaugcaguggauuucugaaguggccaaaggaggauuuguuuggacaaagggacaguauuuaguuuaauuguagaguuacugauuuuauggagucaugaaagaaugacuaagcacugggagauuagaaacaucucauuguaauuaucugguuacuagaccucuuuuggggugggguagggagacuggaggugaugcagaaaggguguacacaaggcauuaauaagaaaugggccuaaaaacagagagucuuuaaagaaacugcugacauuaaaauaaaaguguuauucuaggguauauccuagguaauuacuagagauugaacaaacuguguaacuugaucaaaaucaucauucagcaaacuuugcuguuauguuuaagggcagagagaaaggcucucaagccuuguugccaaggagcuccaugccuaagaaggaaggcagacaaguaaugguuauuauucuguguauuaagcgugcuacuaugggaaaacugaagagggaugggauccuaagcugggguuggggaaagagauguggucccuuccuauuuuggccugaaggaugugaggcugugaaccaggugcacacucuccugguggguacucuggggucugguuuuuuuuuuuuuuuugagacggagucucgcucugucgcccaggcuggagugcaguggggcucacuacaagcuccgccucccagguucacgccauucuccugccucagccuaccgaguagcggggacuacaggugcccaccaccacgccuggcuaauuuuuuuuuauuuuuaguagagacgggguuucacuguguuagccaggauggucucgaucuccugaccucaugauccacucaccucugccuccgaaagugcugggauuacaggugugagccaccgugccuggcccuguuuuguugucuuccauuuuugagagagcaguguuggcuggggaccuagcuugugaccaugagacaaggagauugacuuuuggcuauaguaaugucauguucucauuuugagaaguggcuacagauaagaggcaagaaagcacucuugcugagagaaaaaggcuguuugaaacuaacauguuauggggaguccuagauguugaugaaaucaggacucuuguauuuucauauccuuacuugaauuauaaacuggucagugauucaauuuuggaauuugcggggagggguuagacauuguucuuuuaggaaacuuguugcuauuuuguuugcuucugaauagugaugguauuauuaauauuuugaauugcaguuacaaguuuauuaugugcauuauugaacauagaaguuuuaagaagguaucugggggauauacuuguaucucuuuuuauuaugagugaauguaaguauauuauaguuauaugagaauucgcuucaucuugcuuaaauuguguagagugagaaauaggacuauuaguuaaaugcaugaaauuuuucuauuauaaacuuuuuuuugaacagguaauauauacacaugaauuaaaaauuuaaguuucucuccuagcuugucugccauccacccaauuucuuucccuggagucaccaauguuauuaauuauauucaugaaaaaaagccuauauauauauauauauauaugcacacacauacauauauauacacacacacacacacacacaccucccucuguuuuuguacaguucguggcugauuauagacuacuuuugcauuuugcuuuuuuuuuuuucugagauggaguuucacucuugcugcccaggcuagagugcaauggcgcaaucuuggcucaccgcaaccuccaccucccagguucaagugauucuccugucucagucucccuaguagcuaggauuacaggcaugugccaccaugccuggcuaauuuuguauuuuuaguagagacgagguuucugcaugcuggucaggcuagucuugaauuccugaccucaggugaucugccaaccucggccucucaaaguguuggguuuacaggcaugagccaccgcguccagcgcauuuuacuuuuuuuaaacuucauguaucuuggaaaucauucuaugugaguacauugaagacuuccuccuuuuuuuuuuuaaaugaguuguaugacuaaauaguaugcuguugcauggcauaucaugauuuccugaguccucuauugaugaacauuuaguuuuaucuaaucuuuugcuuuuauaaacaaugcugcaaagaauaauucuauaauauauuauuuuugcacauauaugaauaaauucccagaaguugacauuuuggguuaaaaguuacgugccuuaacauugcuauaaauagauauucccagauuauucacguuggagguuuugaugaaauccagccugcaauacaagauacauuuuuguuuguuuuuugagacaaagcucugucgcccaggcuagaguacaguggcacaaucucagcucacugcaaccucugccucccaggcuccaaccauccucccaucucagccuuccagguagcugggacuacaggugcauacuaccaugccuggcugauuuuuguauuuauuuuauuuauuuauuuuauuuuauuuuauuuguuuugagauggggucuugcucuguugccugggcuggagugcaguggcgugaucucggcucacuacagccuccgccuccuggguucaagcaguucucccaccucagccucccgaguagcugggauuacaugggcacgccaccacgcccagcuaauuuuugcauuuuuacuagagacgggguuucaccauguugaccaggcuggucucgaacuguugaccucaggugacccacccaccucagccucucaaagugcugggauuacaggugugacccacugcgccuggcccgauuuuuguauuuuuuguagagauggggucucacuauguugcccaggcuguucucaaacucaugagcucaagcgauccucccaccuuggccucccaaagugcugggauuacaggugugagccacugugccuggccugcaauauguauuuuaaaaauauguuuaaaaaauguaauuucaggccgggcuugguggcuuacgccuguaaucccagcacuuugggaggucgaggugggcagaucacgaggucaagagaucgagaccauccuggucaacauggugaaaccucgucuuuacuaaaaauacaaaaauuagcugggccugguggugugugccuguagucccagcuauucgggaggcugaggcaggagaauugcuugaaucuaggaggcggaaguugcagugagccaagaucguaccagugcacuccagcauggugacagagcgagacuccauuucaaaaaaaaaaaaaaaaaaaguaauuuuaaaauggcguagaaacaugucaugugucauuuuuugaauuaaaauaugacuauaguucagugaucaaaagcaaauugagcacuuuucuucucauuucuuuuuuuuuuuuuuuuuuuuuuuugagcuggagucucgcuuugucacccaggcuggagcguaauggcgcaaucucggcucacugcaaccuccaccucccggguucaugccauucuccugccucagucucccgaguagcugggacuaugggcgccugccaccacacccggcuaauuuuuuguauuuuuaguagagaugggguuucaccauguuagccaggauggucuugaucuccugaccuugugauccacccaccucggccucccaaagugcugggauuacaggcgugagccacugcgcccggccucuuuuuuuuuuuuuuugagacguaguuucgcucuuguuguccaggcuggagugcaauggcuagaucuuggcucacugcaaccucugcuggguucaagcgauucuccugccucagccuuuugaguagcugggauuacaggcauccaccaccaugcccggcuaauuuuuuuauuuucaguagagacagaguuuugccauguuggccaggcuggucucaaacuccugaccucaggcaauccacccaccuuggccucccaaagugcugggauuauaggcgugagccaccaugcccggccucuucucauuucuuguuugcuuuucucuuuugacuuggcaagaauuuugugacuggacgaggcaggaauaaguuuuguuuccuuguagauguuaccaauacugccuucuagagauggguacuagauacagaagauuuacugaauaauugcuucugcguguguguguguguguguguguguguguguguguguguguguguuucuuuccaauauggugaucuaccaaacuuucuguaguuuucaauacuuguaguaauggaugaugauugugauaucaggauuacaauuugauuuaacuuuaaaaacaacuuucuggaauuuauuggauagaguaugauuuaacuagaaagaauaggaauagaggcugggcgugguggcucacgccuguaaucccagcaguuugggaggcggaggcggguggaucgcuugaggucaggaguuugagaccagccuggccaacauggugaaauccugucucuacuaaaaauguaaaguuagcugggcaugguagugcacaccuguaaucccagcuacucaggaggcugaggcaggagaauagcuugaaccugggaggcgaagguugcagugagcgaagauugcaucacugcaguccagccugggugacagagcaagacuccaucucaauaaaaaaagggaaaacauaguauuaacauuuuaguguguucccuuccauacguuuucuaugcaagaugcauauaaaaaaaaguuuuuauuuuauaaacaaaaauggcaucauuuuuguuuucuaguuugcuuuuuuauuuuuuuugagauggaguuucgcucuugucgcccaggcuagagugcaguggugugaucuuggcucacugcaaccucugucucccagguucaagugauucuccugccucagucucucaaguacgugggauuacaggugccugccaccaugcccagcuaauuuuuguauuuuuaguagacaugggguuucaccauguuggccaggcuggucucaaauuccugaccucaggugauccacuggcuucggccucccaaagugcugggauuaccggcgugagccaccgcucccggccuaguuugcuuuucuaauuguuuucuaguuugcuuuuuucacuaaaaugauugcagauaccuuuaaaguccaauaagaacagauuuauuuauuuauuuuuuauuuuuuauauauuuuuuugagauggagucucgcuuuaucacccaggcuggagugcaguggugcgaucucagaucacugcaagcuccgccucccggauucaugccauucucccaccucagccucccaaguagcugggacugcaggugccugccaccaugccaggcuaauuuuuuguauuuuuaguagagacgggguuucaccguguuagccaggauggucuugaucuccugaccucaugaucugcccgucuuggccucccaaagugcugggauuacaggcugagacaccgcgcccggcaagaacagauuuuuuaucaucauuguugguaacugcauaguaugcuguuguacggauguacuguaauuuauuucccacuucccuguucguuaacauuuaggauuauuucauuaaaaaaggaugaccaaaacaaagaaagagaaaaaagaauuaaaaaaaaaggaugaccagcugcagugaacaacuugauauguucaguuugguauacuuuuuuuuuuuuuuuugagauggagucucgcucugucaggagccauggugcccaccccauuuuagcauacuugauaaauuuuuccuuagaugcauucuuagauuuugaacugguugggugaagagauguugccaaauuguccuauguauuacuacuuuuuauucucaucagcagugcauuaaaguguuuauuugauuauauucaauuacauucuuuuuuuuuuuuuuuugagacagagucuuguucugucacccaggcuggagugcaguggggugaucuugacugugcaaccucugcuucccaaauucaagcgauucuugugccucagcaucaggaguagcugggguuacaggcgugcaccaccaugccuggcuaauuuuuguauuuuuaguagagaugggguuucaccauguuggcaaggcuggucucgaauuccuagccucaagugauccacgcaccucaggcucccaaagugcugggauuacagguguaagccaucgugccuggccucaauuacauucuuaagugaccguuuuugaaaauguaggacuagagugaugguuagguuuuuugauauuuuaaggaaaaccauguuaauguugaauaggaauaaguuuauguuggaaaaauauugaagcaaucauaacucguuuuggaaaccgagcugcuguauguaguacaacccaguuuauacuaacauuguuaaggcacagcucucuuuuugcgcuuuucuuuuggaauuuuuuuuguaaauccauaaaacauaacuauaaaaauuucauuuuaguaaaagcaguguccuaauauagcuuaucugagaaauauagcaaauuuuuguuagguauaaacuuaguaaaguacagacuuaaaguguaugagcuugaaauaugauugaauagugguggacaggguaugaaauuucacaguauuucauaguauuugaaauuguaugcaguguauaaaauuccuuauuugauaguauaugaaauugucuuuucaguagccuuugucauugcucaggugauguuccacauuauuuuucgcugacaagucacuuaaguugcauugaaaggguuugaaguaacauaauaagaucuaaauugucaaugaauaaaugaaucucuaaagcccucauuucaguucucuuucuuuagcaagcacaggguuccuuaucuuugaaggcuguccaugacucugcacguuuuccucguccgucagauucauacugaggaguaugaaucuugccuaagcaagguaaacaugcuuggauggugagggacaauaagcaaagccugcauucucaugcucagguacaccuaagguguagcuuuaccuaguggugcccuuauauuuguuucacuguuguagccuuucuuuuuuccauguuuccuaaggaauuggaaaaguagagccuugcaggaaagcgucuugauauacuugguggaauagauuauuuacuugucuuucucucugcagugaacauggagcuuguugagggcagugccuggcagauugccugguacauuaaguacucagugaacuuaggaaacuggaaccaagagccuuuccauuucaugugucuuuccacuuuuuucuucuuuuguuuucuuuaacuuccuauugugaaauaauuauagauucacaagaaguugcaaaaaauguacagggaguucuuguuuacccuucacccaguuucccccaaugguuacgcauauuuuguuguuucuccucuuuuccugcugugcugugucuucuuuucccuacguuauccuaguuuucuccucuuuuuccuauuuuugaucaugcuuuuggcuugccauuggcaucuaugggauguacugaacucucugaacuaaauguugcugaauuacucuccuaaggcugcuugugggaaugcaugugaugguucuuucucuucauuuauucuuuguggaucacuugcuuaguaugaggugcugugccagguacuaguuguuccucuauauucaagcuuuucagcucuuauuuugagaacauuaugguggauauaucuuuccuuuguaggucuuuuuccuaaaugauacgugugucuaaaguacucagagauguguaucuauuguuggugagaagaaggagcugcauuuuggugaaaauagcccuggauuuugaauuagaaagugaaguucaaaucuugguucuggccaggugcgguggcucacaucuguaaucccaguguuuugggaugccaaagugcgagaaucacuugaggccaggaguucaagaccagcaugggcaacauagcaagaccccaucucucuaaaacaaaacaaaacaaaaaaaaaggaaucaaaauucugguucuguuucauacuugcuaugugaccccagaagucacuuugcuucugaaucucuucuugucuguaaaauaggcauuauaauuacaaucugacagagguuuuguagggaauagagaaaguagcauuuguaugauaacuuaauacauuggaagguacugcuucaaauaugaaguagcuauacuuauuuuauugaugaaaugaaagccaaauuuaaaacuauugguguauuaauucuuuauagcuugacuucuuuauucaguaacacagaaagacuucucuuguuuuuuuaaauccucauccuucuuacaccuucugucuucacauuaaauacccaggacuuaauagaguuuucuuuuuuuucaacuggguauaaccuagcucccuugggaaauuugggauggccaugucagcugucauacuguaucaaaugacauaucagauguccucuucucucuuuuuuuuuuuuuugagauggagucucgcucugccuccaggcuggaaugcaguggugccaucucagcucacugcagccucugccuccuguguucaaagugauucucuugccucagccucccgaguagcugggauuacaggugcgugccaccaugcccagcuaauuuuuguauuuuuaguagagacgagguuucaccauguuggccaggauggucuccaucgucuugaucucuugaccuugugaugugccugccucggccucccaaagugcugggauuacagaugugagccacugugcccagccuguucucuucucuucuuacucaccuaagucuggggauuuuucuguuucaggaaccucuuagaaaauuucucaagcaggcugggcgcgguggcucaugcuuguaaugccagcacuuugggaggccaaggcgggcagaucaccugaggucaggaguucaagaccagccuggccaauauggugaaacccgucucuucuaaaaauacaaaaauuaacugggacugguggcgggugccuguaaucccagcuacuugggaggcugaggcaggagaaucgcuugaaccugggaaguagagguugcauugagccgagauugugccacugcacuccagccuggauaacagagcgagacuccgucucaaaaaaaaaaaaaaaaaaaaaaaaaugaaagaaagaaaaucucucaagcuagcauauaugcuccuuugugcuuagcuuuuuaguggauuucaccguuagaaaccaacucuucauguguuacuagaaacauuuuuauuuuugaagggagacuugcuuuucauuuguacaugcacauggaauacuuaguauagaaaguggggcauaaaaugaauauuuuaaaauugaaauaauugacaauuuuuuuucuuaaaccuugucuagaugcaggcaaacuuuuaaaucauuaagggacagacauuuauagaacaccccuuccaauaauagcaggauacacauuguucugaagugcauauggaacauuucaggauagaccauauguuaugccauaaaacaagccucaauuaauuuaacggauggaaaucauacuauguucucugaccauaauggaaugaaauuagauaucaauaacagaaggaaauuuggggaauucagaauaugugaaaauuaaacuacacacacugaaaucaccaaugauucaaagagaaagccacaggaaaauuggaaaauacucugagauaaaggcaaaauauaucauaucaugaugaugaugguugcaaacaaugugaauguacuuuauaccacugaauuaauuguacguuuuaaaauaguuaaaauggcaaaucuuauguauguuuuaccaaaauugaaaaaaacaaaacaaaacagaaaaacccugggcugggcgcacuggcucaugccuguaaucccagcaguuugggaggccaaggcagguggaucaccugagaucaggaguucaagaccagccuggccaacauggcgaaaccccauucuacuaaaaauacaaaaaauuagccgggcauggugguggguaccuguaaucccagcuacuugggaggcugaggcaggagaauagcuuggacccaggagguggagguugcagugagcccagaucacgcaaaugugcacuguacuccagccuggguggcagagugagaauccaucucaaaaaacaagaagaagaagaaaaaaaccccugccacucauuuuucaacaaugaauguuuauugagggccuacuaugcuucaugcgaaaaacaaagaauauaucauaagcuaggggauacagcaaaagcaguucccagaaggaaauuuauagcuauaaaugcuuguauuaaaaaaagaagaaagaugucaaauccauaaccuaaucuuccaccuuaagaaacuaaugaaagaagaauacacuaaauccaaagugagcagaaggaauauaauaaauaaaaucuagaauggaaauaaaugaaauagagggaaaaaaaguagggaaaaucaaaccaaaaauagguucugugcaaagaucaacaaaaugcacaaaccuugagcuagauuaauaaauuaauaaaaugaggaaugaaagaagggacaucacuacugaccuuacauggaaauuaaaaaagauuauaaggaaauacuaggaaccauuuuaugccaacaaguuagauaacacaugugaaauauaugcauucuuugaaagacacuacugaaauuaacucaaaaagaaauagaaggucucuuuuguuuguuucagauggagucuugcucuguugcucaggguggagugcagugaugugauguuggcucacugcagcguuugccuccuggguucaagugauucuccugccucaaccucccaaagaaauagaaaaucuaaauagaccaauaaaguaaagagauugaauuagcaauaaaaaagccccucccaaaaaagcuuagguccagaugacuuugcauuuugugauucuaccaaauauuuaaagaagaaucaacauaaauucuccacacacucuuucaaaauaaagaagagguauuacuuuccaguuuauccuaugaggacauuauuaggcugauaccaaaaccaggcaaaaaugucacaagacaagaaaacuacagaacaguauucuuuauggauauagguguaaaauaccucaacaaaauacuugcaaacugaacauagcaacauaucggaagaauucuguacugugaccgagugggaauuaucccaggaaugcaaaguuggcuuaaugucuguaaauuaacguaacaugccauguaauagaauaaaagacaagaccaacaugaucaucucaauaguggcaggaaaaacauuugauuaaauccaacauuguuucaugauaaaaaacauucaacaaauuagaaauggaagggaacuuccucagugugauaaaggccaucuuugaaaaccuacagcuaauaucauacuuaaugaugaaagacagaaugcuguccuaagauuaggaacaagacauauagucuuuaauuuuuuaaaauuuauauauauauagauauuguuuauauagacggaguuuuacuauguugcccaggcuggucucgaacuccugagcuuacgugauccacccaccuuggccucccaaagugcugggauuauaggugugagccacugcgcuugaccaaaacauguauagucucuuugacacuuagcuuuaacauuguauuggagguucuagccgggacaauuagggaagaaaaagaaagaaaaggcguucauauuggaaaggaaguaagauaaucucuauuugcagaugguaugaucuuguauauaaaacauccuaaggaaugcacuauaaaacuguuaugagcuccucaaaguugcagaauacgggaucaauauacagaaauuaauuuuauuguuacacauuuacaaugaauaauucaaaagugaaaccaagggaacaauuccauucacaguagcgucaaaaagaauaaaacauuugggaauaaaguuaacaaaagaaaugcagaacuuagauucuuuuuuuuuuuuuugagacagggucucacucgucgcccacgcuggagugcaguggcauaguaucagcucacugcaaccucuaccuccugggcucaagugauccuuccaccuuagccuccugaguaguugguaccacagguguauaccaccacgccuggcuaauuuuuguuuuuuuuagagacuagguuucuccauguugcccagguuggucucaaacuccugaauucaagugauccaccugccucgaccucccaaagugcugggauuacaggcgugagccacugugccuggccggaacuuacauucugaacuauaaaacaucauugaaagaucuaaauaaauggaaagauacucuauguucagggauuggaagacuuaauauuguuaugaugguaauauuccccauauagauuuagcacaaucccuauuaaaauuccaggccaggugugguggcucaugccuauaaucccagcacuuugggaggcugaggcaggugugaggucaagaguuugagaccagccugaacaacaacaugcugaaaccccaucucuacuaaaaauacaaaaauuagcugagcgugguggugcacgccuguaaucccagcugguugggaggcugaggcaggaggauugcuugaaccugggaggcaaaguuugcaguaagccgagaucacgccacugcucuccagccugggugacagagugagacuccgucucauaaacaaacaaacaaacaacaaaaaaacccaguugccuaguuugcagaaauugacaagcugaucuuaaaacucauguagaaaugcaagggacccagaauugccaaaacaaucuugaaaaaaaguuggaggacuuucauaacuuacuacaaaguuacaauaauugagacaaucugauacuggcauaaagauagacauauagaucaauggcauagaaugagaauccagaacuaaacccuucuguuuauggucaauugauuuucaacaaagugcaaggacaauuagguggagaaagaauaaucuuuuucaacaaaugauggugguacagguccacacaacaaaaaaaggaauuuggacccuuaccucacuuauauauauauaaauucagaauucaucauagaccuaaauguaagaucugaaacaauaaaacucaggcugagccuagugggucauaccuguaaucccagcacuuuggaggccaaggugggaggaucgcuugagcccaggaauucaagaucagccugggcaacauagugagaugccaucucuauuaaaaaagaaaaaaacaacucuuagaagaaaacaugguuguaaaucuucaugcccuuguauuacagaaugguuucuuuuuucuucuuuuuuuuuugauacagguucucacucugucgcugaggcugggguacaguagggggaucgcagcucacugcagccuugacuuccugcugggcucaacaauccuccuacuuuagccucccgaguggcugggacuacaagcauguaccaauuaauuuuugaauuuuuuauagagauaggguuugccacauugcccaggcuggucucaaacucgugagcucaagcagucugcccgucucggccucccaaagcugccgggauuacaggugugagccaccgugcguggcuucuucaguaugacaccuaaaacauaggcacugaaagaaaaacagguaaauugauauuaauugaaacagaaaaccuuuuuuucaaauggcaccaucaagaaaaugaagacaucccagaaugagaaaaaauauuugucauauaucugauaaaggacuuuuauccaaaauauauuuuagaaauucuuaaaaucaacaguaaaaagacacauaacccaguuaacaaaugagcaaaggauuugaucagauacuucuucaaagaugcuguccaaauggccaguacauccaugaaaagaagucaaggccgggcgugguggcucaugccuguaaucccagcacuuugggaggccaagguggguggaucacuaagucaauagaucgagaccauccuggccaauauggugaaaccccgucucuacuaaaaauacaaaauuuagcugggcguggugacgcguaccuguagucccagcuacuuggaaugcuaaggugggagaauugcuugaaccccggaggcagagguugcagugagccaagauugcgccacugcacuccagccuggcaacagaacgagacuucaucucaaaaaaaaagaagcuuaguauccuuaguccuuagaugaaaaucacaaccacaauuagaugccacuuugauuauagauaauuucugaucccuaaucagacaugugccacuggcccugcuaauucuggguaauuucuuuuuuuuuuuuuugagacagaaucucgcucuguugcccaggcuggagugcagcggcacgauuuuggcucacugugaccuccgccucuggguucaagcaguucucccaccucagccuccucaguagcugggauuacaggcaugcgccaccacucccggcuacuuuucauauuuuuaguagagaugggguuucgcuauguuggccagacuggucuugaacuccugaccucaggugauccacccaccugggccucucaaagcucugggauuacagaucuaagccaccaagcccagcccuggauaauuucuaacagauauaaaaguaaagagauuauaacaaacccuggaaugcccaucaccaagcuucagcaguucucaguggauguccaucuuguuucaucuuugagggaguuucaaggaguagaaaaaaauagaagcaauuuuaaucccaauagccuaaaccuaccacaggaggagaaaaaauagaaugaaaacuauguucuacuuuuacaguucacauuuagggaaaaauauguuuaaaauaucugagaggauuuuuaaaauuuacuuuauuaaaauacuagugaaggcaaauucuaaucaugaguaccuuaucugacaccuguguaguauuuguuucuauuauuuucugauggcaaguguacuguaaugcaguugccuuuuuguuguuguuguuuguuuuugcaguuauuuguguugaccagccuauaguuuuuuacaacauguuuuuguggaaauaacugaucugccagcugcauuuucuuaggaauuuuuuucuuaucauuuacuucacuauguucuguaguguugaaagguagauuucccuccacuaugaaaugauagugccugaguuuugaauacuauuuuucuaauugugauuauaaaaguaauauguauucaucauagaaaaaauuuggaaaacacaggaaagcauaaagauaagauuaaggggccuguaauuuuaucagcugaaaguuaaccaauguuaaugauuuuguuuuguuguucaggugaccugccuuuuuaauguaauguggugagcuugaaccuuuuauucauuuuggugcuuuuacauuguguuuggauuuugucguaauuacauuguaguuaaucauugugcacacuggagugagggauagagaaugagagaaaauuaguuuaacucugauuuuuucccuacugcagaauauucuugaguauacuugaguaauuccagcuuuuaaugaucuuuccaagguacacaauuauauauccauccaguuucuagauucuccaguucagagaugacuuguauagauuucccugcaagaccaaagcacuguugacuuuuggugcaagaaauggacuguugggccuuauuucuguacagucuuucuguuguaugccugacugguauuuuacaggcuuuucgagaauuauuucaucuucuuaguaucuagaauuacagagcuagagaacucuaguagaauuucuaguauuuguuaauugaaauaaaaacaucaaauuaagaauuuagaaacacuuuuuauauuauuuuugcauuaaaaaauucauaauacauucauaaugcauaaagguaagcuugaaaaauaugaauacuuucucaguauuaaaacauaugaauaugauauuuugucuguauagauaauucuugguguauguauggaauaauuaucagacauccuucuaauaaguuuccccuuucaucccaggagugaggaucagcaauguuuacagguugggaaccaguucugugaucuuucuagacugcuuguuuccucugaacaggccgcacacucuugcgucugugcuuuguccauauguauuugcacauuccuuuuacuugugauguuuucuaccuucucccuuaccucuacuucuaagaaagaauggaacucaacuuaugacugccagugacuguuuguccuuugauuuucagcccaagcaaacuuuauucuuuggacgaguauuucuggaguaccuuguuugcaacaggcauuauaggcauuaggugaacaaaauauaguuaggucccuaccuucuugaggcugacaguccuguugggaaaucagacaguaaauacgugguagaauugcaccuuaagugcuugaaaguagagaacagcaugcagugacaagggaguaccccuagaauggccuuccaaugggucucugaggagcuagcauuugagcugaagucugaaagaugaaaaagaauagccgggccaauauagguguaaggagaguuuuuggcagaaggaacaacauaagcaaaagcccugaaguaguaaagaguuuggaaccaaaaggaggccagcguauaugacuagagcucagagguauuuggcuuggagauacaaauuugggagacaucaguuuauaagcaugggaauggaugcugguuauuuuggagugagcagugugaggggacaagaggcauuggacugagcccaccaacagagaucuggaagguggguagagaugagagaugaauuaguagaugcaaccagagaaguagcaagaaggcauaagcauuuguuuucacacaaguagggaauuuuugaagaaggaaggggcgaucgacuuuggauugcugcugagugguguaguuuguuaaguacagaaaagucuuccuuggauuugccaacauggcugucacuggugauucugacaagagcugcucuuguggagugagcaagugaagccagaucagagggucuguggaggggacaggaagugugcaucaguggagcuggcugguguagacaacggcuuaaagaagcuucacuguugauggugucauugaugaaaggcaugugagcucaagagagggccuuuguaagaugagugauuuagaggacauuuacaagcugcugggaaugagcuagcggaggagagaucgcugauuccugggagcagacaacuggaagguuauaggucugaggaggcagaaaggaggaguuguugucaucugugugggugcugaaaccauuaaggaagcugagaggagauagggagggagucagggagacuggagugugagucugcaguggaagacagggaaggaccugugacugacaaaugaaagcuggggcugccccggugcugagcugcuuggugcuuagcuuaguugguaggugcagugccccauccuugcaauucccaguugaagcauuacugaguucccucaggcaguuuuaucuuccuuccucuucuaccuacagcauuuucugcaaacuucugguuuaagacuuguccccauacuauuuugacuguguuugucucuuucuucuuucaggcagugaccuucuugaaggccuugaugaagucucuacaaaguuuugugauuuuuaguaguuagcauaguucaauaccugucagaguaaaugcuugcucacugagugaaugugugggccucaaaaugagugggacagugggagggagaaaaaagagaaggaaaggacagaaggaacagguagacuaagaacagacuuccugcuggcagggcauggcagcgcgucuuucuucguuuucgaucauauuguaauuguugcagaaaucauccuaauacagaaaagauugucuuauugauagaaauaugcugacuuagugugaguagauccugcuaauuucuggcuuuaaacuaucauaccuucuuucuggcaugaaacuaccauaccuucuuccagaacuggcuuuaaauuaucaaccuauuggcuuuaaauuucaacccuguuuuccagggagauuuuuauuuuuuauuuuuuugagacagaguuuugcucuuuguugccaggcuggagugcaauggugcaaucucugcucacugcaaccuccgccucccagguucaagcgauucuauugucucagccucccgaguagcugggauuacaggcgccugccaccaugccuggcuaauuuuuguauuuuuaguagagacgggguuucaccauguuggccaggcuguucucgaacuccugaccucaggugauccacccgcccuggccucccaaaguguugagauuacaggcgugagcgaccgcaccuggccccagggagauuuuuuaaugugguuauugauuaacuggugcugguaauuuaauuccuucuugauacucugguauggaauauuauuuuauuaaggcuucuugaacuccuuauuuaugauuugacuucguguuucuuaauuuucuccuucuuacgccccacaugcuguagcugaaacauuuucauguuucaguuaguaaaugcccaugcuuugaacuuucaaugaagcuguaguauagugaaaagaacacaaacuuuggggccaggcagaucugguuuugaauuauugcuugacagcuauuaguuuuaaaaccuuaggcagguuuuuuuguuuguuuuuguuuuuuuuaauuuauuuguuaauuguauuuuauuuauuuuuuuugagacagagucuugcuuugucacccaggcuggagugcaguggcacgaucuuggcucacugcaacuugcaccuccuggguucaagcaauucuccugccuuaccuucuugaguagcugagauuacaggcgugugccaccacacccugcuaauuucuauauuuuuaguggagacaggauuuugccauguuggccagguuggucucgaacuuccccgcccaccucagccucugaaaaugcugggauuacagguuugagccaccgcacccgaccuguuuuuguuuuuuuaaccuuucugagcugcauuucuuaucuucaaaaugagaauaauaaugccuacuuaucucacagguaucucacuaugucugccauaccacucuucaccucccucauuuuacuuaugcuguuuuuccuuaagugcuguaacuauuuuuuuuuuguuuuuuuugagauggagucucauuccugacgcgcaagcuggagugcaguuccgugaucuuggcucgcugcaaccuccaccucccggguccaagcgauucuccuuccucagccucccaaguagcugggauuacaggcgugcgcccuaugcccggcuaauuuuuguauuuuuaguagagaugggguuuugccauguuggccaggcuggucucgaacuccugaccucaggugaucugcccacuuuggccucccaaagugcugggauuacaggcgugagccacugggccuggccaccauaacuauuaaaugcacauccuagccacauuuuaacacaaagcucaagcugaaucuuguuuauauaguuuugacuuggucauuccaagccuucuuaauccauuccuuccucugaauuuucauagugcuuauucacguuccuuauuuggcaggugcaguauuuuacuuguuaaaucuacuaguuauacaucucguguuuguguugaccuccgacauugacaggccuuuucuguguauguaugucuuguccucucugaguaugcuggaaacucuuucaagugaagucauagacuauaguuauuucuuuaguauauucuauagugagauuuuauauuugauaaauugaugaguaaauaaaagugauucagacagacugguaauggauaaacaggguauaugaauauauucgcuccauccauuuauucauucuacaaauacccauugaguacauacguguuagauugaaaaacacgucacaguauuuuguagcuccuccuauugauugguagaauccauuuccucacacuuuuguuuuuguuuuuuguuuuguuuuguuuuuugagacagagucucacucugucgccccaacuggagugcaguggugugaucucagcucaccacaaacucugccucccaggcucaagugauuucccugccucagccucuugaguagcugggauuacaggcgcacaccaccacgccuggcuaguuuuuauauuuuuaguagagaugggguuucaccauguggaccaggcuagucucgaacaccugaccucaggucauccaccugccuuggccucccaaagugcugggauuauaggcgugagccaccgcgcccggcuuccucacacuuuuaaugcggacuggccuugugacuugcuuuuaccaauagauuguggcagaaguaacaugcaaacuguggaucccaggucucaggaguccugguagccucccccuuugucaucuuggagugcuccagccacuacaugaugagcucuaggcuaugccacugaaugguuagagaucauguguggagagaggcccagccaacagccagcaccagagucccagacaugugagugacaccauuguagagccuucagcugcaguaaaaaugccagaugacucaacugcaugaaugaucccaggaaagacuagcacaagaucuucccagcugagcccagccaccucguagacuuaugggaaauauuaauucauuauuguuuuaagcuacuaaguauaaaugguccuccuuuuaauuucuuacaaagaagucuacaguagacuaaaaaaguugucagagcuuaugauugauucucuucuuuccaucccccauuguuaauaguucuuuacugauaguguguguaagugccacagguagauaugguaauuaaggggcuggagauaggugcuauuuuuuuuuuuuaaaaaaaaaggcuuugugcaugugcuuuuucauucuuaaucuuauuugaugcaugcuagagcugguauucuccacagugccacuugggagucaagaccagaggccaaaauucccaacuugaugccucuuuucauuacaucaagaugucuuuuuuuauuguguguuccuuccuucuuguugaaguugguauuuuuaaacuucuuccuguugaccugcagcagaguugguccauuguucugguuccucugauaauuucuacuuuccaggguacuauaaaggagcaugacuaggacaauugucuugaccuuuuauuguuuuggcccuguggaccaagaugaugugacaggaaaagguugagaugcuuggaaccuaacuacuguagugggggcagagaauguugauguuggagaaugaaagggguuuggguuugggaagaguuggaccauuuuuucagaaauauccaaaaugugucccuuuucucaggugacugauacagugacauuuaguguguucaguagccuucauaguagaucuugcuaaaggagaaaacuuuuccugaugaagaagaauaaagauguuuugcuauugucaccuccucuacuguuucuucuguaucauuuuaaugucucucauauucuuuuggaaaauuaugaaaauugaacuuuuuuuuaaacucagaaauaguguuacauucugaauaaucuuugaugucaacacugcuguaagguaauucuucucuguaacacugcucuuuugaaugaugauuauagaacugacugcagggauuguaaacaguaguucauaaucucacuaaaggcaggcaagggcugaguccuguuuauguuuguaucgcagugccucccauugugucuuaaauauaauagacuaauagaccugguuuuuacuuagcucaggcauaggugaccacugguuaugguuaacuuuagaccuagguuuccuuauucuacuuuucccucauggagagccugggcaggacauggguggauggaagagaguuuuacuuccuccuccagcuccaucagcuccucuucuucccccuccuccaacuucucuaacuucaucucuucuuuuucuccuucucuuccaacucccucaacuccuccuccucuuuucccucuccagcuuuucuaauuccuccucuuccuuccacuuuuccuccuccuccaaguccuccuccucuuucaauucuuccaaauccuccuccuccaacuccuccaauuucuccuucuccaguuccucuuucuccuauaauuccuccuccucaugcugcucuuccuccuguaacuccucuuccucauacucuucuucuuguaacuccuccuccuccucuaguuccucuuccuccuauaacuccuccuccucaugcuccucuuccuccuauaacuccuccuccagcuccucuucugccuguaacuccuccuccucauccucuuccuccugaaacuccuccaacuccuccuccuccaguuccucuuccuccuguaacuccuccuccuccuccaguuccucuuucuccuguaacuccuccaacuccuccuccuccaguuccucuuccuccuguaacuccuccucuuccaguuccucuuccuccuguaacuccuucuccuccuccuccaguuccacuuuauccuguaacuccuccaaugccuccuucuccaguuccucuuccuccuguaacaacucgucaucaaccuccaguuccucuuccuucugugacuccuccuccuccuccaguuccucuuuauccuguaacuccuccaaugccuccuccuccaguuccucuuccuccuguaacuccuccucaucauccuccaguuccucuuucuccuguaacuccuccuccuccuccaguuccucuuucuccuguaacuccuccaacaccuccuccuccaguucuucuuccuccuguaacuccuccaacuccuccuccuccaguuccucuuccuccuguaacuccuccaacuccuccucuuccuccaguuccucuuccuccuguaacuccuccaacuccuccuccuccaguuccucuuccuccuguaacuccucuuccuccuccaguuccucuuucuccuguaacuccuccaacuccuccuccuccaguuccucuucuuccuguaacuccuccaacgccuccuccuccaguuccucuuccuccuguaacuccucaucauccuccaguuccucuuucuccuguaacuccuccuccuccuccaguuccucuuucuccuguaacuccuccaacaccuccuccuccaguuccucuuccuccuguaacuccucuuccuccuccaguuccucuuucuccuguaacuccuccaacuccuccuccuccaguuccucuuccuccuguaacuccuccaacgccuccuccuccaguuccucuuccuccuguaacuccuccaccuccuccuccuccaguuccucuuccuccuguaacuccuccaacuccuccuccuccaguuccucuuccuccuguaacuccuccuccuccuccaguuccucuuucuccuguaacuccuccaacuccuccuccuccaguucuucuuccuccuguaacuccuccaacucguccuccuccaguuccucuuccuccuguaacuccuccaacuccuccuccuccaguuccucuuccuccuauaacuccuccuccuccuccaguuccucuuccuccuguaacuccuccuccuccuccaguuccucuuccuccuguaacuccucuuccuccgccagcucuccuuccuccuguaacuccuccuccuccuccaguuccucuuccuccuguaacucuuccuccugcuccaguuccucuuccuccuguaacucuuccuccuccuccaguuccucuuccuccuguaacucuuccuccuccaguuccucuuucuccuguaacuccuccuccuccuucuccaguuccucuuucuccuguaacuccuccaacuccuccuccuccaguuccucuuccuccuguaacuccuccuccuccuccaguuccucuuccuccugcaacuccuccuccuccuucuccaguuccucuuccuccuguaacuccucuuccuccuccagcuccucuuccuccuguaacuccuccuccuccucuaguuccucuuccuccuccagcuccucuuccuucuguaacuccuccuccuccucuaguuccucuuccuccuguaacuccuccuccuccucuaguuccucuuccuccuguaacuccuccuccuccuccaguuccucuuccuccuguaacucuuccuccuccuccagcuccucuuccuccuauaacuccuccuccuccaguuccucuuccucucauaacuccuccuccuccuccaguuucucuuccuccuguaacuccuccuccucaggcuacucuuccuccuguaacuucuccuucuccuccagcuccucuuccuccuguaacuccuccuccuucuucucucacuccuccacgucauccuuuuucccucuuauuuucuaaguuuucugcauuuuaaaauacaauuauuuuuugauuucucuuuuuaugauuuaauugcaaauguuuagaaaaaccuuccuagaagauucagggaggagaacacauauuuauuuguuuugauagcugaaaauauuucugaaaagauacaugggaaacuggugacauuacuugcuuaauuuuuauuuauuuauuuuuugagacaaagucucucucuguugccaggcuggagugcaguggcgugaucggcucacugcaaccucugacucccugcuucaagcgauucuccugccucagccucccacguagcugggauuacaggcacgugccaccaugaccagcuaauuuuuguauuuuuaguagagacaggguuucaccauguuggccaggcuggucuccaucuccugaccucaugauccgcccgccucagccucccaaagucuugggauuacaggcuugagccacugcgcccggccauuacuugcuuuuaaggagagaaacuggguggcugggagggucagggguggaaggcaggucuugcacuuuuguaccuugugaauuuggaacuaugugauuaauauucccugaaaauagagauguagaaaacacacaaaaacaugaaaaaaguccaaaaacaucaguuuaauaagaauaaguguaagagagaauaguuaccuuuuuuaaauuaagaagaaaaagaagagagaauucaaucugcuuaaagccuaggggcuuccagucucuuucauucuuugcauuucguugauaggaauuugugaccuguuuuugaguguacuaagccuuuguugcauaauuacguucaagaagcauaugcuuauuuguuagaaaucuuauacaauuaugguugaaggggagguuuucuuaugauauauauuuauaaaucacaguagggagacuugaacgaaugggaacuuuccuaguguuuacuuaaggaauagagaccuugcucucuugccuguugcuuccugucuaaacaggaaaucugaccucuugagucaaaacagaauuaggcuaagacuucuaauaauguuuucaagguggggaaaggaaacucauuguccaugcaaccuuggaaaauuacuuaucuauacuuuaccucaauuucuuaauuuauaaauaaggacguuaacaccuacuuuauagaguugaagaauuagagauaguauuauauaaaucaguauuacguaagcacagaagcugacaccucauguagcuccuuaaauuguauuauuauuauuauuauugguuaguaucuguucauuuuaggccccuugaaggaguaaacgcuaugaaauuuuuuuucauugagaaugaaugaaaaugaaugauaguuguuuaggggaagaaggaguauaucaguuaucuauugcucuguaaccaaccgcucugaauuuaguggcuuaaauaaaacaacaaugaaauguuauuucucauaauucugugguuuggcuugguggcuuuucugcuuguuuccuuacacuuacuggcauaacugcagucggaugacgacuggaauggguagauggucccagauggccucacucacaugucuggcaguugcugcuggcuguuggucagagcauguugguuccccaaguggccucucauguccaauaggcuaggccagcuuccuuacagcauggccgucccagggcagcauucuaagagggcaaguuccauugcuuguauagcaagucuuugcuugcuuuuguaguugcugauuucacaggguuaagcccagagucauugcaggaggggacuuggacuccaccugggugagguaggaguagcaaagaauuuguggccauuuuuaauauaccaccaaccuggugcuuauuuguucugcuucuuggacuaauaguagguccagaaagagauucuuuugguuucuuaaguuuucccguaucguugauaccuucuuuaguccaacauaagagaugauaaaggaacugcaaguauuacauuuguacuaaaaauuggaaugaaggauaauagcugcuuuugaagcucuuuguugugaaggagggacuaguuccagcauuuggacaugacuggaaagcagaucucuccucaauauaaggaaggauugcucugugagauacuaagucccguugaaugcuauccuucccucacucuucuguguuguuggaagcaguaaaguagaagauggguaguuaugugcuggggcuuugaaggaggguuuuccucauugaaugacuugauguauaugauuccauaccucagaaagaaucucaauguuuuuacguugagauuagggguggggauggggugguauuagaaagggagagaauugcuguguucagacugugaguuacucuacugagaauuuuaauuuuacuuuauuuagaaaacaaagauauguuuucuggaaacuuugaaaguugggacuuacuacuggugugaaaaaagcuucaauuuggcacaguaucagggagguacugaaucuugaagauagguuuccuaugggucuucuugguuuaaaaugaaaggaauuaaguaaugguuuuagaguaagucagaaauaaauuuguacaaugcuccagcagcuauagguuaacgagagagcuuaugcaauuuguguaguuagaacgguuuugguacuuuucucauaucauguauuuuacccuacucaaacaugauuuugagaucuccuaauuuuaauaucaaaacacuaggcccaaauggugcuauugucagcggagaauacugugucaauaacugaucagaauaugagccuauuuccuuucucuuuuuuugagacagaguccagcucugucacccaggcuggagugcaguggcacugugucggcucaccgcaaccuccgucuccuggauucaagcaauucuccugccucagccuccuaaguagcugggauuacagguguccaccaccacaccuggcuaguuuuuauauuuuuagagacaggguuucaccauguuggccaggcuggucuugaauuccuaaccucaggugauccgcccaccucggccucccaaagugcugagauuacaggugugagccaccguacccggccuuuuuugacggaguugcacucugucgcccaggcuggaguacaguggcgcaaucucggcucacugcaagcucugccuccugaguuuaagcgauucuccugccucagccucccgaguagcugggacuacaggcacugccaccaugcccagcuaauuuuuguauuuuuaguagagacaggguuucaccauguuggccaggcugucucgaacuccugaccucaaaugaucggccugccguggccucccaaaguguugggauuacaggcgugagccacugcgcccaccuccuuucucuuuuugugucuuucuuuucuuuguuguagggaggaggagauggaggcuaccacuuacuccauuguaaaguagugugauguaggugcugcccuugacuuuguuuaaugugaccaagccagccacuuuggucaacaguguuuucuauagagccuuccucauuucccauacuugguuuuuuuuuagaagacugagaguaaggcaguaagcugcaguaccuacagugauucagacacagagugguguuagauuucuggugggaaauagaauugaaguuacaaauaaauaugcuagcuaaagcagaagauugcuuuccugucuggugcauuuacaagcugggaaauucuggaaaacaucaaccugccaacuguguggcucauuggcucuucuuugggcuucgauguucuuccugauaaaaauaauaauuauguuauuucgauaugguugccaagccguucaugcuucucgcucugcuugugauuauaaaugauucugcagcaugaauugcuuugucuuugauuuaauguuucauaacauuuggguguuauguuaucugugcuaauuugucguucucuucucuuacuuuucagaauggacugcugaauuaugaaguauuucagacccaguaguagaacaucacucugccacucacuccuuuaucuccuacuaguuauuuaaauuggacuuuuaauauccuaccagcugcucuucagacacacauggugcauuguugccauuccccagauugcaucuuugaaacacaggcucuuaguaaccuucagcgaacaaagaggcaaccucccagauacgucugcugggagggagucaucgugacugcccucuagcuuuugcuggaucuggauuugaauuccacuauggagccucgcauggaguccugccuggcgcagguguugcagaaggauguggggaaacgauugcagguuggccaagaacugauagacuauuucucagacaaacagaagucugcugaccuugagcaugaccagaccauguuagauaaacuuguggauggacuugcuaccucuugggugaacucuagcaauuacaagguaagcugugcuuuagaaggcacuuuuggagguggcugggcugcacugguagaucaaaauuggcccuuauaaaaaucccuugugagcagucagcaugcuuccuugguuucuaguaagacacucaaucagauuguggccuuggguuauuucauucuggagaaaguagaguuuucuuugauacucauugcagaucaaaaaauucucauccuuuagcacuuugacagaaggucaagugaacagauaaggggaggcuuuuuuguuggaaaguugacaagcauuuguagccuugaaguuaauguguauauuauguuuugcagcaaauagguccugagaccuuggugaguugcccuuuauaaauaacaaaugucuucacugauuuucucugggggauugaauugguaauaagguguggagcauuuuaccuucaggucacuguugugaagcuggcccagguaccuggacagaaauagguugucaaggacuuuucugugaccuguguguaauggccuagaggauauccuucaggaucuaaaggucaaggcuguuuaugugaccuugguagggagugggggugggggugggggccaggucccaugggucaaaugagucgugaagguugaccauuuuaccuuucaaagacaguuuuccugaauaaaaacuagauuggacuugaagugcugaagaggugguguuccucucucugcuuccuccccuauucucauccccuuaugcucucuuuucauuucccuagaggguggccccuuugggucaagguugagauggaaggaagaguggagaguuugcaugacugcuaauaggugcuauagacguuguuaaaggggcuuacagacauagaaucuuuugugcuuuuuucauugacucaaucuuuugagauugguuuggacuuaaaaagucacaggacuccuuugcucuaguauguacucuguuuucuaaauacguuaccuauugcccuaauauuucacuuaucacuggauauaaaauuuauccuaccugucuucguauauuuauuuuuuagaccgagucuugcucugucgcccaggcuggagugcaguggcacuaucuuggcucacugcaaccuccaccuccugggcucaagcaauccucccaccucagccucucaaguagcugggacuacagacgugcgccaccaugcccagcuaauuuuuguauuuuuguagagacaagguuuuaccauguugcccgggcuggucuugaacuccugggcucaagcaagccacccgccuccuccucccaaaaugccgggauuacaggcgugugccaccgugcccagccuauccuaccugucuuuaaacucuggcuaaaauucuauuucauucaucuguuuauucacuuagcugaaauuaucaauugcuucuuauguguuuggcauuggugcuggauggugcgaguguuaaaagagaugagaggugauaaagucuagucacuacaauuuuguucuuuuuuaaaaguaauuuguaaaaauugacaaauaauuuuacauacucaugggauaccuaaugauauuuugaugaauauaauuuguagugaucaggucaggguaauuaauauauccaucaucucaaauguuuaucauuucuuuguguugggaacguuuaauauccuccuucuagcuaauugaaacuauauuacuauuaacucuagucauccuacagugguauauaacaccagaaguuauuucuccuaucuagcuguaauuuuguauucuuuaacaaaucucuuccuauaccucucuuccuccuguccuucccagccucugcuaucgucucuucuacuuuuuacuuaugagauuaacuguuauuuagcuucacauaugagugagaacauguaguguuuaacuuucuguuccuggcuuauuucacuuaacauaaugcccucuaguuccauccauguugcugugaaggacgggauuuuauucuuuuucauggcuaauuaauauuccauugaauauaccacauuuucuuuauccauucucuguuguuggacauguagguugauucuuugcuguugugaauagugcugcagugaacaugggggagcagauaucucuuccauauucugauuucuuuucacuugaauaaauucccacuagugggauugcuggauccuaugguaguucuauuuauaguuuuuuauggaacuuccauacuguuuuccauagcagcuguacuaguuuauguucccaccagcaguguauaagaguucccuuuucucugcuacauccucaucagcauuuauuauuuuuugucuuuuugauaauagccauccuaacaggggugaguugauaccucauugugguuuugauuugcauuucccucaugauuagugaugucgaacauuuuuucauauauuuguuggccauugguaugucuuccuuugagaaaugucuguucagauuauuuguccauuuuuaaaauuggauauguauauauauauaauuuuuuuuuucuguugagauguuugaguuccuuguuuauucuggauauuaaucccguuuggcugguccaaugguaaugaguuaucagaauuuaacauagugucacuaaaguugguauacaacuccccacugcuaaauuuuacuggcuuaaaaaaaaagucuccugucagaggaguaauuugcaaauaucuucucccauucuguagcuugucuuuuuacucucuuguuucuugguugcccugaagcuuuuuaguuuaauaucaucccauuuguucauuuuugguuuuguuucuugugcuuuugaggucuuauuuauaaaauauuuucccagacuaauguccugaaacauuucuuaaauguuuucaucuaguaguuuuauuguuuugggucuuacauuuaggucuuugauccauuuacaguugauuuuucuauagggugagagauggggaucuaguuuuauucuucugcauauggauauccaguuuucccaguaacauuuauugaagagacuggccuuuccccaaugaguguucuuggcaccuuugucaaaagucaguuggccguagauauguggauuaauuucuguguucccuguuuuguuccauuggccuaugugucuguuuuuaugacaguaccagguuguuuugguuacuacagcuuuguaguuuacuuugaggucuguuagugugaugccucuagcuuuguucuuuuugcucaguguugcuuuggcuauucagggucuuuugugguuccauacaaauuuuaggacuuuuuuuucuauuucugugaagaaugucauugguauuuugauagaauggcauucaaucuguagauugcuauugucauuuuaacuauauuaauuccucuaauccaugagcaugugaugucuuucuauuuguuuguauccucuucaguuucuuuuaucaguguuuuguaguuuuccuuguagaggccuuucaucuccuugguuaaauuuauuccuagguauuuuauuuuugguagcugucauaaauggaauugccgcuuucuucuucuucuuuuuuuuuuuuugagauggaguguugcucuuuugcccaggcuggagugcaguggcguaaucucggcucacugcaaccuccgccuccuggguucaagugauuuucaugccucaaccuccugaguagcugguacugcaggcgugcaccaccauacccggcugauuuuuguguuuuuaguagagauggggauuuacuacauuggccaggcugguuucgaacucgugaccucaggugauccacccgucuuggccucccaaagugcugggauuacagucgugagccacugugcucggccagaauugccuucuugauuucuuuuuuuagcuaguuuguuguugguguauagaaaugcuacucauuuuuguauguuuguauccuguaaccguaccgauuucagucaucaggaguaagaguuuuuugguagaaucuuuagguuuuucuguauauaagaucaugucaucugcaaacagagacaauuuuaccuacucuuuccaauuuggaugcuuuuuauuucuuucucuugccuaauugcucugggaaggacuuccacuacuauguugaaaaagagggugagagugggcauauuuguacuguucuaguucuuaaaagcugaaagcuggcugagugcgacggcucaugccuguaaucccagcacuuugggaggccgaggcaggcggaucacgaggucaggaguucgagauuagccuggccaacauggugaaaccccaucucuacuaaaaauacaaaaauuagcugggcaugguggcacacccuguaaucccagcuacuugggaggcugagguaggagaauugcuucaacccggaaggcagagguugcagugagccaagaucauggcauugcacuccagccugggcgacagagcaagacuccaucucaaaaaaaaaaaaaaaaaaugcugaacgcuuuuccucauucagucagauguuagccaugguuguuacauuuuuaagggcuaugaaaucaccuugucuauguuuuugggucacaacuccaccacuuuuucuaugugcauauuaggaugcuucugacuuaagaguaauuggaaacugacucaaaugaccuaaaguucuccaaggaaaucuagugucucaaauaaauccaguaguaguuaaggcaauguccagggaaggagaaugucuucuuguaccuuucacuugggggaaggaaaccuuucucagaagcuccccagcagacuuuucuuucaucacauuugcuagagugacuuugcgugcccaucccagcaccacuggaaaaugaguguccgugauugccuuugaaugccaugcuuaaccuauuggucuuaagugggggccucccuugagugaagcaugugaccaugugaaggaggguggauacuugaauaguaucaggguccuaauaggaaaaggagguuggggaugggacugggguagcauggauguuaaauuauuagauuggugcaaaaguaauugucuucaaggagcucauagucuauggagaggaaacugauaaauaaacaaguuauacaguacaguguagugugugcaguaaugcaaauauacagaguucugugggaagacagaagaagaaaguaguaacacugccuaaaggaauugagaauuuugaagauugguuaguuuuuccagaaugacauuugcaggguuacaaaggaaugaaagauuaagacuugacucuuggugaaguaauuccuaaacaaggacagauuagugugaaggaaagucaggaaguugggguuuaccacuaacuugcuuguaaccauggacaacucaguuaaaccuguuuguacaaugcagauauuagacuagauaaucucuugggagcccucaagcucuaauauuuuauauuacuuaauagaggugguuuuugcacucaagggcuaugucuuaugguuuguaauuucucuaaguguaguggcagccugcauguucacaucuggagcccagaguauggaacaucaugggugcucaacaaauacugguuccaugagugaucucaggaacuuagacuccucagccagguauugcugguugcuuuacugaaaccuggaaacuaccuuuuagauccugcuucccuuuuuuucuuaauuauaagucaagauuuuuaaaauugaaacccugagguacaguuuggcuuuauuuggaauuuuuaaaauagauaauuccuuuaauauuuuagauuaaagggauuagcuuuauauuaaacaaaacuuugaagcuuggcuucuugaauuuuuuuuuuuuuuuuuuuuugacagagucucacucugccacccaggcuggagugcaguggugugaucuuggcucaccguuaccuuugcuuccugguucaaaugauucuugugccucagccuccugaguagcugggauuacaggugcgugccaccaugccuggcugauuuuuuucuguauuuuuaguagagauggggcuucgccauguuggccaggcuggucuccaacucaugaccuccagugauccgacugccucggccucucaaaaugcugggauuacaggcgugagccaccaugccugaccuugggaccuuggcuucuugaauuuuuuuuuuuuuuuuuuuuuuuuugagauggagucucacucucucgcccaggcuggagugcaguggugcaaucuaggcucaaugcaaccuccaccuccuggguucaagugauucuucugccucagccucccgaguagcugggacuacaggcaugcaccaccacaccuggcuaauuuuuguauuuuuaguagagacaggguuuuaccauauuggccaggcuggucuugaacuccugacugccugauccaccagccucggccucucaaagugcugggauuacaguugugagccaccgugcccggcuguuuuuuuuuuuucuuuaagggcugaaaagagaauggagaaguaauuuuggcuugcccaaacaauaguacuugcguguuguuauuccuuuucuuaacagggaagguagaugaaugucagcucaauggcuuauuaaaaaaaaauacggccagguauagugaaucacgccuguaaucccagcacuuugggaggccgaggugggcggaucaugaggccaggaguucacgaccagccuggccaacauggugaaaccccguaucuacuaaaaauacaaaagucagccgggcgugguggcacgcacguauagucccagcuacuuggaggcugaggcaggagaauugcuugaaccugggaggcagaguuugcagugagcugagguugcaccacugcacucuagccugggcaauagagugagacuccgucucaaaaaauaaauaaauaaauaaauaaaaauaaaaacguuggcuggagcuugaguaacuuugcauuuaaguguuucuuuacagacagauguauaugugguaucaagggcaauuuaauggcuaccauuuauuccuuacuuaguuucagguauguucucugucuuaucucauguagucuuuauaacaacccugcaggguaaauagauagugguauccuaauuuuuauacaggaaguaacugaggcuuagaaauaaugaggcaauuuuaacuagugauuauggaacuggauuuaaauauaggucucugauuuucuggauagugcugcuuucauaagaacaggguuuaguaaacuuuuccuuaaaacccagauaguaccuauuuugggcuuugugagaccauaugcucuuugaaauauucaacuaauaugaaucguuguauugcaaaagcagugacagguaauagguaaaugaacaggcuuggcuguguuccaguaaaacuugacuaccuuaugugauauuucagaaaaacuugccucucucacucagacucauauugggaucaguuugaauucuguuagcuuacugcuaaucaucuacagugagcuggccuugaacuuucuuugguaguagaagccaucuguggguugaguaauugguuauuuaaauaagcauacauucagaacagcacuaugcuacaccauggcggugcuguucaacauggaaggauuugugaagguucccuguugucauagugaccaugggaauccuggaaggagacauuaaauaauaaaaauaaccccaaauuuugaauauggcuguccucauugaucuggucuccucuuccugucugccuuaaaacuugcagaaagggaaaagugguggggauagguucuugcacucacuuccagcugcuucuguucuuccuucuucccucaucaggugagaagggaugaaauguuaagaaugaccugucuuggagagaccgccugggcuaugcaacuggagggaauuggggggggacuuaugcuacgcagcuuucucaggucaucuugacagcuuugauucugcgcagcagugcaguaacaugcagccucacauccacaccacaccagugcaaguaccuguaccuuuacugggaucauuggaaacaacguuucuuagcaggggcuuggugcuuuuugugaauacagucccacaggccuuucuccgcaguuucaaaauucaaagcacucugaaagccuaguguuuuuaauuacuaauuugccauuugaccugaagugaacuaacaugagacuauuuauagucuguauguaccuggcuaggcuauguuucacuacaaaaauauuaaugugcuugauugugaguugcugccccggauucuauucaaggggcuauauuacacauacacacacacauacacacuaucucucucuccgugcacuauuuuaucuuccuaaaaaucugaaaaauucuuuauuccagaauauaccuggccucuagaguuuuggauaagcaauuguggaccuguauuuaauacuguacaauaauaaugauagucuauggcuguggugcauuuacugugagccagaaauugugcuaaauauguguucauuuuuuaaauuguaauuaccauaugagguagacauuauuuuucccauuuuacaaaugagaagacugaugcucaaaaaauuagcuaacuuguucaaggugauaaaacuaguaauuaagauuucugagacuugaacucaaguccuuaugcaacaaccagaguuaauuaaacacguaugaugugccaguugcuguacuuacacaguagggaaaaacuggguacggucccggcccagugucuaagcugucuaggucuguccagucugugugggcuucaucuccguguacauuugucucaaggcccauuccgugcugccuuauauuugaaauuuguggguucccuauuaacccagagcuuccuuuucuucugcccuguggucugauuggaggaacggggagggcacaugagagggcggugcacaguguaggauaggaaauaagucagugcuaaauugcaucauaggaauuuguauaaauucugucaugcggagaaagaagaaacauuaggguaugcuuaguuggagaggccuugacagagaagugggauuaaagaggguuaugaagaaccaaaagguguaagcugcagaggguucugagaaagucucucuuccuuuccuguuucucccuuucugguuagcacuuccuugguagacuguaaaagauguagucucuccuaagcugcuuuacagagcacauguuaccgcuagaucaaguguguuuaugggcaggaggagacuguguugacagauaagggagguuccucucauuuccuuugccuaucuccaaaaccuuggcuuucaucgagguuuuuauuuucccgcuuguguccuugagaggagagccagaaaagauuauuggauucagauuaagugacuucuguuuccuuuucuggcagucuccucgcuacugccaccaagugacacaucuuuucagagacuguccauuuuuuuccagguuuuccuugcaguguuuguccuauuggcuguaggaggugaauuuccaugguuuaaucuaaaaagacaggugccucugucauaaguagaaaagcuacaguuagcagcacuaagcaaaagcaaaaaaccuuaggaaagguuaugucaagaaaauuuauauggauuguugguaaaaaugguguccuugauguauguaauuaguggcauuucuuccuaaauguguuuaccuauaugcaagggcaacaaaguguacugaaaguauuuuagauuugagugugaauugucuggauuccucuucuggcucugccacucauauauuugagcagguagcuuucucucuagaauguauuuccucaucuguaaaaggggucugaugauauuuacuacauagaggauucaguaagcccauguauauaagcccauguagugcuuuuaauauguagcauguggucaguaaaaggaaguugacgaaaauguauauuaugggaccaaauacucauaaaaucugaggaaaguuaacuuuuaugugggacugagguuacauguuuucuuguggccuagucaguuagccugugcucuggaacagaggccuugggucucuuguaauaagauaugaauccaucaguuguucaguguugauaauaaagucccugaguagagcagcagcuggcugggaagucugugaagggugaguuaaaaacugacugguauaaaacaauccauugacugaggcccccuguuuuaggaagauuucacuugauuguaaaauuuuuaacacuuauacuuucccuuguuucagaaaacuaaaauuuaaauaaggauacaugcaacagaagaaguaauaaauugaaugucaaggcagaaaguaaaacagcuggagugagaacguggaccuaacaaugaggcuaaugauuaacagcuaauguuuacuaguagcuaacacuuauuaagcgccauuaugugcuagacacuguuaaguguuuugcaugcauugccugguguaauuauaacauagaugcuguaugauaagcccugugauuauuccuauucuuuaaguggggacacugaagaaacuugcccgagguuacaugacuagaaagugucagaggcaggauguuagucggaauagucugacuguagcacccacugcugaagcaauaugcaguauuuucuuuauaauuuuguagcagagguaauaguagcauuuauuggagcauaaaagaaaaggguguaaggacguaccccacaguugauuucuuaaagggagggaauuuugaguuagacuuuaaugaaaaauauuuaagaugaauauauuuaaaauaguucuuugguccuguuagaaucaugaccauauauacuuuuuaaacuuuuuauuuuggaaaauauucagacaugugaaaaccucagaaaacaguuaaaaaaauuuucauguauguuucaccuggaccccaguguuaacucuuuaucacauaugucuuguuuucucuauuauuaugcuuauuguaaucauuugagaguaguagacacagugcuucacugcaauaccuguguauacagugguucuuagaaacaaggucauucauuuauauaauguuaggacagcuaucuaaaucaggauuaagauugauggacuacuggccgggcgcaguggcucacaccuguaaucccagcacuuugggaggccaaggcgggcagaucacgaggucaggagauggagaccauucuggcuaacaaggugaaaccccgucucuacuaaaaauacagaaauuagccgggcgugguaucgggugccuguagucccagcuacucgggaggcugaggcaggagaauggugugaacccgggaggcggagguugcagugaccugagaucaugccacugcacuccagccugggcaacagagcaagacuccgucucuuaaaaaaaaaaauugauagacuauuaauaccugauuuacgagacauacucaaauuucaccuguugucaugcuaauguccuuuauagcaacaagaaaauuuuuuuuuuuuugagacggagucucccucugucgcccaggcuggagugcaguggugcgaucucggcucacugaaagcuccgccucccggguucacgccauucuccugccucagccuccugaguagcugggacuacaggcgcccgccaccacgcccggcuaauuuuuuguauuuuuaguagagacgggguuucaccguguuagccagaauggucucgaucuccugaccucacgaucuccacccgccucggccucccaaaguguugggauuacaggcgugagccaccgcgccaggccuuuuuuuugagacggaguuuugcucuuguuacugaggcuggagugcaguggcgcgaucucggcucaccgcaaccuccgccucccggguucagugauucuccuggcucagccucccaaguagcugggaucacaggcaugcaccaccacccuggcuaauuuuguauuuuuaguaaagaugggguuucuccauguuggucaugcuggucuugaacucccaaccucaggugauccacccaccucggccucccaaaguggugggauuacaggcgugagccacugcgccuggccgaaaaaaaaauuuuuuuaauccuguuucaugauccaguucuggaacacacacuacauuuaggucucauaucuguguaguuuccuuuuuuuuuuuuuuuuuuugagacggaguuuuucucuuuucucuuguugcccaggcuggagugcaguggcacgaucucagcucccugcaacuuccgccuccccggaucaagcgauucuucugccucagccucccaaguagcugggauuauaggcaggcaccagcaugcccggcuacuuuuguauuuuuaguagaggcggaguuuuaccauguuggucaggcuggucucgaacuccugaccucaggugauccacccgccugggccucccuaagugcugggauuacaggugugagccaccgugcccggccauaguuuccuuuacacuggaacaguucauugucagucuuuccuuauuuuucuuggcuuaauaauuuugaagaauuaggucaccuuacuguguguaguucgucaauuugacguuguuugaugcuucuuccugguuagauuuuggcaggaauacuguagaugugacauauccuucucagugccucacaucgggaggcacacgauaucucuuccuccuacgugguuaaagagguguuugccagguuucuucaaaaaguuacuuuuuuccccucuuucuaauuaauagauaucuuguggggagauaguuugagacuguauaaauauccuauuacucauuaaacuuucaccuauagcuucagaauccauugaugauuuuuacuuaaaacaguuauuaggccgggcgugguggcucacgccuguaaucccagcacuuugggaggccgaggugggcggaucacgaggucaggagaccauccuggcuagcacggugaaaccccgucucuacuaaaaauacaaaaaauuagccaggugagguggcgggcaccuauagucccagcuacacgggaggcugaggcaggagaauggcgugaacccuggggggcagagccugcagugagccgagaucaugccacugcacuacagccugggugacggcgagacucugucucaaacaaaaaaacaaacaaaaaaaaacaguuauuaauuauuaugcugguugccaaagggugauuuucuaguucaccauuccuucuucauuuauuaguuggcuucauauguuuuugaaauguauauccuauguuggcuucauauauuuuugaaauguauagaaagaaugaaguucuaucaaaauagaauauuuugauaguuaucacaaaaaggaacugcuuugaaggagaaaaaaguguuuaaaauuaauguuacuuagguacauuuauauucauacauuguuuaaggcaaccuaauaauuuugugaacauauaaaaaugcgaugaaguuugguuugagccugaaguaaaaauggagcgauggcuaccugaaaguuuucauaaauauuaugaagggaauacaaaaagacauguaauagcaaaauaucuuccuggaguuagcaggauauuaaaggacgcuuugugggaggggaagaaaagcaaaacaugcaaauggaugacacaaucugaguauaagugagauccagguuauucagcuauagacagaacucaccagcuugaacuguggguuaagggggaauugucagacagcauuggaguaaaaagaaaaccaagcugguggcccugccaaguuaucuauugaacagguuagguagagggagagucugugacaaggaccaugguaagaaauccagagaaaucagaugaaaauggcucgaaguagagaaugggaggucaaccuggaagaauuauuugaucuacagcugcauuuuacaugggauuuuggggaggggcaaagaaggagcuguuagagauggcuguccauuauggaacaaauaggugugguuauaaauggggaagaaguucuuugaugacugguaggaaucucuugguguuuaaacauccuuaaaagcuuuguggaugagauggccuuuaggauucuuuuggaugagggacaagagauagcccagccggcuccaugaaggaagauguucaggcguccuuaauagagauaaaauucugagauacaaguggccugguugugcaccagcgaggcugagcacguuuccuagguggaggagcccugagggcaaucaagagagacuucccugcagcacuguaguauaggaauuuaguacugauucgcagggcaaucgaagccauugaaagaccucagggagaggugucugggucucacccacacaccgcagcagugggugcugaagauugucugaugaaggcauuguggacuaggacuaagaggaagugagggagaagcaaauuugaguaaugucauuagggaggaggacaaccuagugguuuuugguauuagugugcauauauaaaggacugggaugaauuugauaauuguuugagauuucaggcuucaugauacaauuuauuggcuauggauagccuuguaaaaaaagauguccaaguucuuuuucugcauggugcauuugacuucuuuuugauuuagagaaguaauuuuuaaaaaucaaauaauuuggccggacgcaguggcucacaccuguaaucccagcaguuugggaggccgaagcgggcggaucacgaggucaggagauggagaccacccuggccaacauggugaaaccccgucuccacuaaaaauacaaaaauuagcugggcgugguggugcacgccuguagucccagcugcuuggcaggcugaggcaggagaaucgcuugaacccgggaggcggagguugcagugagccgagauugcaccauugcucuccagccugggcaacagagcgagacuccaucucaaaaaaaaaaaaaaaaaaucaaauaauuuuugaagaacauuuagaaaaauagccauggagauauuuuugucuuugacuucuuacuuugguugagaauccuaagcuuauguucuuugugauuuauacauauagcuugggaacaaccuuuuucaaacacauuucuggaggcugcuuagaugauuuuugcaaaugauaauaauuuguuuuuauuacaguaaaagcaauauguacuuauuguauaaacaggaacauauuuuuuaaaaguuguaaugaaaaaauuaaaaucacucagucuuuugcccugagauaauuaucuuauuguuuauaucuguagaaaaaagauggaaagaauauuuagauaagaccgaucaugcuauuuugucagcuguuuaacaugugucaugaucaucuuagcacugaguaaguuauaucacuuauaagaugauuuaaaauauuuuuaauguaauauucucuucuauacauuuguagcuuucauuucuuuuucuguacgugguugcugucauccaagugguuucucaucuuuuggccauagcaucacugcacuugaucaucccuguacauacguguuucugcccucuuguguaccucugugcuggaaguucugaaaggcugaauugcugguucaaaguucggcagauugcccaccugucaguguugcaggagugccuccauauuaauccuggauguuaccauuucucuugauauuuuuccuuuggaaugggccaaagauaccuguuugcuucuaggagcagcaauggagacuauuucuucugcuuguaaucuuucagauaagagcacauuuuaagaggaaauaagguaaauaaaauaguuuuauuuuuguugaucucauuuccccuuuaacugauugaugaaaauugucugucuaagguguauuaaacaucaguagagcaggagaugccuauaugaaggaggaggaagaccugauaccucaacgauguucacauugaaauggaucuauuugggucuauuuguuguuguuuaauccaguuaucuuuuuuuuuucuccacaaaaugaggauaauauugauuuaucucccaauagaguugugagaaaaaaacaucaaaaucuauuucuuuugaauauuccacucuuuuuuccaagugcuuucacaccuacuauaaccuaauaaauaucagcucaucuuaacugggcuaaacuggaagauggcaaauaauacuguuaaauaauaguguguuuuuuuuuuuuuuuuuugagacagaguuucauucuugucacccaggcuggagugcaaugguacggccuuggcucaccgcaaccucugccuccuagguucaagcaauucuccugccucagccuccugaguagcugagacuacaggcgugcaccaccacacccggcuaauuuuuguauuuuuaguagagacaggguuuuaccauguuggccaggcggaucucaaacucuugaccuuagguggucugcccgccuuggccucccaaagugcugggauaacaggcgugagccaccgcacccggccuauagugguauguuuuuguuggguagugagggguaagugugugaucuuauuugauucuccauuugauucuagccuaaacuaaagaauguuuuucaaaaaacaccuuuguaaagaaaaugauggucaguaaucuuucucaucauaggaggcaagucagauggaugggcacgucacuggccagcguggugguugagaucacucuggagacagcacuggggacuugguggcgagaacuguguuucugucugccccguggcugcauuuuuggaugcaggccucucuucaguguuguguucaugcuguuuaugaccccaacucacaucuugcagcuccacuaucagaagacugaguuucucucuucccagcuuggaguaaaacaaucacaaauccccaaacaauccccauaaacccucagccuaugcauuguagccggggagacauggcugugcacgaaaauggucgcucccacucauguaaagggacagggcaaggagugccaagucuccuaaaagaagaguggcucgacugggggcaaauggcccaugugugaccacugggggaaucaugaacuucauacuuuagauugguugggggaggccucaggggucuaguggaagccucaggcauugggaucagagguuaggguuuguaucacagcucucuacuuacuauuuguguggauuuagaugugccauugagccuucauuucuuguccauaagaggagacuacugcauacuucauggagaccugaggcaugcccaggcacugcccagugcuuggcauaauaugucucuguguuuguacuuuauuuuguuuauuuuuucuucugaugaucuucauuauuugggcuuucagcugugucaucaagcaagaacuuuuccagcuuucccaaccucuuuaaaucgaggauuuauccuuagugauuauacuaaauuuuguaauucuaccaaaauacuaguauuuuuaugggcauguugccauuuuuucuguauaaaugugaaguuugaauucuuuagguauugauauguauaagggauuauauucugcuuuaagacuucagacauacacuuaccacauaaccugucuuauuuaaaaccaucacuggguauuauguuauagggaaugggaguuaaacuggugaaguucagcuuuuuuuuuuuuuuuuuuuuuuuugagacggagucucguucugucauccaggcuggagugcaguggcaugaucuuggcucacugcaaccuccaucucccggguucaagugauucuccugccucaaccuccugaguagcugggacuacaggguaguaccaauacaccuggcuaauuuuuguauuuuuaguagagacagggucucacuauguugaccaggcuagucuugaaccuccugacuucaggugaugcacccgccucagccucccaaagugcugagauuacaggugugagccacugcgccuggccgauguugagcucuuagguuuauucaucauauauuuuuauuauuuuuuccuuuuuuuuuuugagauggagucucauucuguuguccaggcuggagugcaguggugcgaucucagcucacuguaaccuccgccucccggguucaagcgauuucccugccucagccuccugaguagcugggacuacaggcgugugccaguacacccaucuaauuuuuguauuugugguagagaugggguuucacuauguuggccagacuagucucgaaccuccugaccucaggugauucaccugcuucagccucccaaaguguugggauuacaggcgugagccaccucgcccggcugacauugagcuucuuguuuauucaucacauauucuucuaagagccaguuugugcucuucuguuagaggucccaaauggagggguuuuaaaaugagaagggaaggggaggugagguguuaaggaaauuaagaggaggaugugguagggggauuaggaaagggaaagcuccaggcccaauuuccagcccugcccuggauccaggcagggggauguucuaaggauggggggagggcaggauucccugcauaccucuuaccccuuaagguucugaucuauucucugucuucuuccuuuuuuuucuuuuuuugaaacagagucucgccgcguugcccaggcuggagugcaguggugugaucucagcucacugcaaccuccgccuuccagguucaggcaauucuccugccucagccucccaaguagcugggacuacaggcucgcaccacugugcccggcuaauuuuuauauuuuuaguugagacaggguuucaccaugcuggccaggcuggucuugaacuacugacuuugugauccgcccgccucggccucccaaaguguugggauuacaggugugagccacugugcccagcccagaucuauucucuuaagaccacaucuuucuucccugggauacuuuauuuuagccaggaucagccaacuugcuuggucaugcuacuuugagaaaaguaugcucagagcagcugggagaaagcagugcgcuucacaguacauacugcaugggggcuaaguguagcuacuaaccuaggccucaggggcuucaacgugcagcucuucauauacaaugaaggaggaggauuuaugcucacagggccccaaagcacagguggauguggacacaauggaaacacauucaugcacacucaggacaguugucuuuuuuuuuuuauuuuuaaauucauauugaacauaguuuaguuuaagaaaaccuuaugccaacgcauagagaaaaaucugguauggcauaugccaaacuauuaauaguguauuuuuuaagggggguggagagaauuauagggauuacuacuuuguaaguuuuuuauuguuggaaaauuuuuaaauaauacaucuaggauuuaaaauuuuucuuucuuuuuaaagaacaggggcuaggugcagugucucacuccuguaaucccagcacuuugggaagcugagguggguggaucacuucaggucaggcauuugagaccagccuggccaacacggugaaaccccaucucuauuaaaaauacaaaaauuagcugggcgugguggcgugugccuggaaucccagcuacuuggguggcugaggcaggagaauugcuugaacugggaggcugagguugcagugagccgagaucaugccacugcauuccagccuggaugacagaaggagacuaugucucaaaaaaagaaaaaaagaauaggguccucaaaaacgucaaaguacaugucagcuauguuuguauuauguauguguuuguuucuuucugcccaugucuguuaucuuuaacuaaaggagcaaguagaguggucagguugaguguggcagaaugggaagccauccagaagucacuauuuuuucccccaaguagcugugcucuugagaaaccuuaaguaucuugguugaaagacuuuuuuuuuuuuuuuuugagauggagucuugcucuguugcucaggcuggagugcuguggcacgaucucggcucacugcaaccgccucugccuccuggguucaagcgauucuccuggcucagucuccugagcagcugggacuacagguacgcacgaccgugcccagcuaauuuuguauuuuuaguagagaugguguuucaccauguuggccaggauggucucgaucucuugaccucgugaucugcccgcuucggccucccaaagugcugggauaaaggcaguagccaccaugccuggccaaaagacuuauuuuuauagacugagcucuugauugcuuucuauaaggaaaauugaucuguuuuuuguuuuuuccuaucuccaaaauuagauauacccuguuuagggcaggggaugcgguccuagaaaugggaacgcuggcaaaggagagcaaguauacuuagucucuguggagcuguguucuaaaucucacuucgcaguugcuuucuguaccugcacauccucugaaaucaugaccuaccucuggcuauuccaucuguuguuuuuuguaaccugcugacaaaugcucucaagcuacagagaugucuugaaagcauuuuguaauguuggggcuuccccucgucaguuucuaguugguguucuucuuucucuucuuuuauuugaaggugacuccagcuauguaaaauaggcaauuuauaauugaaaaguuaaccugggaccagacuguuuggguuagaauucacacuccucccuuuagaccuuccgucacuagcugugugguacuggauaaguuucuuaaucucuccauaguuuuucuucugcaaaauggggacaguguugauccauaggguugucgugaggguaaaagaguucauguguagaaagugguugacguaucguaagugcugacauacaguaaguacuuguuagcuuuaugaucauuuuauagcauccagugugauagccuucuuuuguuucuuugugguugauccagcauuacagcacuaucacuacuugccuuugaugaccuguuauggauuuaaauuguacccaaacagccaaacagugguagagaggccacagagggauaaacaguuuauuugucauuuuaagagacauuaguugagggugcauuggcugagugucuuugcauuguaaugggugaaggcuacugggccagguuucucagugugucaaaauguguacuaaaguggauuguguacucccaccugggugacagagugagacccuguuuccagaaaaaaaaaagaauugugggguacauaccccaccauuuuuauuuuuuuuuaaaucuauucuggaaauaagcagucaucucuuugugaggcauaucagaaucaucuggaggcauuuagccucccucuccaccuuuccuuaaaaaccaggcuuagaucaugucuaaguuucagguaguugauucucacccaggcuggaguaagggagagacuuuaagucgccauguaagcagcuauuugacuguuuaaguaauggaaugcccuacaaguuuuucaguguuggaagaaauugcauccaaaagagcauaaaacugaucauagagaacgucuuagucuguuucugcugcaguaaccaaauaaccacagacugggugauuuauaaauaauaaaaauuuggccaggugcaguggcucaugccuguaaucccagcacuuugggaggccgaggugggaagaucaguugagcccaggaguuugagaccagucugggcaacaaagaaagcaagaugcccaucuccacaaaaauaaaaaauaaauguauuucuuacaguucuggagccuggaagucuaaggucaaggugcugguagguugaguggugagggccuggucuuggcuaccaggaugauaccuuguugcugcauccucuggaagggacaaacgcuguguccucacauggcagaagaguggaagggcaaaaaagcgucuagcuaguuccuccaccugcccuccccacgauuuuuuacauaaagguauuucagaaaagacccuaacacuuucauaaaguguuagucucauucaugagagcucugcccucaugacuuaaucaccuccccaaagccucaacucuugaugcuaucacacuaaguugcaguuucaacauaaauuuuggaggggacacaaacauccacaccauagcagugaagaacgaaagagaauacaaaugagcaagaacaggaauggacuugaaaggggagguacuagcuuugauaaguacuauauggguacuugaugggcaugcuaugaaaaaagggagaugauuuugcuugagugaagucaagagugaauuagaaauguuugcuuugcauauuuugccaaaauggauaaguggcaguggggauuguagaaaagaaauggucugaacaucaugaagauaaucaccauguauuugaucuccugcuaugugucagguuuuuauauaugcauuauucuucaauuuuaucacaauucccagagguuaguuagcucugggacuccuccggguuaaguaauagucucuaaaccacauagcauuuaacuggaauuugaaugguccuucaugcaaccucuggcuaauagguauaacuuugcuuuguaaucacauuguuuagggaguaugguaagaaaaauaaaacaagucuuagauuuccuacuggacuaauaguaggggguagguacauuuaaauuuucaauggagggaauaaaagaaaaaguucagcagaugcuuggaagagcaacaacggucccuuauaguaacugggcacuggcuugguauucgcagaugaauaagugaaacaccuuuggcugggcacggugguucaugccuguaaugcuagcacuuugggaggcugaggcggguggaucacuugaggucaggaguuugaggccagccuugccaacauggugaaaccccguaucuacuaaaaauacaaaaauuagccaggugugguggcaggcaccuguagucccagcugcuugggaagcugaggcaagagcauugcuuugaaccugggaggcagagguugcagagagcugagaucgcgccacuguacuccagccagggcgacagagcaagacucugucucaguuaaaaaaaaaaaaaggaagaaagaaagaaagaaaagaaaaacaccuuuugaagguguaaggauuuuagguggacuagcauuuuaacagccagaagaauaauuuugacuaccuuagagccaguuuaggaagaagacuuucucccucucucucccucucucucccuuccccuuucccuuucccuuuccuuuucucuucccucccucccugcuuucugucuuccugucuuuguuccuuucugucuuucccucuuuucugccuuucuuucugucuuucuuucucucucuccucucuuucuuucucccucccuucuuuccuuccuuccaaaaacauguaucuuucuuucucucucuuccuccuuccccccuucuuuuucucucuuuuccuuccuuccuuccauccauucauccauccauccaucuuucugucuuugucuuucuuucucucucucucuccuccucuuucucucucucucccuuucucuuucucucucucucccuuucucuuucucucucucucucucucccuuuccuguccuguucuguccuguccuguccuccuucccucccucugcucccucacuucccuuuuucuuuuuuucuuccuuucuuuuuuccuuuuuuuccuuccuuucuucuuucuuucuacagauuaucugucgcccaggcuggaguagaguggcacgaucuuggcucacugccaccuccaucuccuggguucagaugauucuccugccucagccucccacguagcugggauuacagacaccugccaccacaccuggcuaauuuuuguguuuucaguugggacaggcuggucuugaacuccuggccucaagugauccgcccgccugggccucccaaagugcugggauuacggucaugagccacugugccuggacuuuucuuuucuuuuuugagacaguaucucgcuuugucguccaguugggagugcaguggcacgaucuuggcucacugcaacuucugccuuccgggcucaagcaaucuuccuaacucagccuuccaaguagcugggaguauaggcauucgccacccugaucagcuaauuuuaaaauuguuuuuagagauggggucucaccauguugcccaggcuggucucaaacuccucggcucaagcaauccuccugucuugaccuuccaaaguguugggauuauaggcuugagccaccauuccuggccuuauuuauuucuuacuuaagaacaaaaggggccgggcgcgguggcucaugccuguaaucccagcacuuugggaggccgaggcggguggaucaugaggucaggagaucgagaccauccuggcuaacaaggugaaaccccgucucuacuaaaaauacaaaaaauuagccgggcgugguggcgggcgccuguagucccagcuacucgggaggcugaggcaggagaauggcgugaacccgggaagcggagcuugcagugagccgagauugcgccacugcaguccgcaguccggccugggcgacagagcgagacuccaucucaaaaaaaaaaaaaaaaaaaaaaaaagaacaaaaggccuuuugggaggcagagaaacgauucuaggguacuguauuauaguuccugggauccuuugcucugcagagugaccuuuguggaaugcuggucugccugugaauagagucuaaauuagaaauucaaggucagcuauauaagauagccauuaccaaaaugacacacagguaaacaaagugaaucuuccuuccucacguuuuugguauuaaaggucagcagaggggucugauugcacguuuaagauaggagagaaugcuuuuugacugauugagggcauggccuuuaauuucuaagugguuuuuaaagaauguaugggucauuguuuguuuauuccaaaguccuaaugauaugaacgauauuuuuucucagacaggaauguaguuuuuggcaguuacucugcaucacaauggcuugaaaauauccaaguccuuuggaaccaaauuauauggccucugugcaugcguuguguguccaagaaaaaaaauaugugcaugauugauuuaaaaaacacuugaaauaagaaauaauggcuuucaaauugggaaaucuuaacuacccagcacuaggagaauauaagauaaauguguacaaauauuuacauguuuauccaggcgauggugcacucugcagcaaguguaguuuauaaagaguuuucagugauuugggggacaugcuaauggaauaauguaaaaugaaaaaggcaagugcaaaauuuaaauacagcaaaggcucaacuuuguacaaauguguagaaaaaugaucuggaaagaaaugaaaauguuaaugguguuaaucuaauugauaaaauuauagauagguuauauuucugucuugcauuuuuaaaauaccucgcaauaggcauacauuauuuuauaaagagaaauuuuaaaauuuucuucuacaagugcuuuugagaagguauuugucaggauaugauuaaagaugauacauuauuuauguugucugcuacaugaagaaauaaaagauuuguuguaaaaaguaaugcccuuguuagguauacaguugcaguucugaaauuagggaagaucacugguaccucacagugauuucuuaauuuuucuuuuggaauucugcucacaauaaaguaacuuugcaucuuuaauauauggacaauacccaagcaauauuacaguuaggaucagggauccacuaaagcauauuccacugcaucagucccacuuuuuucccuuaaauuuuaaucugguugcucuaaaaagacaaaaauaaaaaucuguagaaaaucucuuacuacauuuaauacuugaacuguuucgaugaauuuugccagugaaaugagcaaacacugguaugaauuuagcuuguuuuaaugacuucauuuacuacuuuuuacauuuaguuuauuuuuucgugguaauugcugcagauuuucuuuuuuuguuauuuuugccucagacuuuugagauagaagauuaugaaauaugccaugccaaauguucagaguuuauuagcaaugcagucagaguaagccaaaucuggcaguuugguuugauuucugcuuuauaguagaaggauuaauucaagaggaagaugcuuauuuaucuuccucaaugcauaaugguacauguggaguuaaagcauguucuuuguauauuacaaaccucauagaauggagauccuuugacucaagaaugaaugucuugcaucuuccucuccccuucaccaacaaaacagccuuagggagaaugagaauugcauuagugguugccagggacugagaggaggagggaucgggagcagcugcuaauggauaacgguuucuuuugagaugaugaagauauuuuagaauuaguggugauggcugcacaaccugugcauauacuguaaauuacggaguuguacacuuuaaaaggaugaaguuuaugguaugcacaugaaacaccaauuuuuaacaagugagcuagaagaggggaagggauuccauaugugaaggaaucccauacaugugagaaagcuccuucagauccccccagccccucugucuucuucauaguaaauuacggagaagccugguucugagagaaugcugaauuuucacaggcauuugaugugagaguaaaaaaaccauaugaauaaaugacuaggcucaccucuaaaauguuguuaugaugugacggucuaaggacauggauaauacuguauuuucaaagauuuguuucagaagauacauuauggggcuguauuaaggaagacugaauucugucuuuaaaaugaaacaaauguauauuagguuucaacaaauaguuaaauuacugaauuguacacuuuaacaggaugaauuuuaugguauuuauauggaggaagagggaaaguguauaaguguaugaguuuuagacuuacagagugaaguuuuuuuuuguguguguguguuuuuaauuccucuuacugucacuuccaaaugcuugugcuuuuaagaagcaauugcuuuauuuugguuuuggaauguaaaaaagcaaaaagaggucuaacuuuuuuuuuuuuuuuuugagacggagucuugcucuguugccaggcuugagugcaguggugcaaucucggcucacugcaaccuccgccucccugguucaagugauucuccugccucagccucccaaguagcugggacuacaggcaugcaccaccacacuccgcuaauuuuuguauuuuuaguagagaugggguuucaccguguuggccaggauggucucgaucuccugaccuugugauccgccagccucggccucccaaaguguugggauuacaggcaugagccacugcaccuggcccuuuuuuuuuuuuuuuuuuuuuuuuggagauagucucucacuguguuguccaggcuggagugcagugguguaaucauaucucacuacagccucaaacuccuggccuuaagugauccucucaccucagcuuccugaguagcugggacugcaggcaugcagguuuuuuguuuguuuguuuguuucuuuguuucuuuguuuuucaucuuuucuagcggcagggugugguggcucaugccuguguaauccuugcacuuugggaugccgaggugggcggauugcgugagcuaaugaguucgagaccagcccgagcaacauggugaaacccuaucucuauaaaaaauuuaaaaauuagccggacgugguggcaggugcccauaacuccaguuacucaggagguuggggugggaggaucgcuugagcccagaagggagagguugcagugagcagagaucauaccacugcccucuagccugggugacagagugagacucuuucucaaucagucaauuaaucaaucaaucagucaaugaaauuuuuguagagauagggucgucuguguugcccaggguacucuugaacuccuggacucaagcacuucuccugucuugggcucccaaagugcuaggaucacaggcaugcaccacugcaccuggccucuaacauguuuugaauaucuaguuauaugccagaucuugugauaauugcuuucaguauuuuauucauuaaaucaccacuagaaccauauuuucaaccucauuuuaaauuugaggaaacuaaaaauaaacuugaacccuguugccucccaaagaauuacgugggucagugucuuuaugagaaguugccacagaacagugaggaaaauaacuugccuaauacauuaccucccagagaugcccacacuguggggaacagccuucccagcauuucucugugcauauaucacauuagaauuucaccauauaugcuauucuauagccuguuuguuguuuuguuuuacucaguguaaaaaguuagccagauagguuuucuuguugaaauauggucauuuuuauggccucauaggauuccuuuuuauguguuaugaucuacuuaauuugucuccuauugauagagauuuaggucauuugcacguuuuugccauuugaagugugcauugugaugauuaucccaugcauaaagguggaucuuuuuucccaaccuuuugucauggauuuuuuuuuuuuuuaaagauacguaagaguaaagaaaaugaaacaaugaaccuccauacucaucauccagcuucaacaacucucaguguucugcugcuuuuguuucaucugucuucccucugcugccccccaguccccuggagaauuuuaaagcacauuccacguguccuaucauuuuaccuauaaauauuuuaauauguauccguaauaaggucuuaaaaaauaaccaugguaccauuaucacgccuaacaaaauuaccgccagucccuuaaugucaccacuaauuaguuuguguucaguuauccucaauugucacaaaaauaggacauuuucuaauucugucauuuccuucaguucuauuauuuauuagcugugauucuucuauaaagaacuuugccucuucaacuaguugauuauucugaaaugcauucuguauaggaaagguaguuugacugcuuuauucuuuccuuagauuuucagaacaugaguuagugucuaccagucuccaaaagaaagaggaucuuuuuaguauuaauauaacucaugaauuuaaacauacuugguguuccauuucauuugagcauauucuuggggucucauauuagccaguaggagcccuuucaagccaugucagagggcacagagcuaaucugaaagggccaauucccagugaaaggaauuggggcuccuuggagaaguggcugguuucaaaucuaagcaggaagugucugagauagauaagccuagaacaucuugucaggcuucgaacacaaggaagcacuuuuaccugguauugcacuauacucaagcuaccucuuuguacaagucuuccucacuagaugaugagcuuuccucacuagaugauguguuuuguuuuugaaaucccauaaccuagaucuguuccugcugggcauuccugcauccauuuuguaugccuucaaagcuuuaccuuguaacauuuaccauggcuuaauuuauguugugauaauuugauuaaugucuguaccucucaccccauaucuacccccuuuuuuuaaaaaaaaaauuuuaccuguaacaccuugcuuagugccugggcacauaguuguuacucaguaaaaucugucuaauaaaugaaaagaccucuaacccuuccuguucaugguauuccacaagauuuuuugauggucaaauacaaauaauaauugcaggccagguuguguaauaccuugcuauuauagaggccuauccgucagggauucaaagguuagcuuuggccugugucaugcucuuagcuacguaagucauuuuuuaguugggggugagaaucugcacccucuguuguuggguagggacacauuuaacugugucuccuucucuauagcucauaaugugaagcccuguaacaggucuugagccuggauauuuacaccgaugcuuuagagauuaugccacuuaaguaauguuaucuuagguguauuuauccguccuccuccuuucugccucuccucacccacucuucuccuaguaggaaauuacuuuucguuuucauguuuuuauauugaguugugaacacuugcuuuacucuggugcguagacuugggcagaccacuuuacgucacugagccuuugcuuccugguuuguacgauggagagaaauaauacuaccugccauaccucuuuacaggacuguguaaagcuuauuauccaugaaucuucucuuacuuucucccuuuuacuuuguggugugugagcuucagaaucugauacauuuucaugcuuuuacuuauaagcaauuagcucuaaagccucccuuuuuugaaaaaaguuuuuuauuaaaaaauuaauguagcuggguaugguggcucaccccuguaaucccagcacuuugggaggccaaggcaggcagauuaucugaggucggaaguuuaagaccagccuggccaacacggugaaacccugucucuacuaaaaaaaaaauuagccgggcaugguggugcacgucuaauccuagcuacucaggaggcugaggcaggagaauugcuugaaccugggaggcggagguugcagugagccgagaucgcgccacugcacuccagccugggagacagagggagacuugucucaaaggaaaaaaaagaaauguauuuuuaauugacagaaauuguauauauuauguacaacaugaugcuuugaaauauguaauauuguggaauggcuaaaucgagcuaauuaguauaugcguuaccucacauaguuuuuuuuuuauggugagaagauuuaaaaucucucagugguuucuuuuuuuuucuuugagacagaaucucccucuguagcccaaguuggagugcaguggcacgaucucggcucacugcaaccuccaauuccuggguccugguucaagcaauucugcugccucagccuccugaguagcuuggauuauaggcacaugccaccacgcccagcuaguuuuuguauuucuaguagagacaggguuucaucauguuggccaggcuggucuugaacuccugaccuugugauccgccugccucggccucccaaagugcugggauuacaggcgugagccaccgcacccgguuuuuguuuuuuuuuuuuuuuuuugauauggagucuugcucugucacccaggcuggagugcaguggcacaaucuuggcucacugccaccuccacuucccugguucaagugauucuccugccucagccucccaaguagcugggauuacaggcgugugccaccacgcucagcuaauuuuuguauuuuuaguggagacaggguuucaccacguuggccaggcuggucuggaacuccugaccucaggugauccacccaccuuggccucccaaagugcuaggauuacaggugugagccacggugcccagccaucagugauuuuuuuuuuuuuuuuugagauggagucuggcucugucgcccaggcuggagugcaguggcacaaucucagcucacugcaagcucugccuccuggguucaugccauucuccugacucagccucccgaguaacugggacuauaggcacccgccaacacacccagcuaauuuuucuauuuuuaguagagacgggguuucacuguguuagccaggauagucucgaucuccugaccuugugaucugcccgccucgggccaucagugauuuuuaagaauacaguacauuauuaauagcuauaguuaccauauuguacaauagaucccuuaaacuuauuccucuugucuaacugaaauuuugugucuccccagcggaaucccccaggcacccugguaaccaccacucuacucucugcaaagcuuacguuuuuguugcuggucuaugugugguaagagaaaauaggguuucacaggacacaguugcccauuagcuuuuguuuuguuuuguuuuuuuaggcuaccuucucccuuuuaaaguugagguaaucauagauucacaugcaguuauaaggaaaaauauagagagauccuuuuuauaaaugcccaguuucccaaaaugguaacauuuggccaaacuaugguaucaaaucacaaccaggauauugauacugauacaaaccaauaauuuuacucacauguauucaguuuuauuuguacuuaaauugugugucuauuggcuuuugaacugaaaagucuccuaauucaacauuucagauuugaagugacaggguaauaggaacaaauaucaauuaauaugagagaauuaacuuagacaaugaagaaauaugaucuaacuguagugaaugugguaauccagaccaugauacuuuugggccaaauagugcaauauuguuauuuaacaguugucuuaaaaauuagagaacuaauuuauuagcauauacauucuuggcgugcuaaagacacuuaaaaaaggacuuuaaacuugaaacuguuucuuaagcauauccugcugucacauuguuuacacguuccuuuguuuauauuuauuuugcuuagaaaacuguguuuucagcugggcgcgguggcucacgccuguaaucccagcacuuggggaggcugaggugggugaaucaccugaggucaggaguucaagaccagccugggcaacauggcaaaaccccaucucuacuaaaaauacaaaaacuagcugggcgugguggcaggcaccuguaaucuuagcuacuagagaggccaaggcaggagaauugcuugaacccgggagguggagguugcagugagcugagauuguaccacugcacucuagccugggcgacaggacgagacuccaucuuaaaaacaaaacaaaacuguuuucaugagcacugcagaguaauuuuaguucagcucuggguuagugggacccaagcuagauuuaauacccuuucccuuuucucauuggucagaagaagaugguggaugaacuaugcuuccuuuccuccuuuguucuuguuuagguuugaggcaugaccagucaccaucaauggaagucugggguuaacuuuuaacuuaaaaaaaaauuaucauauauauauuuuugguagaaacgugguuucaccauguugcccaggcuagucucaaacuucugagcucaggugaucugcccuccucagccucccaaaauucugggauuacaggugcgugagccacugcccucgguccuaacuuuuaacucuuuauguuucaaauguuccucuuucccagcacacacaauccaguugucaauaaauuuuaguaguuuuuuucucugaaauaauaauuuuuugucccccccacccuuaagaaugugugccuauuugaaaauggcagaaaagcaugaagaaaaugucgucuuuuuuauuuuuugagaaggagucucgcucugcugcccaggcuggagugcauuggugcaaccucggcucacugcaaucuccgcgucccggguucaugccauucuccugccucagcauccugaguagcugggacuacaggugcccgccaccaugcccugcuaauuuuuuguauuuuuaguagagacgggguuucaccguguuagccaggaucgucucgaucuccugaucucgugauccacccgccuuggccucccaaagugcugggauuacaggcaugagccacugcgccuggcccuauuauuuuaucugaagugucuaccugucagaccucugccuuuuuuucuucuaauucugccucugcuauaggaaucagaugccauuuuucucuuccuuagccuuuugaagcugcuuuccaacuaguuucccucccuaggccaaguggcuuucuuucuuccucucucuuuuuuuuuuuguaaucaguacuacaucuuuuacaggugagcuuucuaaaacagauuuguuuguccaucccugcuccgaagccuugaguucucugcugccuaaacaagaaagcccaaacaccugagcaugauacucaacacccucuaauauuuuuguccuaaacaugccauucuuugcuuuucuuccaccacguucccuccauacuguagccacacugauuuggugcauccuccugccaccccauucucuuuccucgguauggauugccucuuguuggccuugugaaacuucuuuucaugauugaagacucagcuuaaaugguauggcuccugugaagccugugcuaauuuuucccaguuaaaauugcuugcucccauaccacugagcccacaccacacuuugccagaccauguuuugcuuuguguuguugccauuugcuacuuguuucaacuauaauauugauauuuuugcagaagagggccauaguuugauuuuucuuugugugucugaacccguugcuugcacagcaguacccagcauauaguaacugcuuaugaaauuuaauuauauuagcuugggcaacauggugaaagcccaucucuaccaaagcaaaacaaaacaaaacaaaucaaaaaacuagcugggcaugguggcacacaccuacaaucccagcuacuugggaggccgaggugggaggauugcuugagccugggaggcagagauuguggugagccaagaucacacuacuguacuccagccugggugacagagugagacccaucccaaaagaaaaaaaccaaaaacuaaauaaauaaauuuaauuauauuaagcugcauaauaagugucuccugcuugcuuguauuugagguggccuuuuguguuuuuugcuuaaugugccuugucauuaaaaaaacagaaaucccugugacaauuuccucucuuauagucauaucccaauucaguauagcuuuaugagagggaugaauuuguagccaugguucuguaaggcaggaagauucuaaugggcauccaaaucccgugggugacuuucauuucucaugagaaugaaguggggagggguaagcgagugggaggggacaccugggaaucagccaggaauauuccuuguuuccuucauauccaguaaauccagaaaaugaguuuuaguuggaugaaagccuuggcauccauccuaaccuuuguuacuaauugaagaacuugaauuuaaauugugauuuguucucagaaaauuccaaauagaaaacucaugguauuauaucauacagggucccagugaaggaaaucuagaaauucuaguuuucacacuguagaaggaauauugauacacucacccucucuugccuuuugaagggagaagccgggcucccugauauugaaaacuacaugcuugcugugagagaggaugcaugguaggcugaaagccucauggaucauuaagaguucacuagauucugccugcagcuguuagaaaaugaacaaucaggcaugugggagucuaccauguugcugaaaugcucagcaugaaugacuuuagccacagagauauuuuucacuuugagaaggaaaaccuuuuuacacaagagaagauuggcuuuauguuuaagaaacaguguucuacuuaguggugcacugaauucuagaucacauuuuggucauacuucuuccucccacccuagugauagucuccagcaauaaaaaggagaggcacuuuuuacuucguuaacaagauugugccaccugucucuuuccuuugggaguuggguggggagggaaagaaggagggagagaggagagaacagacugauaugcuagaggccucuuggaaagaagugagugcauauuagugauauuuagacacuuggaugccccccuuuuuuaacuuuuauccuuaacacagaaacuaaaacagcaaauaucuuccuuugacagaugcagaaacugaggcacauagaggaauuaauuugcucaaaguuacaccaguaguaaguggcagaaucuaguccagagucugcacucuuaaccacuaugugcuauugucacaucagcacaguuuacaaacaagguuggccauggugagccuccagugcacacagcauuccaaguaaucuuuuuuuuuuugagacagagucucccucuuugccaggcuggagugcagugcugcaaucuuggcucacugcagccuuggccuccuggguucaagcgauucuccugccucagccucccgaguagcugggacuacaggcacgcaccaccacgcccugcuaacuuuuuauaucccauuucaucauguuggucaggcuggucucaaacuccugaucucaggugauuugcccuccuuggccucccaaagugcugggauuacaggugugagccaccacguccggccguaagaaaucuuuuaacaucauaaauuggguucuaucacuugucagccuaaccuucuccagugucuucccauuacacuuaaaauaaaauuaaaacauuuacuuuaaaggguuaaugaccuugugccgaaggccuagcccuagcugucucuuggccuuguucucauuccugcugucuuuuacuguccuccagccgcccugaucucugucucuagauugugcuucagagggcuuucuaaugguuaguuggcuuucucccgaucucuguguuaugagcuauauccuaucauuugggucucagcuuaaacucacuguuuagaaaccuucugugacgucccuagcuaaaauagucucuacccucagucaauuacuuugccacuauuugaaauuccuucuacuugaauguaagauucuugaggcagagaccucuuauggcaguuuaggaagacaggcaaagucauuagcgucucuauugccuaaaacagugcuugggacaugguggccacucaauaaauauuuauugaguaaauuaacauaaugagggauugaacauuuauaucuccggaaggcacauggcuuuccugagagcaacuuuuacaucccucuggcuuaacagauauaugacaccagcucaggacagccagaggcuacccuaucaauucuauuccuccaaacuauuccugccaccucccuaacuaaaacuuguggagaaguuugucuccccagugucucagcaguaagugaagguaggggaagaccaaggaccuggauaugacagaguucuccucugauuugcucuauuuuauaggacccuggaaagcaacucuuggacuugagcuucacacaauggcuauauuuguaauggugacuucaagaaaagccaaacucuagaguauucucuauaauugaaauaucuaguacauuuuaggagauuuccauuaacuaaauggaaacuuaagacauuuagaaucaguccucaguuauguggaaaaauccuuucuccggauagacucauuccuucuuucaguugugagcguguuacuugcuuagugcugggcagucuucacuaaaguuggguuaugguuauuaaagaaauguuuguuucauuuguucuuuugcucgucuagaauacaacacauuucuuauuugaaaucaaaggcugaguuuucugagggucauuuguuaucugauuagacugccccagugugaggaccaggggcucugaaggccacugaccaccccucucugguccagugguuacaauugcccccaggguuccgggagggguggaagcuaggucucuuugaccccugcuuagcaguaaugugcugucucugaacucugaaucauacugaaccaauucuggcuggacgucauuagccaccccuguccauuauugauucagcccugagucugagagcacaguacacaucugucugaagcccucuagacgaguggaugaauccucccucuguucuguacuggugcuguucaaugcauguuagaaacuggauacucugaugacauccugaaaguguauaaagccuugaucuuucucuguuuuugauucauggauguaaaagcaugaaaaucuuagaaguuaaccaguccaccgaaacuuuaccagcuucccaaccccaucuaggaagauagaaguagucacauaaagaaagagacuuuauaacuucuuagccaagauaaaucacuaaacucugauaucguguauuuguauuauguggcgcuccaaagguauuucuuuucuuuccuaacaccucuuuguaguccagauuugucuuuagauuucauggcuuagucauagcaugaugagaggauaauuaggguagagauuuauuugcccguuucacacauuuuguguuuguguguaugugaagauaagaugugccagggaguuaaagggagaaaaauucuauucccugccuucaaacuagugauuauagcagaggagacguuugcacgggaggaccucgugucguacauuacagccaaccaguuacaagagaugcagagugcugaguccaggcugcccuucugugggagguaacuagcgaaagcuucuggaaaugguggcccuggagcuggaucuuauaagauaggcaggauuuggucauguagaaguaaacuuuccagguggaaauagugccgagcaaugcuggagcagucuggagaaguuccacuuuggcccauggaucauguguacugaagcucugggguacucuccuucccccuauucuugggaagcucccagagggcaagggcuuuguuuuguucagucuguaugcugagcaucaggacaggacagugccuggcccacagcggugcucgacuguuuguucagugaguggaagaagcugaggauaaugaaaguagcuaacguuuauggaacaguucugcauacuaggccugugcagagcucuuuuaggcaaauuguuuuccuucauccucacaaccaucuuguuaguugcuguuguaauuccccuuuaauaggugaagauaagugguagagcuggcaucugaaauggggcuaucuguguucagaacccaaacucuuccccugaacuaugcuuccuagagagagauuggugcccagccucagagggcgugaaggccacaccagggcuguuaagcuguuuuuuaagcaggcucugaggguucauugaagguuuuugagcaggcuucuaggguguuccaaguugugucuuggaaaguaaaaaaauuaugguggugucucagccaacuuggggaugaguaagagguuccuagaaaauaguccaguggguaagagguaaugagauugaggauggauuacuggaauguuaggggaacuaguuggguacuaguuugagcauuuggcauugguagguaguuauuaucaaaauuacuaguggcaucugaaaguaauuuaagacaugagcuugugcuuugcacacaguaaauccucaauaaaaugauuauaguuugucuacaaugcuuacuguuuuggagcuuugaaucucgcucaccuaaggaaguccuguuugcagacaucuugggcauuuugcuuauaaacaauauuucuuuaguucucugcuauaguucuacuugaaaacccagucuuucaagaaaaacaagagaggaccaaguuguuuccacuuauugcuuacguuuuacagacuauuacuuuuaacacaaaauauggugcagcacagaacacauuacagagcaauacaguuugcaaaguaauuacaggauuuauaaacaugggaauucacauuauacaccuagcaugugaucugauaacgggguccaagaaaugcaaggcaccuugaggucuggccuguggucccacugcuuucguccccauuucucuuuuugcacccacacaucuacccccucuugugggaggacuuugagaugauugcuucagaggcaccugaauaguuuauaggcuggucucauuagaauuguuugguagcuuggauuaaagcagugaaaugugagaagggugcuggagguccauuaauaggacucacagcugucagucucagagcccagugcuagcuccugcugugugcuuguuucuggccgucccugaaacaacccugcaagaaaguucacuugugcuuuuuggguguuuucucuucggaaaagagauaaauccuagggcccuuguuuuaguaccuuaccuguggauaacuacagcaaacugaugcaaacagggaaaggacuuagaacaaguuuuagggccguucugcucuuaauguguguucugacugucaguauugcugucagcaucuagacuugagcaugcagaucugcugaucaugccugaugaucuuugauuugaguugcuaagucagauaaugccagaauuggagcggccuagugaaaaaaggcucugggcucacaguauggggcaucagcugucucugcagcucucagggcucugacagccugucccugccaagggagggaugagcauggaaggucacagcaaguucagugggaaaguggcuucagggcagagcuuugguuggcuguggauguggaggaaguucauuucaaagcucauuuagagaggguuuaaaaacaaauuucuuaaaaaaagugcaucuccuuuuaugugaacacagcugcugcauggggcugugauagugccuccuggacuugugcaacaaggcagcccugguagaaauacuauaccgauugcuuuuggcaaauuugauuuacuggagaaaguagucacaugaguuauucugcauguuuacugagacccuccuuggucuugugaauacagagcagaaugagaccuaguuccugcccugaggaacucaugccuagggagacccuauauccacguagccugggacauucccuguucaugccucuuguccugguauaagaguacgcccuuugaaucucaaaguuccugacuucagaugauaaauuaugugguuaccuuauucauagucuaguggugggaggcaaauaugugaacuuucaucucaucacagaauugagccucugugcaggggccccagccuggccuguugauaggccuccuccucgucuuuccccaccuguguauacaacuucuuuucucugacaguggcaguccccuuguccaccugcauucuccugcuuaucccagugucccagugcuucuugccccauagcugccacaggaacccagaacuuauuuagggaccaggaggauaagcuuucaugccaacugcagccccuuuggagcauauucuggguuguggcuuucccucucuuuucuucuucucaaauuguguuuggggaaaaauuuauuugcugauggcugcuuguguucuaccaaugccucacuucucugaguuguuucggugauaaucuguacuucugucauucugaugggcugucaggagcaaaaguugaugaaaaugugugcuugguuucccguguuuaacugguauagcuuuggacuuggauuccuaauucucuccaccccugggaauaaaauaucguaccauagagagagcugggcuuuagagccccuuggacuuggaugugaguacaggugauaaaucugucacuaaaacaggguaaaucaauacagggugaugaccaaggcccuuucugacuaaaaucuuugauaauucuucuucagugguucuaaguuagggugaaguccuuaauuauagaacucaaaccauuuuagucaugauaugagauuguccagugcugggccagagagguuaagugacagggucucagaaagaauagauuccuaaaacaugguucguacauggaacauuuauagaagaauggauaaauguuagcucccuaccccgccgccaccuuuuuuuguuuuuccucauugccuuuagcuaaucagugaauuccucauuuggaauaauuaccucaugaaugaugugguuuggcuuuguauucccacccaaaucuuaucucauaauucccacacauugcaagugggaccuagugggagaugauugaaucauggggacaggucuuucccaugcuguucuugugauagugaauaggucucacaagaucugaugguuuuaaaaaugggaguuucccugcacaagcucucucuuugccuguugccauccacguaagacaugacuugcuccuccuugccuucccccaugauugugaggccucuccagccauguggaacuguaaguccaauaaaccucuuucuuuuguaaauugcccagucuuggauaugucuuuaucagcagcaugaaaacaaaugaauacaaugaacuuucauuuucaccccuugcucauucuuuuuuguuuauuucucccaaauuugguuuugcuuacuuuugaaauuugaaaucaggauuagauaagagugggagguaauauaaaagaagcuaauuuccccagagcugagaauuuguuccaaguucucagggccuuuuuguuuuacaaaaaguuggaaguuaaaagaaauuaaagcagcaaauuuauuuuugauuuccauauccuaccucuaagcuuucuaugcuagaacaaguuagcauauuuuuuaauaagagaauucauuaagugugucggcauguuaauuuuucauuuuuuggcuaaaagcaugguauguuugaaagcaugagugaaauucuggaauggaagaggugaugcucaauccagacaugagguuucugcugauucuuucugccuccucuuuaaaagugcuacuggccuuugacaaagucuuguugcuuuauacaucuccuuuuucaaugugauguagacucuuucaacaaaucaucaggcggucguuucuugacagccuguucagcauaauauaaacuauccuaugaaaaaaguggagaaaaaucaagugcccacuuauguuauccuugaguguugugguuagaggucagagaagggagagagaagugaaggcuacuuggcauugggggaagccuccaguugagaagagaugccuuguacuugauuugaaaggggucaguugggagggagggcacaccuuaggagugugacaccagauggggcagguacauugcccauccccaaccccaggagccucagccaagugccucuggggaagugucagucacgugauuagcuuggccuguguugggacugucauugggacucaaaaagaugugugcauauaacauuuuaaauuuagaagagacaugaaaaauaauuuagaacaacuucauuuuacagauggaggaacugaagccuggaaaggacagcugaccuccuuuccagauucugaaagaauaaaaucgaaagcaggagaggguucucuguaccaggccacaucauugaaagacaaaaccugaacaauaauaaaaccccagaggacaaaagccaagcuuaagugaaauuugccuguugugcuucugugcuuauguuugaucuccuaguaaauaauugaagaguuugagguaguuccccaguggaaagguuucuagaauagagauuugucugaaaauguucagaagagcuguucaguauucuacucaguugauuuuauggagggagucauaggacucucaguguuggaguaacuaguuguguuguagccugucauggcuuuggagugauuuguucuuugcuggaugacuagauaaaucaguaaagacagaauucaggaaaagggaugagagauggaauggggaggagacucagauuuaaagaaugccuugugcuaggccacgugcugagcauuuucuauaagucaguuccccaaguccucugaagaacucaaauccuucagcacauguuuguuccgcacagguuagcaguggucacaggcaggcccugaggguggacugccugcccagguuccugugcuguggcuggcgcugggcuuugcucagaggagucaaggagaagucacuuggccccagcucuaagaagacuugcuguccaggacaaagauugucaagcuguuucucuaagguucauagugagaaauccguuuuauguugcaaccuguaggaacacauuagucccacagucagaaguaaaacauuucaucucaagaaaaaccacagaagacaaagaauacuugucuaacauuaagcccuaacauaauguaguuuugagccccuuucuuguaaauugccagauucccuaaugaaaacagcuuuaccucugauuuuugcaauccugaugccugcagacauguaauaacccuuguagauaagccacucaaagguaggaaacugaugauuuucuucaagggagaauagugaguguaucaacucuaacuuuggcauuuccuuuccccuuuaaauacuugcaccauccuuuauuuagagagcccaguauuucagaaggccugacucacuugcccuuaucuccaucuaaaucaagguuuccaaccccuggcucagaagcccaggacaguuuugaaugugguccuacacaaauucacaaacuuuguuaaaacauuaugaaauuuuuuugcaauuuuuuuuuaagcucaucagcugucauuaguguuaguguauuuuauguguggcccaagacauuucuucuuccaguggggccuagggaaaccaaaagauuggauacuuuugaucuaaauauuugucuuauuguuccauuuugucucuaguuuuucuaauagugaucguaugagaucagugcacugcaagcuacucuuuuuuagucacugcaguauuuaagguaagagaaaagaaagcuuuaagauagauuuuacaguaguaauucuuugccuagaauaauagucaugagucuuaauccugguucccagguaguuaaggagauauaguuucuaaagaucaaaccuauaguauaccuuuauuauuacuuuuucaacuuuguauuaugaaaauugcaaaacauugggcugcgugugguggcucaugccuguaaucccagcacuuugggaggccgaggugguuggaucaccugaggccaggaguucgagaccaaccuggccaacauggcaaaacccugucucugcuaaaaauacaaaaauuagcugggcaugguggcccaugccuguaaucccagcuacucgggaggcugaggcaggaaaaucacuugaacccaggaggcagagguugcagugagccaggaucgugccauugcacuccagccugggcuccgucucaaaacacaaaaaacaaacaaacaaaaaaaacaaaaauuagccaguugugguggcaggcuccuguaauccuggcuacuugggaggcugaugcaggagaauugcuugaaccugggaggcagagguuguggugagcugagaucgcgccacugcacucuagcuugggcgaaaacaaaaagaaaauugugaaacguacacaaaaguagagagaauguuuuaaugaauccaugcacccagcauuuaacuucaaggauugucaguaacuugcuguucuugaaaugccugguacugaugugauaccccuuauuccuagagguggaaauaaccguggagcagagggauguucuuggauguggauucauucuccacuuugcagagaaaaccuagacagaagacugucuuccauuccuuccuggcaggcagcuucugaggggauauguguguuuaaaacuuaaaauguuaaaaauuguuuuaauuguggcuuucuuaaauuucgaauuuauguguaucuguugugaaaauuccuuaauacacacaugugaagcccaaggugaaaauccuauuccccagcauacaaacacauugcucacaaacauugcauguaaguuuuuaaggaaaugcagucauacuauucugcauacuguucugcagcuugcuguuuuuaaaaacuucauaacacagacaucuucccauguuaaauauacauguaggucuaaauuauucuuuccuguagcugcacuguauucuguaguauucaaguauaguauguuaaguuuuuucauuaucauuaaauuuuuuuuuuuuacuuugaagugauuuaagaguucccauguacauuucacccagcuucccuuagugugagcuucuuacagugccaugguacauuuaucaaaacuuaagaaauacaagggacuugguacaacacuauuaaucaaacuacagguuuuauuuggauuucaucaguguuuccacuaaugucuuuuuucuuuucuuggauccaguccaggauaccacauuucauuagccauuguaaugaugaugaugauaaugaugaugaugauaauuauuaagguacuaaaauauaauuuauauaucaugaguuauaaaauucaccauuuuauaguuuacaauuaagugguuuuuuuguauauucagaguuguaugcucaucaccacugucuaguguuugaagauuuucauuguauuaaaagggaacucuauacccaucagcaguuacuccccauccucucuguccaaagcuucuggcaaccaacuaaucaacuugcugucuuuggauuuuuuuuuucugucucuauuccagauauuucauaaacuagaaucaugcgauauguggucuuugguaucugacuucuuccauuuguaucauaauguuuucaagguuuacccacguuguagcaugaauucaguacuuaauuucuuuuuauugccaaauaauauuccauuauguagguauaccacauuuugucaguuguuggauauuauguuguuuucacuuuuugacuauuaugaauaauacuguuaugaauauucauguuuuuguguggauguagauuuuuaaaucucuuggguauauaccuaggagcugaauguaugagacauaugguaauuuuauguuaaacauuuuggggaacugcuagauuguuuuccagaguggcuacauuauuuuauaaucccaccaauaauguuugaggauuucaguuucuccauguccuuaccaaaaauugucauggucuguauugcuguagccaucuuggguuucuaaagauugagcauucugcuggguuugucaugagccauguuguuugcacaucucaugaggugugguccacaccuucuuucccuccaucacagugccguggcucuaaaaguuuucugugugaauucagacaggggauggcuuucagguacucugugcaguuaaccggggucugcugacaggugcaguucgguggauugauuguucauaaaauauucuuaagguucccaggccagguugaaagcuucaguuugcaaggucauucuuaugaaacauucugaacagaaccaugagagaaucuggcucgcucugaaauucuuugugauuuggagucugaggcacuugggaauauaucaccuuaacugucacuuucccccaauuggcagcaagaguguauuaguccauuuucuuuuguuuauaacagaauaccugaaacuggauaaauuauuguaaaaaggaauuuuuuucuuauaggcgugagggccaagaaguccagagucaaagggccaccucuggugagagccuucuagcuggugggcauuuucugcagagucccgagguggugcggguuauuacauggugaggggcugugagugcuuuagcucagguuucucuuccucuucuuauaaagccacuaguuccacucccgugauaacccauuaauucauucauccauucgugaagacagagcccucaugacacagucccuucuuuaaaagccucgccuuucaguacugcagcauuguagauuaaauuuauaacgugaaauuugggggggcacauucaaaccauagcagagaugcuuccuaggaugccuggaggauuucuuuuuuucuguugcuuucccauuuucaaucugggugaugcugcuuucauuuuagauuagugguuucuaugagggacaggccaguccauugggcuacgggaagaacauuauagcuccuuguuaauauuuauuuuucaccuuauucuuugaaguuauucuguuuuacauaugcuuuauaacuaaauuuacauaacaauagauuguaugauuuauaaguaaauacacauaauagguguucuuuuuuuuuuuuuuucuuuuugagacggagucucacucugucacccaggcuggagugcaguggugcaaucucggcucacugcaaccucagccuccuggguucaagcaguucucugccucagccuccugaguagcugggauuacaggugcccaccaccaugcccggcuaauuuuaguauuuuuaguagagacgggguuucaccaucuuguccaggcuggucuugaacuccugacuuugugauccacccaccuuggccucccaaagugcuaggauuacaggcaugagccaccgugcccagccuacacauaauagguauucuuuuuuuuucuuuuuucuuuuuuuccaagaugaaguauuacuccauugcccaggcuagagugcaguggcgugaucucagcucacugcaaccuccaucuccaggguucuacaguagacuaaaaaguuagcagagcuuaugguugauucuguucuuuccacccuccauuguuaauaguucuuuuauuuauuuauuuauuuagagacagagucucacucugucgccuaggcuggagugcaguggugcgaucuugggucacugcaaccuccgccucccagguucaagcgauucuccugccucagccuccuggguagcugggauuauaggcaccugccaccacgcccagcuaauuuuuguauuuuuaguagagaugggguuucaccauguuggccaggcuggucucgaacuccugaccuugugauccguccgccucagccucucaaagugcugugauugcaggugugagccaccaagccuggccacauaauagauauucuauguaaucaaaaaguucagaagccacugcuuuaagcuaucuacugagugaagaaaggcacaaacaaaacuuaucaucugaacugauaaccaggaaagaguaaguucuaucacgugcucuugagaaaggcagcaguagaaaccuagggcagggcccagcaacagggauugauaacauucgcagugagcagcacugcaaaauagggagaaugaagaacagaauucaaaccacagagcuugcagagucucagagaccacuaguuuuaguuuuguagacaguugccccgauuaugcaaguauuaauaacacaccuagagucauuugguagcagaacuaggauggaggucuugugaccuaguacaggacuguacuacagguacugcuguuugcauggugcuuuaguuguauuaguuucucuuuauuuguauuuugguauaacuuuuuagcagcaagaaguaugggaggggagaugcaugucagaaguuguucauucuuguucaacuuaauuuagaacccaacagaaagauauuuuuccaggugagcaauaaggccugucagugggauuuguucauuuauucaacaaauaugguucuagacaauagcaaugauaaucagaugaauauuucugucuucauggagcuuauguguuacuuaggggaaggagccaauaagcauguuaacagugaauuuuaugacauuugaacaaagacuugaaggagaugcugaaacaagcuagguagguaucuuggggaagagcauugcaggcauacagagcacccggugcagagagcggaaggagucuggcacaucugaugaacagccaggaggccagugaagggagcgggcaggaccacuagauaagcucagagagguaaugagaggucagaucaugagggcuuguaggccauaguaagacuggcucuuacccaagcuggggagcccuuggaugguguugaagagaggauugaaaugauaacgacuugccuuucaaaaggacauucuguggcugggcauggugguucacaccuauaaucccagcacuuugggaggcugaggcgggcagaucacuugaggccaggaaugugagaccagccuggccaacauggcaaaacccuaucuuuauacaaaaaauacgaaaauuagcuaggcgugguggugugugccuguaauuccagcuacuuggaaggcugaggccgagaauuugcuugaaccugggaggcagaggugacagugagcugagaucaugccacugcauuccagccugucucaaaaaaaaaaaaaaaaaaaaaaaaaaaaaaaaagcgguggguagggggcaggcgccguggcucacaccuguaauuucagcacuuugggagaccaagguggguggaucacgaggucaggaguuccagccugaccaacauggugaaaccccaucucuacuaaaaauacaaaaaaauuaacugggcgugguggcacaugccuguaauccuagcuacucaggaggcugaggcaggauaaucgcuugaacccaggaggcagagguugcaagugagccaagauugcaucacuguacuugauagagcaagacucugucuuaaaaaaggaaaaaaaagacauuaugcuugucuguuaagaguagaccuugagugggcugggauuggaagcaaggauacaaguaggacagagugauaaugucuugauggcagucauuguauucagguuaguuaauuggaauacguaguucaugauauuuacauucuuuccuguuugucuuauucaccuucccuccauccuccuccucaaaauuugcuaucauuauaguugaugcugaugauagaugaauaaaaaccuaucuucuggaagguugcagucuagacucuuggcauuagagaaauagaugcuuuuaaaaaucagaggucacaaaugagccugacugcuagaacaguauaauagguggcuggaaacacaacuucugucucaggcugguggauauuggugggaggccacuggaguugaugaggcuugaagcgaguccugaaagaggcacaagagcagacagcagagagaacacacagugcugcagacgggagcaugcgagagcacagcacauccaggaaaacugcagaggauucaugggccgcagagagaccugcugagguuugugugcagcgugagcucuccagggaguucuugacuccauuaggacucugggucugcacagaccguguugcuuuccacccacaacucucaguuccugacccagggccuugcuuucuuccacaacagccgauauuucuggauagagauauaagaaauacuuguuuggggcagguauaauaaguucuucugugcaugauucagucacuaggagaauuguuuuaagccuacuaacagauuuugcuuuucuuaaauggcuuuacugagauauaauuuauauaccauaaaauuuaccuguuaaauguacaauuuaguuauuuuuaguaaaauuacagaguugugcaaccaucuucacauuucucuaucagcccaaaaagaucccucaugccauuugcagucaacacucacuucuacccccagcucuaggcaauggugugucuguuuucugcuucuacugauuugcccuuucuggacauuuccuauaaaugggaacauauaauauguagucuuuuaauccaauuccuuuuuuuuuaagacaaggucaggcagguaugcaguggugccaucucagcucacugcagccacgaacuccugggcccacgccauccucccaccucaaccuccugaguagcugggaccacaggcaagugccaccgcuccuggcuaauuuuuuuuuuuuuuuuuuuuuuuuuuacuuuuuguagaggcagggucuuccuauguugcccaggcuggucucaaacuccugggcucaagagauccuccugccuuggccuuccaaaguguuaggauuacagguaugagccacuucaaccagccuaucugauuuaucguacuucacaucauguuuucaugcuucaucuaugucauagcaugugucaauaguuuguucuucuuuauuguuguuauuuauuucuuuuuaauuuauuuuuugagauagggucuugcuuugucgcucaggccagagugcagugggugaucauggcucacuguagccuugaccucccaggcucaacugguccucccaccucagccuccaguauagcugggacuacaggcacacgccaccacacacaucuaaguuuuuuuuuuuuuuuaaagagauggcaucucacuauguugccuaggcuaaucuugaacuacugggcuuaagcagcucucccaucuuggccucccaaaguucggaaauugcaggugugagccacugucuguagccuguugaguguuauuuuaauuauauggaucuaccacauuuuguuuauccauucauaauuugauggacauuuggccuauuucugcuuuuugccauuaugaauaauacugcuauaugaauuaugacaguauuucauaauuaugcauuaauucauaauuaaugaugaauaauuaaagauacaaaucuuuaugugaccauacauuuuuauuuuuuacuuauuuauuuauuuauuuuugagacagagucuugcucugucaccaggcuggaguguagugacgcgaucuuggcucacugcagccucugccucccagguucaagcgauuucccugccucagccaaccuaguagcugggacuacaggcgccugccaccaugccuggcuaauuuuuuguauuuuaguggagacagguuucaccauguuggccaggauggucucuaucuccugaccucaugauccucccaccucagccucccaaaguggugggauuacaggcgugugccaccaugccuggcccauuuuucuuuuuaaaaagugcaguaccuugcuauuuuauuuuauuuuuaaauuuuauuuauuuacuuuuaaaguuuuauuuuagguuccaggguacaugugaagguuuguuacagaggugaacucaugucacagggguuuguuguacagauuauuucaucacccagguauuaagcccaguacccaaaaguuaucuuuucugcuccucucccuccucccacccuccacccucaaguaggccucagugucuguuguucccuucuuuguguucauguguucucaucauuuaucucccacuuacaagugagaacaugcaauauuugguuuucuguuucugcauuaguuugcuaaggauaauagccuccagcuccauccauguucccacaaaagaugugaucucauuccuuuuuauggcugcauaguauuccaugguauguauguaccacuuuuucauuauccagucugucauugaugggcauguagguugauuccaugucuuugcuauugugaauagugcugcaauuaacauacacaugcaugugucuuuaugguagaaugauuuauauuccuuuggguauauacccaguaaugggauugcuaggucgaaugguaguucugcuucuagcucuuugaggaauugccagacugcucuccacagugguuuaacuaauuuacacucccaccaacaguguguuaaguguucccuuuucucugcaaccucaccagcgucuguuacuuuuugacuuuuuaauagccauucugacugugugagaugguaucucauugugguuuugauuugcauuucucuaaugaucagugauguugagcuuuuuuucauaugccuacauguuggcugcauguaugucuucuuuugaaaagugucuguucauguccuuugccuguauuuuaaugggguuguuuuuucucuuguaaauuuguuaaaguuucuuauagaugcuggauauuagaccuuugucagaugcgugguuugcaaauauuuucucccauucuguagguugucuauuuacucuguugauaauuucuuuugcugugcagaagcucuuaaguuuaauucgaucccauuuguaaauuuuugcuuuuguugcgauugcuuuuggugucuuugucaugaaaacuuugcccauuccuguguccaggaugguauugcuuagguugucuuccaggguuuuuauaguuuuggguuugacauuuaagucuuuaauucaucaugacuugauuuuuauguaugguguaaggcacgguuccagcuuuaaucuucugcagauggcuagccaguuaucucagcaccauuuauugaauaggaaguuuuuuccccauugcuuguuucugucagcuuguugaagaucagauggucauaggugugcagccuauuucugggcuuucuauucuauuccauuggucuaugugccuguuuuuguaugaguagcaugcuguuuugguuacuguaguauaguuugaacucagguaaugugaugccuucagccuuguucuuuuugcauaggauugccuugacuauuugggcuuuuuuucugguuccauaugaauuuuaaaauauuuuuuucuaguucuuugaagaaugucagugguaguuuugauaggaauagcacugaaucuguaaauugcuuuggguaguauggccauuuaaugauacugauucuuccuauccaugggcaugggauauuuuuccauuuguuugugucuucucugauuucucugagcaguguuuuguaauucucauuguagagaucuuuuaccuuccugguucgcuguauuccuagguguuuuauucuuuuuguggcaauugugaauggguguucauucaugacuugacucucugcuugccuguugcugguguauacgaaugcuagugauuuuuguauauugauuuuguauccagaaacuuugcugaaguuguugaucgcugaaugagcuuuugggccgagacugugggguuuucuagauauagaaucguauugucuacaaauagagauaguuugacuuccugucuucuuauuuggaugccuuuauuucuuucucuugccugauugcucuagcuagaccuuccaauacuauguugaauaggagugguaagagugagcauccuugucuugugccgguuuucaaggggaaugcuucuagcuuuuccccauucaguaugguguuggcugugcauuugucauagguggcuguuacuucgaaguauguuccuucaauaccuaauaacaugaagggguguuuaacuuuauugaaagcccuuucugcaucuguugagauaaucaugugguuuugucuucaauucuguuuauaugaugaaucacauuuauugauuugcguauguugaaccaaccuugcaucccagggaugaagcuuauuugaucauagugaauuagcuuuuugaugugcuccuggauuugguuugcaaguauuuuguugaagauuuuuguaucgaugcucaucaaggauauuggcuugagguuucuuuuuuuguugugucucuucuggguuuugguauuaguaugaugguggccuaguagaaugaguuggguaggagucccuccuccucaaguguuuggaguaguuucaguaggaaugguaucagcuguucuuuguacaucuaguagaauuuggcugugaauuugguugguaggcuuuuuauuacgaauucaguuuuggagcucauuauuugucugcucagggaaucaguuucuuccuggcucagucuuaggagacuguauguguccaggaauuaauucaucucuuccaggcuuucuaguuugugugcauagaggugugcauaguaguuucugaugguuuuuauuuuuauggggucaguaguaacauuuucuucaucauuucuaauuguguuuauuuggaucuucccuuuuuucuucuuuguuagucuagcuagcagccuauuuaucuuauuaauuuuuuuuuaaaaccucccggauuugucgauuuuuuaaaaauuguuuuucaugucucgauuuccuucauuucaacucugauuuugguuauuucuugucuucugcuagcuuuuggguugauuuguccuugcuucucuaauucuuucaguugugauguuagguuguuaauuugaaaucuuucuuuuuauguuggcauuuagugcuaugaauuacugucuuaacacugucuuagcugugucccagagauucugauauguuguaucuuuguucucauuaguuucaaagagcuucuugauuucugccuuaauuucuuuauuuacccuaaagucuuucaagagcaugucguauaauuuacauguaauuguaugauuuucagugauuuucuuggucuugacuucuauuuuuaaugugcugugguccaagaguguguuuggugugauuucagguuuuuuuuuuuuuuuuuuuuuugagacggagucgugcucugucacccaggcuggagugcaguggcacaaucuuggcucacugcaagcuccaccucccagguucacgccauucuccugccucagccuccugaguagcugggacuacaggcacccgccaccacgccuggcuaauuuuuuugcauuuuuaauagagacgggguuucaccauguuagccaggauggucucgaucuccugaccucaugaucugcccgccucugccucccacagugcugggauuacaggcgugagccaccacgccaggccuuuuuuuuuuuuuuuuugcagaggauuguuuuauguccaauuaugugguugauuuuagaguaugugccaugugaugaucugaagcauauauauucuguuauuuuuggguggagaguucuguagagauuuaucagauccauuggucuaguguugaguuccggucuugaauaucuuuauaaauuuucugccuugaugaucugucuaauauugucaguagaguguugacaucucccaguauuauuuugugggaguguaaaucucuuugaaggucucuaagaacuuucuuuaugaaucugggugcucuuguguuggggugcauauauguauuuaggauaguuaggucgucuuguugaauugaacccuuuaccauuauguaaugcccaucuuugucuuuuuugaucuuuguuguuuuaaagucucuuugucugaaauuaggauugcaacccuggcuuuuuucuguuuuccauuugcuuaguagauuuuccuccauccauuuaguuugagccuaugggugucauugcaugugagaucaguuucuugaagacagcauaccauugagucuugcuuuuuuauccagcuugccacucugugccuuuuaugugggggcauuuagcccauuuacauucaagguuaguuuuauauauguguauuuaauccugucauuguguucuuagcugguuauuaugcugucuuguuuguguggcugcuuuauaguaucgcuggucugcauauuuaacacugguuuguguuuuugcauuuguugguagugaucuuuccuuucuacuauauuaauacauuuagugcuccuuucaagaucucuuguaaggcaggucuggugguaacgaacuccuucaacauuugcuuaucugaaaaagguuccuauuucuccuuugcuuaaagagcuuaguuuggcuggauaugaaauucuugguugaagauuuuuuuuuuuuuuauuuaagaauguugaauauagguccccaaucucuucugacuuacaggguuucagcugagaagucuguuguaagccugacaggguucccuuuguaggugaccugcccuuucucucuagcugccuuuaacauccuuucuuacauuucagccuuggaaaaucugaugauuaugugucuugggggugaucuucauguguagcaucuugcaggaguucucuguauuuccugaauuugacuuuuggcuucucuagcaggguuggugaaguuuucauggaugauacccugaaauauauuuuguaaguuguuugcuuucuucucccuuucagggauaccaauuuuucauagauuuggcuucuuuacauaaucccauacuucuugagauuuuguucauuccuuauucuuuuugucacuauuuuugucugacucuuauuucagagagccagucuucaaguucuaagauucuuucuucagcuugguuuauucugcuguuaauacuugucauugcauugugaaauucuuguauuguguuauucagcucugucagauccuuuagguucuuuuuuaugcuggcuauuuuguccuucagcuccuguaucauuuuauuuugguucuuacuuuccuuggauugaguuuugcuauucucaugaaucucagugaucuugguuccuauccauauucuaaauucuauuuuugucauucagccagcucagccugguuaagaacucuuguuggagaacuggugugguuguugggagacauaugacaguuacuggaguucuugcauugguuuuuugcuugucucuaagucuggguguuccuuuaacugcaguguagauugaguacagucaagugacugauuugcuggauguuuucacagggcugagucuuuguuuagggucuuugaagcugacuucuuguuuuugguuucagagggugguacguuagugagguauuuuugguguugaagcuuuggguugugaucugguauguggcacguaggcauacuggucaugguacacucuugcuugguuguguggcucccccguauuuccucacaguugcagccguguucccucucaauucucaaaaagcguggguuucucuccaccuugaguacuggcuauagaucgcagcuuggcauucccgagcugcccauugcagcucugggacaaucucaguguuuauguuuuuuuuccaguuugggggcagcagaggaagggaccuuaguagugguuguggccgagggucauuugauugucuccugugggcuccaccccagagacaugcaggucagcagucacucagugcaaucagcucaggauggagggucuucgcugcgagcccaagcuggggguucccugccuggugaagaguaggggggugggugggcccuugggagacggacuagccuccccuccuuguuggagguguggauaaggcaguuagggucugugcuucuuuguuaguccgaggguagcaagggcaguuccaccgcagcggcaguggcagagaggcuuucaguugccauguggucucuguccagggaguugcugaguugcuacuggcuggauagcucugguaaggggguggcuggaggcccaggccuggaggaccugccgaugaggagaugugggaauggguacccacauaaccgucuggccacuuuucuguagggcugcugcaauauguuggggguccacuccagucccaguugccuuggauuuuccaguaccuggagguaucaacagugaaggcugcaaaacagcagagauaguggccugccccucccucugggagcucugucccaggaaggcacagaucuguugccagcccaaaggcaccuguagguggugguuggagaccucaguugggagggcccauccccugaagaggaaugggaucagggaccugcuuaaaacagcagucugaccucuuuuucauagagcagccaugcuaugcucagggucugccccuaguugcuuugggcacuugaaacccaaagauggaauugcagcuccuuuugcccugaagcccagaaagccuggguaucuaaggcucucgggucucuguuugcgccugagaaacuacucugccaagauuccauguagcucugugucagacugaagacccugguggaguggguucaugaggcagucuccugacccgaggguuguaaaaaggucuguggaagaagcgugguucccggggucccauauucacucacugcuucccugaaugggggagguuccccuggcuccauuucacucccaagugggccaccguccugccuugcuuuucuccguuuuccauggguggaguuguuuccuugauuggucccaaugcguguaccuggauguuuaauugaaggugcuguguuuacucgccccuucgcuccucucgugagagcugcgcacacuagaugcuucuagucagccaucuuggccaccccccuacacuuugauuucuauauuucauuucuagguagauaccuaggaauggaauugcagucauaggguacguguguguuucguuuuuaaagaaacugccaaguuauuuccaauguaacugaauuuuuuagcuguuccuuguuuuuacuuuuucuggguauacccugagagguagucucauggcuaaaguauagagaugugauaaaucacaggaaauguguuggggugggaugugaaagggaaagggccuugaaauccaugguuggaaaguaccuugaaagaucauuucuguuuccaagaggcauugcauguaaagcaugccauacuucuaagaaucuuucuguuuuaaaagguguuuuugaagcucucauucuauagaacuauaaauccaauuaaagaaaguuuuuuuuuuuuaaguaaugagcaaacuauaauagaauuucaauucugagacacuuuuuuuuuuaaccucuacaguuuuaccaucucugauaucaagaugagucuuuugaucaauuggguaacaguuugucaccagcuauuucuuugguguucauaaaguugguggugucuuagauuugaugaaauauggaagauauuauuggaauaaagauuauaguaccaccuauaaaauauucuggccagaaaugcugaaucugaaucuaguuggaucucuagagcugacuucaucugcaggaaaugcagauagagggucaaguucaacgaugcccaaggaaacagacaaagcugacugugucucuucauaacagaaccgaccagauuucuacagcacgaaaaugacacgaaaagaaaugggguaggagggggcccacuuuagagucagggagacuuuagaauaaccuugaguugucaugugccauaccugcuaaaugucauguguggauuuuuuuggaucaugauucaagcaaaugucugcuccgugcccgccccacccccgugauuaaaaaaaccaaacaaauaaaagaaaaacaaaaacuuuuuggagacaaacuuggagauucaauuuuggaccaucagcuuuguauuccccuguugauuucuaacuugcucucauucucugcccuugcugugcugauuuuaauuagguacccaggccgggugcaguggcuaacaccuguaaucccaacacuuugggaggccgaggcagguggaucacuugaacugucaggaguucaagaccaaccuggccaacauagugaaacccugucucuacuaaaaauacaaaaauuagcuggaugugguggcacacgccuguaaucccagcuacucgggaggcugaggcaggagaauugcuugagccugggagguagagguugcaaugagccaagaucccaucacuacacuccagccugggugacagagcgagacuccgucucaaaaauaaaaaaaaaaaaaaaagaaaagaaaagaaaagaaaaagaaagaaaaaauuaggugcccugccaucauucugagaaucccuuuugccaucaucuugguaauugccuucaccucucuuuugaguuggccccucuguuucuaggaucccauguuuuucacuuuuuugguuuauuuucuuguuuacugacccaguucuuuuuguauggaauggaauugcagucaugugguacguguguguuuaguaacuccuuauaugucuaacagcuuguucgucucuacccuuauacuugauugauauuugaucaaguauauagaauucuaauaagugaucaauaaauuuuaaguaaauaaaugaaugcaccuuucccccuuuaaaaaaacauguauugcaugaauuuagagaguauguuaagcacagacuauuguuauguuuuuccagauuucaauuucaaaaagggguaguaauagcuuuuuuuuuuuuuuuuuguauauauuuuuugaaaguaguaaaaugccauccuggagcuaagauuuuugucaggauuuaacccuggcaugaacucugagaaaaaucaguggaaggagauuacuccuuacuugaggaaggaguugauuugucucucauggugccucuguggagauuggaaugcugggagcuauaaccaaugagccaauucacagauauuuuggucucuaaaauuaguuacaguacacucuuggaacggcuucuguuacacacuuuuugucagaagcacaaccagugggcagaugguucucuggaaaaaguagacacagaagagugauuugacuugggugucauuauaaacuuaguguucuugguuugcccuuuuguaagacuaauggauuagugaacauuauuuaagccacauaaucgcggagugaccuugccuaauuauuuguucaucuuuuugggcuuaguuuccuuaucugcaaaguaggcauauuuauaguuaugauauuugccucaaaauauuguugugagaauuaaauagagaaucuuuguaagauagacguucacugccccaugauuuccuauccacccccuacuuuuuuuuuacugucucugggcaagugagugcaugagaaagguuguguaagaaucugcucugcuuugaguaguuuguggucuuuuuggagaguuacuuaguaugcauauaaaggagauagaaaaaaguacuauucagauugggguuuagagaaauuaggaggcuggagaccuuuuggagggggcuagcuggaacugucucuuagaaggauugggacuugggcuuuggaggagucuagggagacucuaggaaucuugggcaggaggaagagcugugaguccuguuggcgcgcugggggcugcugggagagaggaacagguaggucagcuuggaagcauaucagggaaaauuuugaaaguccauaugggaaacuuagaucuuuguuuauuuccuuaaaccaucaugaaugucuuggugccugaucucauguuuaugggauguaucuggaugagagagauugcaaauuuagaggucugugacuggauaugacccacaaauauguuuuguuuggucuccuuagugcuuuaaaauucuuuggauaaguugccaggguuuaaaaucaggagauguggccuuacuguccuucagucccacauguuaucaagugacuggagcuuuaagaggugccccaaguuuccauggcccccuuacccccaucacauaaccggccuuauuuuuaccuauguguccgaguuugcagccaguggucuagagcagcacuguccaguacaguagccaugagccuccuguggugguuuaaaguuaagauuaagcaaaguuaaaugaaaaguccuguucugcauuugcacuagcuaccuuucguuugcucaguaaccauaugcggcuaguggcuacugcauuggacaucaccguuguagaacauuucuaucauugcugaaagcuguauuggauuggucuaggucuucaaacaaagguuacuaacucugcuucucauuguauuuuaaaccuugucuccuagugugacuugccauauugcuggccucauguguaauaaaagaaagugguuugauggugugaugauccuaaauaccuuuugaaggguaaaauccuuuauauggacaauuacugguaauagcccauaacuuuguaagucccauuaauccaauauuaauuaacguauuuuaacagacauuuacuuuuaugguuuauaaacuaucucuggagggcauuccagaagaggaauuuuaaaaauagacugcgcaguggcauuguuauuggguugagcacccaggcacuuccuaggugacugcuuugaaggauaacaaguuuggguaacaguaacuacuucugccaucguacauguguaugugcaaagucacugacuaucacacuuuucuugaggggguauuuguguuguguuuuuauucuugaaugugaaaauuacaguguagagugcuaauuucuccuuacuuagugagguugcaaucuagucuuuuaaaauaacuaaaaaauguguagaaaucagcagggcacaguccuguuuuuaaagcagcaccuagugcauuacauuaaaaacagagcuaacaguauaguauacaguguguuuucuuuuugacucagcaaauguuuucagcauuuguacuaagaggaugagagcacauauguagaagugugcauccaucaucguuuuguguaaaauaaugaaaacccugcauauuaguaggacugggugagugaugaugauaccuacguacaauauuauaaagccacugaaaauagggguguagaucuguauuuauugacuugggaagauguccauugcacauugaauggaaaaaugugcaugugcgugugccuggaugucuugcaggauagucaccaaaacaguaacagggguauuguugagugauggaauuuuaggcaaccuuauuuucuuuucuagauuucaugccuacuuuguuugccccuuaacucaguaagccacgcuuuauuauuuuuaaaagugcugcucucauaaagaagggaaauaguacuuacugggugccugugacauuccgagcauuuuguuaaaacuucguuagccucauguguacucuuuaagguaaauguauuauuauucugguuuuauugagugagcauuugaagcucggagauggagcagcugccaugggaggagagcuggaugucagccccaaagaugugcuuacaaagccagugcuuuuuuuccuagcugaggcauucccagagccucagagagguguagcgccgaggcugacguuugaaguuauccgauauuggcagagaaggucuuaagcuagcuagagagagagaaagagagaugaaaaagacuaaaaaugugggguuuuguguauaucauuauuauguuauagugaaaauggcuuugguguagucaggaggcucgggcuuauuugcaguuuggucauuuaccaaacuuuacaacccuggauaagucuuuuggucuuuauuuuccuuauuuccaaaauaaggauaauauauucuauaucucaggauuauugugagaguacucagauucaugcaaaauaccuuaaaacaaugaagugcaauaugaaugugaacauuguuuuuaccuuagacaauccagucuucugaagcuucagaaauggccuguuuuuaccaccuaguuugucccuuauggauguuuuuuuggaggagaggauugaguauuccuuucuuugcucaaugagcagaccucauguucuggaaagauaacuguuccauuuuggggccuuuacaaguguuuuggaggucuaagcuucuuguuauaaacuuauaggucuaguggucagcaucacucccacugcucuaauuuuuaaaacuuaaaacugugaaguguguauagaaugugcacaaaacacaaagacacaauuuaaugauguauuuuaaagcuaauagcuguuuaauugaucuucaggacaagaaauagaacguugcuuaggacaucgccaccaggacuccccuaaguaaccacucuucugacuuuuaugauaacugcuuucuggcuuuucuuuuuaguuuuauuaucuaaauaugcaccuuaacauuacaguuuauguuugcuuuuuuuuuuuuuggauggagucucacucuguugcacaggcuggagugcaguggcgcgaucuaggcucacugcagucucugucucccggguucaagcgauucuccugccucagccuccaaguagcugggaugacaggcgcaugccacuacgccgagcuaauuuuuuguauuuuuaguagaaacgggguuucaccauguuggucaggcuggucuugaacuccugaccucuugauucgcccaccucagccucccaaagugcugagauuacaggugugaaccaccaugccuggccauguuugcuugguuuuaaaaaauugaugauuuuuagaaauggggucucacuaucuugcccacacuggacuugaacuccugggcuuaagcgaucauccagccucagccucccaaguagcugggacuguagacaccaccgugcccacuuuauuugcuuguuuuugaacuucauagaaauguggguauguuucuggccuuuugauucauucuuacaagauuuuguauugcugaguguaacugugauucauuuauuuucaguguuuauugcaucucuuaguaugaaacccacaacuucaacauuccacaguggauggacuuaaggauuucuaguuuuuggcuacuguaguagugcugcucugagcauucuugcacauuucaccuguuauauguaugcauguguuucuguugguuauauccuagcagcaguauugcugcauaucuucagauuuguuagcuaaugccaauauguuuucuaaaguguugauuaugccaauuuacauuccugcuagcauguaggagaguuucugugguaccacacccuuguuaacacucagucuugugggucuuuuuccguuuuagccauugugagugugcgguagugucucauuuaauuugcaguuccuugaugacuaguagaaauugaacaacuuuucuuagaauguugaccauugguaucuucugugaagugccucuucacauauuuugccuguuuuucuacuggcuugccuaucaguugcuuuguagagcaccuuuauauauucuagaaacaagccuguuguugcuuauuuguuuuguaauaucuucuucuagcgugacuugacuuucacuuucuuaagugguuuugauaugccaaaguucuuaauucuaauuugguccaguucaucaaucuuguccuuuaugguuuguguuuauuguguccugauauuuuccucuauccugggaucuugaagcuauuauguuauuuucuaaaagguuuauugcuuugcuuucugcacguuuaucuauuaucaggaauucauuuuugugcagggugugagauaggagucaacuucuuuuuaaauccauguagauauucaguugauccaggggcaucaauuuaaaaaguagccguauugucacugcucuguaaugccugcuuugucauaaaauacccucauaggcccgaaucuguuucuuuauccugucuguuggugugucuguccaucaacugauagcacauugucuuaauuccugugauauuguaauaaaucuugauauccacggggagcaaguuuuaucaccuuguuuaaccaaaagagugccuugccauucguauuaucacacguauuuuggaaucaacuuauuuaguucuuaaaaaaauauauguuuguguuuauuaggguuuuuaguggaauguuauugaauguuuagaucaauuugggagaacugaaaauuucacaguacugaguauuccagccuauaguuuuaucuuuccguuuauuuuagcuaucuuaaaaaaauuuuaaaaauuguuacauagcuuuuugggcagauauuuauuuuggcuagauuuauuccuagguguuuauuuuuauaaaauuaaaaauaggaacauuuuuaacuuuccuuuuuggcuuauuaugagaauagaaauguaauuuuuuucauauauauuggcuuuguauuagucuugcaaaacuuaauuuuauaaugcaccuuuagaucuuguaguuuuuuuuuuuuugagacugagucuugcucugucgcccaggcuggagugcagaggcgcaaucuuggcucacugcaaccucugcuuccuggguucaagcaauucucugccucagccucccgaguagcugggauuacaggugcccacugccaugccuggguaauuuuuguaucuuuaguagagaugggguuucaccaucuuggucaagauggucuccaucuccugaccucgugaucugcccgucauggccucccaaauugcugggauuacaggcaugagccaccaugccuagcgccuucuagauuuuuuuuuuacgcaguuguauuuuccauucagaaugauaaucuuuuuuugucaauuuucauacuuuuuuuaaaaaaauuuuuugagacggaguuuugcucuuaucacccaggcuggaguacaauggcgcaaucuugggucacugcaacaucugccucccgguuucaagcgauucuccugccucagccucccaaguagcugcgauuacaggcaugcaccaccacgcccggcuaauuuuguauuugauuagagacgggguuucuccauguuggucaggcuggucucaaacugcugaccucaggugauccaccugccuuggccucccaaagugcugggauuacaggcugagccaccacaccuggccacuuuuauuuuuuuuucuugccaaaauuaguuagcuaggacuguagauauaauguugaacagaaauuguacaguggauauuuuugucguguuccagucucagagagaaagcuuucagcauuucaucauuaagugugaugcuuuuuguagguuugaaaaaaauauauccuuuaugaaguuaaggaagaaucuuucucuuccuaaucugcuaagaauuuuuaaucaugaaugcaguggauguucaauuucucagaugcuuuguaucuuuugcggugauuaacauaauaaaggggaaaaucauguuauuaauauggcaaguuacauggaaugauuuauuguuaaaccaguagcaccaggacagucacuaaaauugaauuuaaaagaauggauagcuucuaagauaaguauugaaaaguucuuuuaguuuuuguaugagaauuauuucacuuucuagaaagguauauuuuacagaucauagaauuauagguugguaauuaguaauugucuuucuucacuuugcugaugcauuucuuuauuguuggcaguauuggucuuaauuuucaucuuuuaaacaauguagcuaauguaucuagguuuggguuucuuuuuccuuaguguggugugauacacugggcuucuugaaucuguggcuugauguuuuucuucaguuuuuggaacauuuucagccauuaucucuucagguauugcuucucucucucucucucucuuuuuuuuuuucuuggacacaggaucuugaucugucacccaggcuggagugcagugacaagaucacggcucacugcagccucaaccuccugggcucgagcgauccucucuccucagcgaugcgaguagcugagacuacaggcuugugccaccaggccuggcuaauuuuuguauuuuuuguagagacaggauuuugccauguugcuaaggcuagucucaaacuccugggcucaagcgaucugccugccuugaccucucaaauugcugggauuacaggugugagccacugugcccggccuuuuauucuuuuuaaagguguauaauucagugguuuauaguacauucacagaguuauacaaccaucaccauuaucuaauuuuagagcauuuuuauugccccauaacacaagcuucauaaccaucagcuauuguuuaaaaguuauuucuaauuguaguaagacauacagaacauaaaauucaccauguaacuaguuuuguguacaauucagcggcaugaaguacauuugaauuaugcaaccaucaccaacgucucuuuccauaauguuuuucucuuguaaaacugaaacccuguagccauuaaauaauaacucucauuucucccuuccacaaucccuggcagccaccaguccacuuucuguaucagugaauuugacuacucuagguguuucauguaaguggaaccagacaauauuugucuuugugacuggcuuacuuuauuccacauaaugccuucaagguucauccauguuguaguguuucagaaaaggccuaaaguuccauuguauggguagaccaggagacuccauuuuguauauccauucaucugucaaucaacacuucaguuguuuccaccuuuuuacuccuguagauaaugaugcugugaauauggguuuacaacugucuuuggaaacucugcuuuuacuucuuuuggguauaugcccagaaauggaauugcuggaaucauaugguaauauuauuuuuaaucuuuuuuuuuuuuuuuuuuuuuuuucagacagucuugcucugucgcccaggcuggagugcaguggcacaaucucggcucacugcaagcuccgccucccagguucaugcgauucuccugccucagccucccgaguagcugggacuacaggugcccgucacaacgcccggcuaauuuuuuguauuuuuacuagagacgggguuucacuguguuagccaggauggucucgaucuccugacuucgugaucugcccaccucggccucccaaagugcugggauuacaggcgugagccacugugcccagcccuaaucuuuuuugaggaacugcuauaaccauuuuccacaacaacucuaccauuuuacacuucaccagcaguauacaagaguuccaguuucucuacaucuuuaccaacaguauuuauuuuuuauuuuuuaauaaaauagggcugggugcaguggcucaugccuguaaucccagcacucugggaggccaacacagucggaucgcuugaguccagaaguucaagaccagccugggcaacauggcaaaaccucuccucuacaaaagcucaaaaaauuagcugggugguguguuggcacgcgccuguagucccagcuacuggggagggggcagguugcugaggcgggaggaucacuugaagcugggagauggagguugcagugagccgaaaucacgcaacuacacuccagccugggugacagagcaugauccuaucuccaaaaaaaaaaaaaauucuaaugaaugucagccguuacuuuuuaccuauugucucucauuucuucuuuuuaaauuccauuuaaacuugauguuuucucucuauucucucuugccuauucuuuugaauauuccaucuuuuugcuucucuuuacuuuauucuggauuuuuucugcagacuuaguuuccuguuuaguucucuucauguauuuacagugcacuuaggaaaaagagcccaugcauugaguauuuaauuuucucuuguauuauuuguuuaaccuauguaacuuuaaaaguugucauuucucuacccaaaacuuuaaucauguguuuuuucuucuuagacauaauaagacugguuauuuaauuuaauuaauuuauuuauugagacaaggugucucucugucacccaggcuggagugcaguggcacgaucuccacucgcugcaacuuccgccucccaggcucaagugauccucccaccucagccucccgagcagagcagcugggaccacaggugcaugccaccacgcccagcuaaguuuuguauuuuuucguagagguggcauuucgccacguugcccaggcuagucuugaacuccuaagcuaaggcaauccgccugccucugccugccuuggccucccaaagugcugggauuacaggcgugagacaccacacucggccugacuuguuauuuuaaaguccguuugcaauuauucuccuauccagggacccagaguccagguuggucuuuguuucugcuaguuuucacuuuguccugugugacugguuaucuuugguuguguuucagauguucucuuugaaaaauuguuacaggaauaggccaggcacaauggcucaacgucaguaaucccagcacuuugggagcugaggcaggcagauugcuugaggucaggaguucaagaacagucuguccaacaugauaaaaccccgucucuacuaaaaauacaaaaauuagcugggcugauaacacgucccagcuacuugggaggcugaagcacgagaaucucuugaacccgggaggcggagguugcagugagcagagaucgugccauugcacuccagccugggcaacagagcgagacucugucucaaaaaaacaaacaacaacaacaacaaaagaaaauuuuuacaggaauaauccgaggacuagauuauuaggaugauguuuucuuuauccagaaaugacuuguguuuuuaucugcucagggcuuuugggcacaaacagucuaaccucacuuuaaucugaugucagggauuaggauuuuucugggccacccagaugcuuggaaacugggcugcagucccugugaaggcuguuuuauuuccaacucacucuccuccuaaagucuagccauuuggguuuccagcacaugugguaggggguuaacuaggucaccaacuuuggagggcuuuggaaucuaaccuuugcccuccuagaugacccaagagguuauuaaaagugauucucugugcccuuucccaguguauaaauggccccagggcaaagugaaccaguuguugcaggcuuauaucuguaaauuuugguugucucuguuucuugaccuggaaguucuucugugccuucuuaguucucugaugcugcagguguccuuuuauguccagcauuuuuuaguugugcucggcaggaguguuggucccagugaccuggucagcccucuucucucuuuuacaaaagagucuuuuaaagguuuguaggauaaagaagauguguuggaccuugagaacucaucuauuccagucucauucacaucaauacaguaggguuuauugaucaccuaccguguacccagcauugugcuacuuauuaugggaauucugaggaaaugcaagaugauaguauuccuuacauucaaggaguguagcuggggaaacaagcacaaacguagauaauuaaguaaaaugucagagucaagggucacgcagaguuaaugguguuggaagaaaaaaauuacaacaaauuuaaagauuuugauugacuuuuauucgugacuuuagaaucagguaacaccucauuccauaaaacagaauuguguauuccagugagccaugcagaagaaguugguuuuauaaaccuaagggcugaagaaagcagaaauagggggaaaaaaaaaguacccuuaccacgugccaggcacaguuuacauacacacuuuauuuaacccucacaacaacccacgaggcagcuguuauuauuguccauguuuuacagaugaggagguuaggcacaaagagguuuuuauaguuaauuaucagaguggucuucugggcaaggacuuuuucauguaucccuuucuucaguagggaaauggaaacccaggagaagggccugagcugugaaagugccuggaacugccuucuguccuccuggcugacacccuggaccucuccuguccuauuucucuggggcucaggugcaucuacccacucagucuucuucgggaguuuccaggcuccccaguuccucuaggcaacgcauugaaacuugacuguccggggcuuagcgaggccuucucugcucagaccuaccaaguaaacugccauccuggaaaagcugacgucagcuuucccccaaauaaacaauaguccucuuuaccuuagccuugaacgauguaugaagggauguuucugucaugaauaacaccccuaccugcaaccaguaaugcaacugugcagauaagcuuaagauuucaccagacaaaagcuaaauaacucacuuaagugaugggcuguucuuuuuaaaaaauaaacuuuuuuacagaaaaauuacaaauaucucauuauuauaucuaacauuaaugugguuuauuacaauuaaugagccaguauugauguauuauuauuaacuagaguucaugcuuuauucauauuuccuuaguuucuaccuaaggaaaaaugucaucuuucuguugcacacucuuuuccaggauaccucauuaccuuuaguuguuauguuucccuuggcuccuguugcugugacaguuucucagaguucuuguuuuugaugaccuggacaguuuugagggguacuggucagguguuuuguaggaugccccucuauuggaauuucucugauguuuuccucauguuuagacugagcuuaagggucuugggaaggacugucacaggcaaaaugccguuuucaugacaucauaugacguguacuugauguugaccuccaccaucuggcugagguugcgucugucaguuuucuccgcaggauaguuacuccuccacuucauacuguacucuggaaggaagucauagugugaaaccuaaucccuuuuagcuggaaaguagagucauuauuuuaaaguguuuauaccauuauuauauuauuuaaaaaaucuguuuacaaauuguucucuuuauaaaaguuuuaaaaauuauuuucuucaauauugucaaguagccaguuucuugcaagaacauuuuauguauuguggggauuauugggccaauuuagauuccuucaguuuugaagcaguagauuucaaagcugaauagaaaagucugcaguuuuugcuuuuaucagccgccagaggcaggcaggcacaggcuguauacaagaaauccuaacuguugccccguccuguuugguuguugugugaacauugggcagugcccggcuuuguguuggaagcauguuuaaugaagucucacagugcaaaacugcuucauacggaggaaggguuuaaucugacuauuggaccauuccacaaaaagcucacuauuucacauuucuuuuucuuuuuuuuuuugagaccgagucuugcucugucgccaggcuggagugcaguggcccgauguuggcucauugcaaccuccgccucccagguucaagcgauucuccugccucagccucccaaguagcugggacuacaggcaugcgccgccacgcccagcuaauuuuuguauuuuuaguagagacgggguuucaccauguuggccaggauggucucuaucuccugagcuccugauccgcccgccucggccuccccaagugcugggauuacuauuuuuuuuuuuuuuuugagauggagucucgcugucgcccaggcuggagugcaguggcgcgaucucugcucacugcaggcuccacccccccggauucacgccauucuccugccucagccucccgagcagcugggacuacaggcgccggccaccucgcccggcuaauuuuuuguauuuuuaggagagacggaguuucacuguguuagccaggauggucucgaucuccugaccucgugauccgccccccucggccucccaaagugcugggauugcaggcgugagccaccgcgcccgaccuggauuacauuuuaugugaggugcaaagaccuacugaaacuucgucuccuauugaaacuugaccuagacuacugggcugacucagcauaaggaaguuacagaacaguugaugaucggcguaaaguuaaaggggugaaguucuguugaaauccuucccguuuaaucaccgcaaaaacugaaagaacuuuacuugcgacacuaaaaccacgcgucuugugcacccucuacugguuuaaccacaaaguacuaguuuauuuacgaauuacugcuguuugaacugauaagucuaugaaaacagguuuucauuuuuccaaaaauugcaccaaaauaaagcaaaagcucuaguugaugcggguguguuguucaggcguuagcaguacugcccucacuaugcgcucauuggacaguagcgcaaccccaagaaaaggaugguuauaauagaaagucccugggcugcaagcaggaagcgccaauaccugguaggguugugguaauuaauucgugagccucgcccuagucggucugguagcuagcuuaccuccagccuccacagcuuucgacgacaccccaauucuuuguuuucugaggcucccgaagggucgcaaaagcggcggcucgguuuuacccagaagaccgcgcgucggccgcucgaaaauuugcauacgcuuuucucgccggggcggggcuggcgggggcgggaccgcggcgcgcucuugaacuccacccgcagcuaacccggguuuggcuacgcuguauugccuuuuauuucguuucuccucaccgaguauuuuccauuauagcuguacauagcucuuuuuguggaagaucauccuucuucgugcuaaucucuuugguccuccagucggcaugcgucuggacucucggacugcgucugggccggaaaugucuaggccuccccggagcgggugggcgggagcgcugccccgcaggccggcugcuaacaggcucccgguguuucccgcugcaggugguucugcugggcauggacauccuguccgcccuggugacccggcugcaggaucgguucaaggcgcagaucggcacaggugagcugcggcacuuguggagcggacccggccccuucagacccccagccuucccucggccuccccggcucccaaacccucccggcagccacccugccuccccuccagcccccucucccucccuuccgcuccucccaaacagccaguccccgcccucccccgcagccccccuaagcacucgcagccugggucggccgccccgcugccuucccuuccagcuggacuccccuggccucugggccugcgggcgcccuuacccucccccauaccuuuguacuggcuucacuguguucucacacggaacuuaguaauacguguucuaauaugaaauauuagugccauuuuuauuucuuaugcuaaauuagcugucacucuuuagugccaaccaagucauauuuuacccugaccccgguccccuuuaaugagaggcaguuuuccuugagaaauccuauaaaaccaagccaguuguauuuuucuccagaugauuaugguuggcaugacuauuuucaccuugauuguaaaugucauuacaaauguauaguaaauguucacucuuauuuugaagggaaaacaguaugucagcaaaaugaaacaaaacccacagauuucauagauuuaaauaccucuaaauuccugaccuccgguguuucauggggguaguauaaacacuaagcaucucuaugcaaccauuuccuuauggaauuucucuguuuuacguugguacacauguauucuuuacuguuaacuuuccgaccaauaugcuccuucugaaaaggucaugagcaccgacuguuuacaaauuuaaaaaaagcuuuuacuuuuagacauuugauauuuuaauaguguuccauuuuccuccuaaauuagcugaauuauucagggauaucucauguaauagagguuuacaaacucuuaaaauaagcugaucucuggucuacaggugcacuuggaccacuggugggaggguccacccuggguaugucggggaagauggagagcugggcucugucucauguguguaugggcgugauguaaaacuaaaaauacacaauagugaugaaacuuaagauuuauucauaagugcccacuccuuccacccccaaacacauauacuggagccccucuccuuguguuuuaccuaaauuuuccuuucuguugacucuuccucucaaggucuuccauuuuuaucagcuuacaaauacguugggaacuggcuggaggaacgugggguaaggaggaagacaaauaguguaucuguccaugcaaaggauuuugcagacucuuuuggugacuuucauggacuucagcaaggagaguagagcugugagcaaagaugagugguuuuagaaugagauacaucauuuaggucagggguuugucuucccacauaauugagauaggaauacuuggugaccacagacccccaaauaggguuucauuugaucaguuuccauuuugauuuucagugcugccaagucuaauagacagacuaggagaugcuaaagacucugugagggagcaggaccaaacucugcugcuaaagaucauggaucaagcugcuaauccccagguaggggcaagagauguguuuugaggucagcuggccagugcgcgugcaugcacgugcgaggguguguguguguacuugcacaaauggugugacuccauagacuuaagcugauguauuacagauaaaaauuuucacagcauucaaucuguuuccccaugcaagauauuuaaauaagucacaaaacuaugagaugaguaaauuaguggauuuaacauggggguauugaaucuaauauacuuaguuuuaauccauuagacucuucagcucauuuauguaaccgacucuccaauucucugaaaagagggagcuguggugucuggggagucaggaggccuggcuggagcccuggccccugucuuccggugaauuggggcugcugggauggaccaaaacagcccugcuuucccagcuucuacuguccuuuauuggggggugaucagaaaaaacagaggccagugugagugugugaucuuuggcaacucacuagcuccuuuggccuugcuuuccucacccauaaaaugaggacaguuauaccucucuuucaggguucuugggagaauuaaaugcaauuauguaaaugaauguguuuuaaaaauuguaauuugauauacuugauaacaugauagaugucaucauuuuccaguaugcucucgagaggauuaaauguguugguagaggaugggacuaauuuggcgcucguuaagaggcuugccuucuauugcucccuuauaaagugucagcugcagcagucuucuccuuuccucaccuguucuuugucaucugcaguacguaugggacagaaugcuuggaggcuucaaacacaagaauuuccguacucgagaaggcaucugucucugccuuauagcaacacucaaugcguaagucugggaugagccugacauuuuuacguggcugaauuuuuuaaaacuuuuuauuuugaaauaauuauagauuuacaggaaguugcaaagaaguguagugugagaucucaugcccccuuuacccacccuugcccaguguuagcaccuugaauaacuauaguacagcaucaguaccaggaaguugagauggauacaaucccuagaacuugcgcaaauuucucagguaaaaccacaugugcauuuguguguauauacaacugcacagucacugccgggcuccuucaugcugcuguguguagcugcacccugaccccuggcaaccaugaauguauuugaauuuccaggaaucuguucucccucccuaugauuuugucauuucaagaauguuauguaaauggaauuauacaauauguaaccuuuugaguuuaucuuuuuuucacucagcauaaugcccuugaguuugcaccugacauuugauaguucauuuuauugcuaaauagaauuccuugguauagaugugucacaguugguuaaacuagucaccuguugaagaacauuuggguaauuuccaguuuuuggcuuuuaugaauaaagcugcuaugaacauucauguacaaguuucuacaugaacauaaguuuccaucucucuuggaucacugcccaagaguacacuugcugggugauuugguaaguucauuuuuaguuuaaaagguacugccaaguuuuuccccagaguuguccauacuguuuuacauuccuaccagcaauguccgaauaaucugguuucuucauacccuugcuagccauuggauguugucauuuuuuuauuuuagccauuuuuauauguguguaguaauaccucauugugguuuuaauuuguauuuaucuaauggcuguugauggugaacauuuuuuucaugugcuuauuuguaggagaggcuuuuuaaaaauuauaaauuucaagccuuuuuuucugauuaugaaaaaauacuguauauaucauaaaaauguacgcaaggaaaaaauaaagauugcuaugauucuguuaccuucagguaaucacuguuaaauuuggugcauuuuauccuaaccuguaaaguuauguuauuuuuaaaaacaaaauugagauuauaauguuuauauuacuuguaaauuuuuuccaucuuaauauguuagccuuuucagugccauuaaauuuggccauauguaacugaagcuuaagaaaaaaaaaagaaaacuucuagccuuugaucacaguagcuccaguuuuaggaauguaugcuaagguaguaggcagauuaaccaagagauuuuuauucacaaaggcuauuugucaugacagggauggugauggugaaaauuguaacucaaaugugccccaguagggcaguacuuggcucagaugugccccaguaggguagaugcucugauuugauugcagucuuuucauccagcgguguugccugaaugucuagcucugccacagcacacgggagaauuaaacaaggucccucaagugacucguaguuggcuuaaagugacagacaguaaugcagaggcagcaccugugaggcaagcgggaccuggggggcuggagcucuggcccagccuuaaaggguuagggccagauuggccagagcccugggggacaggacgaagacuuaucugggagaagccacccuagguuuugaacucugugcaaaggggccaucggacacauuuacuuuggagccaguguggaugggauggagagagacuugguaugagguggugauggggauuggggagacacgggaagggcaggugugggcagacaggcaucuuucuuucuuuccucaguucucacuaacaagaaagcacuccuuuuguuuucagcucuggagcacagacuuuaacacuaagcaagauugugccacauauaugcaacuuacuuggagauccaaacagccaggugagugagaaggaaaacccucgggagaagucauugcuuacagacuguugagaugcauucugguguuccguagugggugggacuggaguccuaaucuucacagaacacugaugauuauuuaagagauccaguacccauuagcauuuauaaaauauuuauacauucaaauguauaaaauaaguuuacauuuaaguauaaaauugguaaaugugguggccagucuguccucuucuauacacagggcugagaaaucacuagccuagaaauugauguuauccagaccagccuccaagauaagaugucuggccaccaccucugcagccaaaagggguggugccggggguggaggugcagaaucugcugagguuggggagaaugauugaaagagggucugaggggaauuuucugaggugaugggaauguucuacauuuugcuuugggggguggcuccacuguguauaucaucguggaaacuccucaacugaacccuuaagaacugcagacuuuaccuaaauuaacaaaaaguaccacuuccucagugugaggguaggagaggagcuggcugucucaccugugaguuaccaggcaauucacaaaguuguacaagucugggcuggagaaauagcauugaacucuccucccaguucaaugcuauuucucaaccagagucauuuuuauuaugucaucucauacaaacugauaagaaugauacuucauuagaagaagggacagaaaauggaacaguaauuuacaagagaaauauauauggucaguggccucuccugugaaaucuugguugauaacugcuaaguuacccucccaggagguuguaucaggcuggccuucuacccgaccuccccuggccucuagcuccccugagucggcaccccuccccucuugcucuccaggcccuuuccuuaucgugcucuuaguuccagcagcaggcgucucucccuucucuuuggcuguugugcugcuccuuccaccccagccucuccccuccucacugccugucgucugcugucucccugcuuucuucuuccacucacgcccuuuuucagccuuuguugaaaauauauagcauuaggccgggcacgugguggcucaugccaguaaucccagcacuuuaggaggccaagguggguggaucacuugaggccaggaguuugagaccagccagaccaacauggugaaaccccaucucuaccaaaaauacaaaaauuagccaggcaugguggcguucaccugugaucgcagcuacuugggaaccugaggcacaagaaucgcaugaaccugggaggcagagguuacagugagccaagaucgugccacugcauuccagccugggcaacccagcaagacuuuuucuuuaaaaaaaaaaaaaaggaaaauauauggcaugggaaauaaauguuuagacauuuuuauuuacuuaaucauacuuuauauucaacguuaauuuaaaaauaaauuguacuauuuuuuaaaaagauucuaaguuaccaaauagauuaucguuuuguauccuuccucccuuuugguuuuguuucuguuuuuguuuuccgugggaaaaauccuuuauagaggccgcacucuggggguuucgcugccgccacauggagugcucuagcagagcagaaaagccaacuugcugaggugauucucuccucauucaguugcugacuuuggccagacaggugaugugaauguucacacugccuguggagaucuucauaccuggggugggcgguggagggcugucaccucuaaaugcacuucugugguggggcaacauaaaaccacagcccagaccgacacuagccagaacuacaacaagggacguugucuagagucugguuuggggaggggagcacugcauggcugugcaccacacugcaguccaucccacaggguccccucacucacccccauuuccccuucuuccucuuuuucuuccacauauauuuagcgagagcucaugcugugggccugucuugucuguguggauccuugggcuuuuuggggaaggggauggagauuacuagcuugauuuugcuucugagccucaaauuuugcuucugcaacugaggcggaccacauccuccagaggaaagugaaggaaaugccucauuguccuagggcucuucacugaugaauaaccucaguauuuccccgcccaaaagaucauggacucgguguagauuuuaagagacauugggaguggaauguuaagcauauuuaaaauuuugaauggguacauucucauccuugaagcuauucagauaagccuuggagaaugcccuacucuucacagguuuuccuuuucucugaaguuuucugcuagaggaggucucacuuaaaaguucccuaaagcuuugguagaaaggagacaggaagggccuagucuguuuuuguguugggcuacucucugauacuauuuuucuccuuuagaucuaggguuaacuuguaaggucucuagggauuuuaacaagauuuucuuuauuuuagaaguacacagauuaaauuucaaaugaucagcacaaucccacauucucaaaauguagauucaguuguuuaagaguuuaagauaaugucgagucuuuaacaguuugacauacuguuuuaaaguugccaaaaggcagaguauguuuaauauuaauacuugagcuaccugacgcaauguaagacaccuacguuaaaggcauagaucccugcuuugcauguaauagcugaccuuggggucacuugcaucuugagccucaguuuccccuuuauaguggagucagugggaagugccucaccccucaauccuuaugagaguccuugcaagugaauauucuuaggugcuggugugaccuguuggucuaaguagaagacucucagaaggccaaguuacucaguagucuccucaucaucugagauggucauuuucauuugcagaaaucaugcaccuaccaugugccaguggguuucugagaaacucagcuguauagugcuuuaaauauaugaaaaaccuuaauugcaggauagccuuagugucuugagauguauuugugauauugacauagccauacuuacaccaaacauuggcagcccuggaguagacuauacacauacugccauauaccagacacuaguuucacuaccaaaaaucaggugcuccuggacugauuauggggaauaauaauaauaauacaaccgaaaaacaaaaguaguacauuuaaauggauuacaucuuacugcuguauaaaucauaaauagauuguauaauuuuaaaaaugauuuaugaagaagcagagagauaguuuuuuaaaauaagauagaaaaugugagacuugucuaaaauguuucauuaagccaaaaauucaaguuagcacuuccugccuagugucuuuaauggcaguuauacuuuuugugccaggaagcccuaggcuuuggucaggaguuuggagccuauaaugguuuugugggcugaguucuaggccugugugucugcuuuugagaaacuucuuauuauuuguuuuguuuuuucauuucccccaccucauccauaagaugagguugguacucuacgggcagcuuucaguauucuguaguagacaggauuuacagcuagaguauuccaaauugagcacucugaaaauaauccauauauucacaugugccuuaggaauguuuuguccgcacauauauuugcacacgugcgcgcacacacacacauacacagacauacaaucaauccaugucucccuucugccaggaaguucugccaccuaccuccccgauacuaaccaaguuaauuauuccugcuucugggguucuuguguagcuugcaugugcuuuugcuguugccuuuauuuuaauuuuuucauuaaucuuuccuacuagucucugaaccucuagaguuaagauuauaacuuguuccucuuugcaguucccaaugccccauaacuauuugaaugacuuucccuuauuugccaagucucagaccagagaggacacuguuguaucaguguugucucugcacuuagacaccugaccuaguagucagccuccagcucuucauuucccuaaagccagugugcggagaauccucucucagcucuucaggcagcggcuaacaaagacuggauuugguguuuaaaauuaacuuggcaaguguucguuuccuuggugguccgaaugcagugacucagagcagggaggccuuucagagugggccacaggugcacagugugugugggcuaggaugcuuuugguuacaaguaacugaaagcccaacucagaaucauuagagcaguggggaaaugugucauucugcaugacguaggaaguuuccgggaucugccaguagcucggagccggagucuugggcaccucagccugugugcauugccuccuagagcucucagcacaggcacagcaccgguaccacacgcacgguuggccuggcagagaggaggcugcugcuuugugagcuccucuucuguuuucaacuuucauaucgaaagguucaaacauacacguaagcagugagagugccauaaagcguccccaugugccaucagcucauucgacaaggccaguucaguuuugucuucuuccccuccuccaccccauuauuuugaagcaaaaguuagauuauguugaagcaaaucuuagaccacauuuauuuaacucuuaaauauuuuaaaagauagacuuuuuuucuucaaaaacauaaccuuaauaccauugucaccuccuaugucccgagaaucagcaguucucuccuaucaucagauacccagccaguguucacuuuucccugaaugucuuuuuccaagagcagagaaauguuuucuagaagcuuucccacagauuccccucauguuucauuguuggagaguugcauuccgugccccugugugacccagcugcugggaagggacagaauugugugauggcuguacacuaaggauguaccuccugagcugagggaagcuuuucuuccuggagguggggauuucaguacgaagucugugcuuguugaugaggacagggcaguggcuguaacagaggcagccagugguccgaggcauccuaacaauaagaauucccuugacuagauaagaaaagccugaguucugccugaagacuuuugauuucaucuucacagcaccucaccugcccuuuugcaggcaggcuggcagaggguugcauccagugggacuccccaugcugacugcuggcccucuuguugaguuugguucaaagccuaaaacaucuugaaacauaugaccauugcuaauuccaugcugucuccagcuggacagagcucaggaggagggaggagcaccucugcugcuggcuugacagagcuuccaugcggcccugccacaguugcagccugggagccaggggugggcucuugggcacagcugugcuggggugcugggguacccacgcuccaaggcacuggcuguggggcugugcuggguucuaggaggacaggguggauuuagggucucaucaguuuauagacugcuucccugucccccacccuagggcggaagccuuccuuugaguuuuuugcuuugcaggaagccuuuauuuuggcauccacauuaaggugcagugugcuggugagaaggauguugacuugcccccagagaggugcuccagccugccauuccugaucugugggcauugggcaggugacuaaccuugccagccucuacacccuccagugugcagugacuaugaggaaggaaggaacaacauggucagacguuggagaccuuagauucuguaaagcauacauauaagaccuggcagagcgugcugcauguauggggcucuugucuuuuugcagucuucauggccugacacauuguggugccuuucuguggugagccugaggggucagcagggagaggcagugcgagaccagugagagccuguguagaagugaauagcugcauuguccugcagucucagcugaauggcuuuuguuuaaaccucuucucuauuagaguguccuacuuugcaguaccaaagaauaccuguucaucugcaguucuucagugaagaauaguuuagaccccuaaaugcuaucugacccuguaacuuucuaggucuaaggaacgauuauuuuaaaggauaaagauguugguuuaaaagauagagauaacacuagccguuguguugauugcuuuauagauacaaacuauaggucacaaacugcuggcauaaagcugguuucagccuguagauuuguggguguguguaugcuugugccugcagaauguuuuaauuuuacauuuugaguucaaaugaguuuauauuugggagacuuauauuuuuaacuuuucuugaaaggguagaaggccugguaaagcugugcuaccauuccucuguggcuggguggugguggcccaucugccugagcaccuuaucccucuucugucccugccuccaggguucccugccagugccauuugucacccugcacucagccugcugcaaucacucacuccucaugucacugccuggccuguguaggcguuucaguucauuuucaccuaguaggcacucaaauauuuguugaaugaaacuguuauuucuuucaguccucagagcaacccucaguuuacagaggaggaaauugagaccaaaggaguucuaguguuuugucuaagguuacacagcucccuaaauggccaaguagguccuuaagucuacuuauuaauauuugacucuaaagcuaguaauuuuuccaguaaaucucuuaaacguuuauggcccagacuuucuaaguagcugccuggguauugauuguucuuuaaagagaucacccauugagauuugcucugagcagauguuaucccuagaaacuaagcaauggugauacacuuuaauaguauucaagguauaguagcauugacuacuucuguaauauaugcauuuuucuuuuuuucuuuuucuugagacagcgucuuguucugucacccaggcuggagugaagugguguaaucucggcucacugcaaccucugccuccuggguucaagcgauucuugugccucagugucccaaguagcugggacuaacaggcgcucgccgccaugcccagcuaaaguuuuuuuuuuuuguauuuuuaguagagacgggguuucaccauguuggccaggcuggucucgaacuccugaccuccagugaucugccugccucggccacccaaagugcugggauuacaggcaugagccaccgcgcccgaccgcauuuucaauguaaaaauauucccuaacauuagaaauuauuuuuuucccucaaaauaaacugauaaucuguguuugucagcucuggcugccauaacaaaaugcuguagaccgagugaguuaaacaacagaaauuaauuuuuucacaguuuuagaggccggguucugguuggggcucucuuccuggcuuguagauggcugccaucucacuaugugcuuauaugaccucuucuguguguguacccagcucucuggcuucucuuaugaggacacuaauccucuaauuuuagggucccgccaucaugaccucauuuaaccuuaauugccuccuuuuuuuuuuuuuuuuuuuuuuuuugagacgggggucucgcucugucacccaggcuggaaugcaguggugugaucucagcucacugcaaccucugccucccggguuuaagugauucuccuaccucagccucccaaguagcugggauuacaggugugugccaccacgcccagcugauuuuuguauuuuuuaguagagacgggguuucaccauguuugccaggcuggucucgaacuccugaccuugaacucgccugaacuugaacuugccugaacucgaacuccugaacuuaaacucgccugccugggccuuccagagugcugggauuauaggcacgagccaccauacccaguuaccuccuuuuucuaaaaaaaaaaaaaaaaaaaaaaaaaaaaaaaaagcuugagucuugcuuugucucugaggcuagaguguggugguaggauuauagcucacugcagccuccaacuccugagcuugaguaauccucuuaccucaggcccccccaaguagguaggacuguagcugaguaccaacuggcccagcuaauuaagaaaaauuuuuuuuguagagaugggcgcucacuuuguugcccaggcuggucccaaaccccugggcucaagcuguccuccuaccuuggccucccaaagugcugggauuacaggugugagccaccaugcucggcccuuaauugcauccuuauaggcccuaucuugaaauauguuggagaguuagggcuucaucauuugaauuuugggggcacacaguucaguccacagcaugagguuuugggugacaauauagccuaagauuugccuuuuuccacuggaagagauaaaaauuaugaguaaaguuaccugucauguaacacuguuaaaucagaggacucccuucaguauuucaaauuguaaauuuuugcuuguauuccugcuucuuuucucuucauucuccacuaccuugauguuguacucccaucuuugcuuacugaauuaagcacagucuccccaacaccaccuggccuugguuccauuuuauguuuuaaaaauguuuuucuuccuaccuuuuuauuugcagauuuuuuaacauacagagaaagugaguguauuuaccaguuaacauuuguuacauuucuucuguaucucuguguacacacauacauacauauacagacacauacuuuuuucuugagccauuugaaaguaacaugcagauauaaugauuuuuuuuuucuuucugagacagagucuugcucuguugcccaggcuggagugcaguggcacgaucucagcuuacugcaaacuccgccuccaagugauucuccugccucagccuccugaguagcugggauuacaggugcaugcaccaccacgcccggcuaauuuuuuuguauuuauaguagagacaagguuucaccauguuggccaggcuggucuugaacuccagaccucgugaucugcccgcuucggccucccaaagugcugggauuauaggcgugagccaccacgcccggcuuaugaugauauuuuuaacccuagacauaucaguguguauguaucauuuaauaacaaagauauuuucuuauauuaacgcaugucauuuuucucacccuggaaauuuaacauggauacagugauguguaauauacaguccguauucaaauuuccccagguuagaaaaaaagucuacccugucucucacaccuuauuucguauuucaugcugcuuucuuaguuugaucuggucuggccagaccggcguacuuccucuuccugaagcaugugccgugcaugucugcuuucgugccuuugcacaggcugugucuuauucggaauucgcucauuccaucuggaccuggugaaauccugcuguuccaagcacuucgcagugguuucuuccucauauggcaucccuugacauccccuaaugugauugcucccuucuuuaaaccacaaccucuuuaugcucuugaauaauguuuauuccaucaugcccuguaauguagacuuuuaggacuuuuuaaaaaucuccuucuuaggacuaggggcuucuugaguaugggacuucauauggccuguacuacccauuuuuguugcucauuaaguauuuguuuaauugacuuaaauccagaguguuuuacaugguauuuuauuuuuaguaucauuuauuuauuuuuaguguuguuucuuaauuuggaaagauggucugaaaauuccaguuuuccaaaauuaccuuaaagaacggaaagaacuaaggauauggacuuugccguguauauagggaugggggucccacaguuuuacuaccguuugacauuguaucagcaaagugaaaacugucaaaacauggcuuucucuagacaaauguauauaaggauuguauucacaguugcacugguaaaauggugauaaauuggggugguauauggccuguugugucccagcaggacuugcugggggaugacacagagcagcuguaagaucucuucuuuuauaucuagguucgagaugcagcaauaaacagcuuaguggaaauuuacagacauguaggagaacgugugagggcagaucucaguaaaaaaggauugccacagucccggugagugcagauuuuuuccuuucuucugcucuacccaaccccccgcccccuuuguuuuccaguuaauaucuugauuugcaauacuuuuucuguugugguuauuuuauucaaagaauauaagguuagaggguaguuggagauuuuauccagaucauacaucagggguccgcucccauuccaguuccucagaaaugagaguuucucacucagacaacuggccaggucccaugccacauacugauuuuaaaagcaauugguauugaaaaauucagcacucuuacaguuuuaugguucuguaucuaugauucuguaucuauaucuguacagacagcacuuaguauaguaggugcuuagaauauauuugaaugaaugaagccauuccagaauguguuuggauaaaaauucauaaguuauaauuuuggaaaucauguuuuaaauguaacuuucuguuuucaugucauucacaauguguauaagcccaugcaaggggaucagcgucucaucagacccaagacaauuggaguccacaaaugcgacuuuguuauaguccagauuuuuaaaauaauguagugaucagauauguauaauuuuaacugugauggagaaacuuaacaccaaauuaauuccaaacuuuuacccugggucauuccuuuaagggggaaaguaauguuaaaauuccagauagaacuggaguggacucacagggcagcuuaucugagccugucauuuuguccauggaaaccccagaggccuagaaacaugaagugacuuuugagagauuacacagcuacuaagagagagaaccaaguucaaaacccuguucuucugacuugccuuuuaauuuucuccguccuguuucacaaaagaguuuauggcauacugggcaucuggaaaugggauggaauauugaaauauacaggagucaacugucuugaugucucuaaggcaaacaugacggcagugggccccagacccucaagugguggcuccacgggcagacaaguggacugugcuuccuugugguugagagucaugccugaucuggaauugcucucaccaucugugcacaggaugauuagaugggaauaaaacuacuuuucauguucuuuacaaaagauaaucugugauaauaguuuuuuuuguuuuguuuuuuuuuuuuaaguuccuguguuuugugaaccucagccuucuggucuuugaauauauggugagaacacaggaggaaaaagaacucaauagcaauacuaaacaaucucuuagggaaaguuggagggcacagaugaucagggaaggcaugauaucaagggaagggacuguuuaaugacgaagucaccgugauuguugggaaaacaggucucgagagugaaacccugcccugcugcagggauggccucaugccaugcuguguaacuugaugugaccccagaccaugaauccaccauuuuacacaguuuccaucuuaacaggaggcuuccucuguguuuuuggaggguaaccacagcaaacuagcaaaucagggggaaaugacauggugaaaccgagaucuagagaggugagugcaggaaagaguuaaugcagcuggccugagacugcuuuccuuagaaaggccugcuuacaggccuggccccaugcuggugucuagaaauguggauuuggggagggcccccaccauucccaacaaguggaauaagaguggcucacugugucaaacugcacagcacaauuugguuuaugcugaauaccugcuuuccuucugagagucuggcauuuuguuaagugccaggcagaggguguuuacaugaccagcccccaggaaaaacccagggcacugagucucuaaggagcauuccugauagaaagcaucucacuuguguuguuacaacucacugcugagggauuaaauguguccugugugacucuaccaggagagucucuaggaugcuugccugguauccucuggguuucaccccaugcaucuuucuccuuugcugauugugcuuuguauccuuuugcuauaaaaaaucacagcugugacuaugauugugcugaguccugugagucuuccuagugaaccaguaagccugggggugguccuggagauccccaacacagugggaccucagaggccuggaugccagagcuggaguuaaagccaccuuuuccagcuucucagucacauguuucucagguucuucacaugacccccuccuucuucucuuuaaaaaaaaaaaauaaaauaaaaaaggcgcuacaaaagaacuuggaccucugaauagaaaugaggguuucugcuagcucacguuaccuaaaauccuccuacaaauucuccaaaacggagaggguauucuuagggaaauggacccacacccuucacauccauauugugacacuuuggcauacacgagugcuuggagaacuaugcuguucuuuaaaaaccuuacucuagugagagaagcugaaacuucaaguuuccuugcauuuacuacaagacaguuaccuaagaucuagaacucugaggggcagaggcuccaguuaccaccuuuguuuuugugcccaaauggaaugaggcuuuuaugguaucagagaacuucaguaucugcuauauguggcuccacgugggugacuggauuacuugaauagucgagacuucucuuacaucauuauagauuuuuuaguaauuuugugagcauagauuuuucaacuuagcaagcuuccauaggacuauuacaauauuguaaaauuugcuuaaugcuuuccaaaauuggauuuaguucuaaauuaaaaaugucuucauaaggguuuguucaccaagagaguauguugagaagaauacgauuaauuauaucucuaagaaauacguggugaggaaaaugccuuagugagaucaccuaaaugacuuaaauagcaagaguaguaaucccauucaagcaacaauuuucuuuguccauuucgcaguugagaaaagagaccuguacaaccagcuucacuuuggaggagcuggaauuagggauuagggccauuuguuguuauuucagucuucucuucucguggccaaaaucuuaucgagccagauaauaaaguggagguaguuaacaaaaucuucauguuagagggucucccugcuuacauggggucucagaguaguugaggcccuaaagguauagaauauuugaccauuuaacaugguuuuuacauguauuauuauaguucauguauauauguucagaaaauaaauaacuucuagccaucauaagauaucauguaguugugugauacccugugaggcaugcuugacaacuuaauaaaauguuaacucuuuguuacuuucauagacuuuuagcauaucuugacauucacucucaucccauugagucuucuagaaaauauuuuuagucaguaucacauauuuuaguuugcagaguguugggaaaaaggucacuuauguuaaauuucuucugggaucaucauuugggaaccaagcuucuaaaaagcaguggcuuuaaaccugaagaugauuuaacuuauagacagggcugagacauaggucacuugauucauuauaacuauuugguaacuuacauugggaacuacuuuuuuaaaaaacacauuucauaauauuuacucguuugcuaucuauuuuaaaauuuauaaacauucaucagguuuuauuacuuaaugauuguuucggaaagggaaaauugguacuuuaaaauuuuuaacuugcuugcuaaagcuuuaguguuaaagagaacccaaggugaaagcagaugauaaauugcucugagacaucacuuauuuuuaauuuuauuuuuugucauaguuauuuguacacacagagauucaacuagauuuauaagauacauuuuugaaaagacaguuccucacucuuucugccuuuuucugcuccucagaggcaaacgcugucaacuguuuuuauugauccuuuuguuauuuacuguucuccuaauaauuggcagguauugcuauuuaaaaauuuuuugucacuauaagaauuauacuuuucacuaugcaggcugaauuucagcucucucucucucucucuuuuuuuuuuuuuugagauggaguuucgcucuuguugcccagacuggagugcaguggugugaucuuggcucacugcaaccuccaccuccuggguucaacugauucuccugccucagccucccgaguagcugggauugcuggcaugcaccaccgugccuggcuaauuuuguauuuuuaguagagacgggguuucuccauguugguuaggcugaucucgaacccccgaccucaggugauccacccgccucggccucccaaagugcugggauuacaggcaugagccacugccccugacugcucucuuuucucuuaaccucucucauauauacuuccaaucuccucaucuaucaaauaaagucauauuuuaauuuugguaaggacaacauauaguucauauuaugauuaugaaugcuauuuacaguucacuauuaauauuugguaaacuaugauuaccuuuuucuuacaacuuuuuguuuuuccuggaguuaauaacuguuuuaguuucauuuguauaguugucuguauacuuacugcauacucauacuuucuacuugcuaaccucucugccaguuguguaagucugugaagccuguuucagccugaacuggcugccuucacugccucuugcaaacccaucauccugacaccucuuugucauccugggucuuugcuucaccuuucucggcaggugcaucugcuguuucuuggagacuaggccuuuucuuucuugguucauucauucauucauucauucguccauuuauuuaauuuuuaaaauuauuuuuauuuauuauuauuauuuuuugaggcaggaucucucucuguugcccaggcuggagugcaaugacaugaucauugcucacugcagccuugacuuccugggcucaaguaaucgcuccaucucggccucccaaguagcugggacuacaggcgcaugcuaccaugcgcggguaauuucuguauuuuuuguacaggugggguuuugccauguugcccaggcuggucucaggcugauuuuuuuugaaucacuaauuaaaucucucuacuuguuaggggucacuaauucaauuucucuacuuguuaggggucuauucagauuuucuguuucuuuucaaaucaguuuugguagcuugggucucuguaggaauuuagucauuuuaucuugguuaucuaauuguuggcauauaauuguucauagaauuccccuguaauccuuuuuauuuguacaugcuuagcaguaaugccuucccuuucaagguucuuauuucauuaauuugagccuuugcucuucuggucagucuaguuaagguuugucaguuuuugccuuuucaaagaacuaacuucugguuucauugauuuuucuguuuucccuguuguauauauuuugcuuauuucacucuaaucuuuacuuuugauugguuugauguacuugucuuuuuccaguuuuuuaagauggaagguuauugauuugagaucuucuguuuuaauguagacaucuacaccuaugaauuucuaaguacugcuuuagcuguauuccauaagcuuugauauguuaauguuuucauuuaucucaaaguauuuucuaauuccuuuuuguuuucauuuuugaguuauuuguuacuuaggaguguuugauuucuacauuuguuuguuucuuauuucuuuuuguuauuaauuucugauuuuaucaaauugugguuagagaacauaauuuguaugguuucagucauuugaaaucuuuuuuuuaaauuaaaaacauuuuuuugaggcagagucucacucuuuuguccaggcuggagugcaguaguacagucuuggcucacugcaaccucugccuccuggguucaagcaauucuugugccucagucucccaaguagcugggauuacagauguauaccaccacacccggcuaauuuuuguaauuuuaguagagacgagguuuugccacauuggccaggaugaucucaaacuucugcccucguguguuccaccugccucagcguccccaagugcugagauuacaggugugguccaccgugcccggcuugaaauuuauugaggcuuauuuuuguggccuggcauguggacuccuggauaauguuccauguacacuugaaaagaaucuguaaggcaggcccaguggcucaugccuguaaucccaucccuuugggaggccgagacggaaggauugcuugagcccaggagugcaagaccagccugggcaacaugagaccccguuucuacaaaaaaauuaaaaaauuaguugggugugguagcgugugccugugguccuagcuacaugagacgcugaggcaggagaaucucuccagcuugggagguugagguugcagugagcugggaucgugccacugcacuucagcuugggugacagagagagacccugucuuaaaaaagaagaaucuguauucuaauauuguuuguuugaaugucuuauagauguuuguucuaguuggauuauagugucauugaagucuuauuuucugguugauccucuuucugguuuuuaaaauccauuaaggaauguacauauugaaguuuccaguuaauacuguugaauuaucuauuucucucuucaguugucacuuuuugcuuccuguauuuugggcucuguucuuaggugcauauauguuuauaauuguuaugauccccugagcacugacucuuuuacuauuguaaaaugucugucuuugugcacagagagaaguuuugucuuaaggucuguguuacuuguuaucacuauaaccauucuagcucucuuuuguguacuguuugcaugaaauaucuuuuuccauccuuuacuuuucaaccacuuugugacuuugaaucuuaagugucucuuagacugggugugguggcauguacccccaguuccagcuacuggggaagcugaggcaggaggaugacuuaagcucuaguucagccuuggcaaccuagugaaaccccaucuuuuauaaaaaaaauaaauacagugagucucuuguagacacuauaaaguugagucuuauuuguuuaugcagucugacuuuuuuuaacuuuccauugguuuaaucuauuuauauuuaauguaguacuggcaagguagaauuuaugucugcaggugugcuauuuauguucuauaugucaugacuuguuucuuuguuccucuguuacugcguuauuuuguguuaaauagauauuuucuaguguacuacuauaacuugcuguuuauuuuaguuuuuuggggggaauuauucgcaguugcucuggggcuugcaauuaacaucuuaacuuuaaacagucuaguuuaaauugauacuauuuaauuucaguauuaaaaacuucuacuuagcucuguuuucuucuuuuuuugcuauugucaugcaaauuacaucuuuauacauuauaagcccaccagugcauauaguucuauaauuauugcuuuaugcaguuucuuuuuaaguuauguaggacaagaaaagagcuaagaacaaaaaauacuuuuauacuauauuuuauauuuaccuauguaguuauuuuuacuuuuuuuuuuauuucuucauguggauuugagcuguuguacaguguccuuucauuucaacccaaaggacuguuguuuuucauuuaucugguaauaucuuaaguucucuuuuguuuuuggugaauaguuuuguuacauacagaauucuugguugauugucuuuuuuaauuucagaacuuugaauauauuaucuauucccacccugcuccacucuggcuuucaugguuucucaugagaaaucagauauugaccuuuuugaggaucccuugugcacaaugaguggguucuccauuguugcuuugaagauuuucucuuugucuucucuugugacaguuugguuauugugucuagauuuggaucucuuuaaguuuauccuguuuggaguagcuuguuaaauauauagauuguuuuauaucaaauuugugaaguuuuuagccauuauucuucauauaucuuuuuuugauaauuuuucaacgugguagaugccugaggcaacgauaacaacuagggcaaaguaucugacccaaaaaguccuuugaaaaguaccguaucuccuuuucuuuuuucuguuuuccugggacuucuguuaugugacuauguugguacauugguuuuguaagaugaucucuuagacucuguucauuguuuuuguuuguuucuguuacuuagguaggauaugguaucauuugacugaucuucaaauuuguugauuccuucuugucucagcucaaaucuguugaacuccuccuggugaauuuuuaauuucaguuauuguauuuuucaucuccagaauuucuguaugguucuuuuaaauauauucuuucuguuuguuguuuuucucuauuuggugagacauuguucuuacacuuuaauucuucagaaauaguuuucuuuagaucuuucgacauauuuauauuaguugacuugaagucuucauugaguuaaggcaauguauagguguccuuaaaaauaguuuuuguugacugauuuuuauuuccuuuguaugggccauauuuucuuguuucuuugucucaucauuuguuguugaaacuggacacuugaaauaauauauuguggcaacucaggaaaucauauucuuuccccuccccagauuuuuuguuguugcuuuuuauuguuuuuguugcuuauuuuguucuagugacuuuccugaaagaauuccuuaaagucuuuguucuuuguuauauguugccacugaauucucugguugguuagcuuagcggugagcuaaugauugaacagagauuuccuuaaacauguugaaccaguaagucucccagccucuacugacuggcucuguguuuugggggcaugcuuucagugcucugaaagguguuuugcaccucugucuuccuuuuuacuuccugcuuguucagagugucaaagucagccaguggggacauuagaggcuucaggggucuuuccugggccugugcaugugcacagccuugcacauauacgugaccucccagguucccaggaguaugucaguguuuucaaaguuugcuguggacaucucaauuucuaccccuccuuccccccaccuuuuuuuuuuccuauuuuuggucagcuucuuugccccaguuguuauuucugucuuggguauccgccauguugaacaguugucacugguuaguuuugaucaucgccucagggaaaaggccucuaacauugaacaagcucuaagucaggucagauaaagacaagcccugcaacugggcuugcagggaugugccagauagguggaaugauaguucuuugggaauggggacuuuuagggagcuccagacuugggaacuucagcucuuucuaguggcugccaggcugcugguuuucacacuugccaugaugauaaguugauuuggacgguuuuugccaauguuuucuuugcuucuuugaagcagauuuucaaggguccuuauucugccauuuuaaagugcuacucuccuguuuuaugaucacaauauuuucucuuaucucuuuggaagcacuaaugacauuuuuaaaaaaacuuuuucuuucucuuuaaaaucucuucuguccuccaaguuuggauuuuuaaguauguguuuauguugauuucucuuuuucaugcuagaagcucugaguauauggaugcagcuuauugacugagauugccgugauuaaguauuugcuuccaggaaauuauuuaaaauuuauauauaaaauuuucuaggaaggaacuaauuugaacuaaaucuuauaguaaaauaaauucuaauuggauugaagaguuuaauauggaaauuuaaauucagaaaaaauagaggaagauggugguugucaaaccaguaaagaaauuuauuuuaaauggaaauccagagauuuaaaauaaaacaauuuaguggccucagaggguaaucauuaguuauguauucaaugucuuugaauauauaaaacucauccuuuuagauuugugugaaucaguaggucccaagagagacauuuuauauuuuugugcucagagcuagcaaacaaaaaccaguccuuucauuccuaaggaugcuuuguugguguuagacugucucuuuaggugguaaccuugauaggagcuguuguagcagcauuaaugagcagagaaugagggagcuagugaggcaggagaguaaaagcggagggaauucugaauuaagguggacauacuaguaauaguuauguuuauaguguucucauaccuaguuguucaggcuugccaggucguggguaaugugaccacagugagaaugccucaccacugagaaagaaucugcagacucguacacaauuaccauuuagaauggugaauacucucccaggaaugaaagaaauacuugccuucuuccaguaauuucaggaacagccagacuagagguauaccuuggcucuaacuugcagacuugcagacaugcucacaucagagggugugguugugacacaaucaaguagugccuuagugagggcaugcccuggcaaccggugucaugauauuauuuaugaguuugucaagccauuggagaucuuuguuacuuuuaaaaagggaagauaauggaaacaucauaagaaacacaaucauguaaggcaucuuuccaguucuuuaguaacugcuggauuugaaagugaguuauaguuuuauucauaucugguccugagguggcaauuggaguuuuauucagugccagcuuuaacgaauggguaguggcugccuggaauaguuuugagaaggauucugagggaacaucugggcuugguggaaagauggcuugaaaagauuguuggugucuccuauggaauggggggaggcagugcaucaggcugguucaucccccucauuugcugauguguaauuuuguccucucuguuacuuagagcauaagcuccagaggguaagaacucacuagcucgguguugggcacauaaugggcacucaaguauuuuugagugaaugaacaaaugaaugaacuaacaccagagcuugugugaauaccuacaguuuuccagagugaggaguuagguuccagcugucuaacauagugauguaacucuccugagugagugucugcauggcauacauaguguuugguacaaauaccaaaagaauguagcucacaucucuaccccuaaggagcuuccauucgcuugagaagaaaaggcaaacauauuugaaaugaugagagcuggcaggauaggaugguguguuaaaaagcacuuaaaaugucccuaaaauugaaugcacagauacauugcuuuggaaucucaacacuuacuccaguauaccugugagaaagccucuuuuuucuuucuuuuuuuuuuuuugagacggaguuucgcucuuguugcccaggcuggagugcaguggcacggucucggcucauugcagccucugucucccggguucaagcaauucuccugccucagccucccuagcagcugggauuacaggcacccaccaccacacccagcuaauuuuuuguauuuuuaguagagaugggauuucacuauguuggccaggcuggucucaaacuccugaccucaggcgauccaccugcuucagccucccaaagugcugggauuacaguaaugagccaccaugcccggcucaagaaagccucuuuuuucuuaacuuuuucuacuaauuaugauugcauucucccaccuuuuccuuucauuuuuggugucacuaggauggaauauuuagacugguuaaggaauuuugcuuuaauuuaaaugccaaggugaaaugauccauuaauagaaaauaaauguaauacagauuuuuuuuuaagcugaagauuauccagucacagcauuuguuucuagagaaaucauuuauagcauuuuuggauuaagcaugaaucacagcaauaagcacaagccuuuguaacguacuauuagugcauuuugaaaagcuccaucccaaguuauugauagucugcgcuaagaaagaaagaggagaaacacacacuucucauaagauacacauuuuguguagaguagucaguaaugucagagagcaggggcucuggauuacuacucucagggcuagaaucuccaccccacaccugugucaccucaaggagauuaaaugagaucuuucagauagacuucuaggcccauucuuuacccauaguaagugcucaguuauuguuggcuauuguuaauguuauugauugagucacuguuuuguuacuaggugggucuguaccauuguuuuuuuugauggggaguggggaucaacuucacauuagcauuuuaauauaauuggcuaugagcagugaugguuaauaguuuguuuacauuuuucuuucauacagguugaauguaauuuuuacaaaauuugaugaaguccagaaaucuggaaacaugauacaaucugcaaauggugaguagaaaaagcaaucccuacuuuugcuuuuucaguuuuacauucgcaucauuuauguuauaugugaagagcugaauuagguaauuuaguaagaguuucuaagucuuaaaacuuaaccuccauucacccaguuuuccaggccagaaacaaugcagugaaucaucacugacuuucuuucauaaccuguauugaauuuauuagcgaauccuguuggcuuuacuuuuaaaacugcguccugaaucccaggaacucucaucaucacugcugcugucuuccuagcacaagcugucaugguauuuuaccugggcucuuguguuucccuccuaaacaguaucuuuucuucuacuguuuccccaugccuaaagucuguuuuucauauagcaaccagaguaauccuuucagaauacaagucgggugguguuaaucuucuuccuaauccuccaaagacuucccaucacacccaggcuacaauucaccaacucaccauggcccacugggccuugcgugaucuggcacccaccgccauucugaugucauuugaaucguucuuugugaaauuucucuuugcucuagccacguuugaccuccuugcuaauuuugaacauucugagcaucuccugcuucaggaccucugugcuuguaauuccuucugccugaaguauuugcccuguggguaucauuauggccucaucccuccucccucauacaguaucucacuucauacaguaucacugcauuacugaggccaccagaauagcauguccaggguucugagggaacgcucugugcccucacccuguuugaguuuucuuugcauguaucacuagaaaaauauguguuuacucaugagagcaggaccuuuacuuuauucccuuuauuguucuuuauuuuuuuucucaaugagcauaaauucaacgccuugaagagucccuggcuugugauaggugugcaguaaguauuguugaauaaauaaaguaaugauuuugaugucaauuguagucuauuguugccaguuccuguauuccuuucacuauacuuugugaugauauuugagaacuaguggguaauucuugugauuccagaaggagaggaaaagacaggagugaauuacuccuguaugaaggaaaaaauaucaaaaaguuaauugcugagaaaaacuuuuucuaacucuggauaccucauuguaucauagcuaagcuauuuuagaauuuuuagguaucuuagauuacaaccaguacugaauucauuaauccuguuggauuaacuuuuaaaacugcaccccgaaucccaguaauucuccucaucauuacuacugucuuccuaguacaagccuucacauuuugaauaucuugagauuguaaagagaagucugagcgcuuuuccucaaaguaacuugauacauaagggcagagcagguaauagcaugcaagucuuuugacucacacucugcuguguaccuauuauuauuccaaaggaauuuuucuuugaacagcauguuuccuauauaaaauaccuaaagugaucuaaaaaugcuuucauuaauccuccuuauuucuuuuucauagauuguaagaaauaauagaaaauugauaucauaauucagcuauuaccaucaaaaaucauuuucgcuauauuuucuuaguucauuuuccuguaacuguauaauuuguauauaauuuuaacuaugguguaauuuucucuccuuuacccuguacuuuagcuuacauacuuucagcuuuuaaaaacauaucauugguagagcuggggccagaauucuggcaucugaguggugcacucgugaugagugggguugcuggguguccacaggcaggucuucacaggcaguuaguugcuggacauguggcuuuuacuuuuguguggguguauuugugucauuugugugguuucucaguuuaaaaauuguuggcacuaggacagaacaugcugugcaaguaaguaaaagcaguggcaggaaauugaguuugugcuucauaagccaguaugacagcuaugaaacagaaucucauuauagugcuggcauuggggagaaagacugcauccacacuggagaucuugccuaaaagaguguguacauauacccuaugggauccagugaugugacaaauaggauuucacccucaggaaugccaaaacuguguggcauuggauauaucacaagcagcauuuuauucuaaguggcuagguauaaauauugcccccaaauucccuuuaugugugugugcacgugcacacacauagguuuaggguugaggauggaaacaguucuuuuaaacaucuaugcuaaaaauagcaaaugguaaggaagccuuaacaaaauuucuuggaggccgauaauuucagcuuuuugcuuuguauguguaguauuacuguuuuaauuguuagagccaaaauguugaaggaaacugaguacuauauagccauauguauaaaauuuuagaauuucuaaccuaaaugauuuucaucucuuuacaguaaauuugagagaccaguaaaauguucaauugcugucaaaaaacaaaccaccugauuuccuucauugaacauuuagauggcauagagaaacugcaguagugauggaauaaaaccugucucccucuuuaucuaauuuucucuuucuuuucuuuucuuucuuucaccuuuucuccuccuccucuuuuucucuuuucuucuuccuuccuucccuccuucccuccuuccuucccucuuuucuuuucucuuuucuuuuuuuucuuucuuucuuucuuuucuuucuuucuuucuuucuuucuuucuuucuuucuuucuuucuuucuuucuuuuucuuucuuuccuucuuucucuuccucucucucuuucugucucucccucuuucucucucucccccaccuccuccuccuucguguuuuuuuaaaacacaacucccaguguaauucuuugaucucuuuugaacuucaaaccuuugacuguucaguuuucucuagauccauucauccucugcuuucuccauuucauaccuuauacagcuuagauuacaaccuuucugaacuuauuaguuguaggaguuuuuguagccucugugggguuuucuacauauacagucuugucaucugcaaauaggaacaguuuuaucucuuucagauacguaugcuuuuaauuucuuuuucuugccuuauugcacuggcuagaacuuccaguacuguguaagauaagaguggugagacaggacauccucgucugguuccuauccuaggugcuaaguaugguauuagccguaggauuuuuguagauguucuuuaucaaaaugagguaguuuucuauuuacuucuguuuaucuuaucuuuuuuuuuuuucccagagcaggaauagaaguuuauuuaaaaaggccuuagaauagaaaagaaaggaaggugugcuugggagagacccaggugggcacaugaagguuaaagaaagaaagucaaaugcccuuaucugaguuuuuaucagaaauagguguuaggccuuuugugaaguuaucaguauauuuuaaaaauugagauacauucuccuucuaguugccguucauuuaaaaauuaaaaauugagauuauauauaauuuaccuacugguguuucacuuuuuaaagugaaugcuuuaguguuuuuuuuuuuuugaauauucacaaagugugcaacuauuaccacuauuuaaaucuaaaauacuucaucacccucacgucccauucccauuagcacuuacucccuauuccccucuccccccaguuucuggcguccuauuuucugucuuuauggauuugccuauucaggacauuuuguauaauuggaaucauacaauauuuggcuuuugugucuggugucuuucacuuagcauaauguuuucaagguucauccauaauguagcauguaucagaaguucauuucuuuuuauggcugaacaagauuccauugugugauuagauugcauuuucuuuauccgucuguugauggacguuugggguuguuccacuuuuuggccauugugaagaaugauucuuugaacauugauguaaaagauuucauguggauauguauuuucauuucuguuggcuguauaccuugcaguagaauugcuggguuguaccuuuaacuuucugaguaacugcucaaacacaguaaacacacaguuuuccaguuuugcagcacuauuuuauguucuuaccagcaaccuguaagaguuuccacuuucuccacauccucgccaacaauugucauugucuaucuuuuucauuauagucaccauaguggcuguaaagugguaucucauugugguauugauuugcuuuaccuugaugaguaaugguauugaacaucuuuuucaugugcuuauuagcccuuuaaauaccuugcuuggagaaaugucuauucaaauaaaucuuuugcccauuuucuaaaggaguuaauugccuauuuauuguugaguuuuaagaggucuuuagaugugcuacauaccagacucuuaccagaugugauuuauuugcaaauauuuucucccauucuauggguuuucuuuucacuuucuugauagugucacuugagauauaaauuguuaaauuuugaugaaguccaauuuaucuguuuauuuuuucuuuugucauaccuaagaaacuauugccuauauuuggccaggugcaguggcucacaccuguaaucucagcacuuugcgagaccgagacaggcagauuaucugagguuaggaguuugaggccagccuggccaauauggugaaacuccaucucuacaaaaauacaaaaauuagccaggugugguggggcaccccuguagucccagcuggggggguggugggguggcccugaggugggaggaucgcuugaacuugggaggcggagguuucagugagcugagauuguaccacugcgcuccagccuggucgugagacuccgucucagaaaaaaaaaaaaaaaaaagaaacuauuaccuauuuuaccacaguaaaaagaaagaaaagaggccaggcauggugguucaugccuguaauccuagcacuuugggaggccgaggcaggcagauugccugagcucaggaguuccagaccagccugggcaacacggugaaaccccgucucugcuaaaauacaaaaaauuagcugggcguggcggugugcgccuguaaucccagcacuuugggaggccaaggcgggcggaucacgaggucaggagauugagaccauccuggcuaacauggugaagccccaucucuacuaaaaauacaaaaaauuagcugggcccgggcgugguggugggcgccuguaguccuagcuauucgggaggcuggggcaggagaaucgcuugaaccugggagguggagguugccuugagcagacauugugucacugcacuccagccugggugacagagcaagacuccaucuaaaaaaagaaagaaagaaagaaagaaaagcugggucugaccuccuccuaguuucuuccugcuuuuugggcugcaccuucuuggcuuccuuuaucuaaugucuacuaauuagccauuaaauucuuaaagcuuaauucuaggccuuuuccuuucucaggcagugcuuuuucccugguuacacauauccguggcuauaauuuuauuuauuagcuauaucacauuuuuuucauaaauguuugucuccuauacagaucuugguacaggauuggaacuguaugugaaacagcuaccugucugacauuuccucuuguauuugaaacauguaucuaaaaccaaauuuauauucuacuucuggcugaaagacaaaacacaaaacaauaaauauugcuccacccuaaguguuuucuguacuccuuauaagcgugauugcuccauuauucauccugguauguaaauuaaagauugggugucauuuuugauaccucccucucccucacuuuucauaaauauuaucacugauucauauggaguuuaacucaaauauugcuuuuuuauugagguaaaaucuacauauauaauuaacgaucuuuaccaauuuuaaguguacaguucagugguaauaaauacacuuauauacauuuuuuucacuuuacucuucccccuccccuuccuggccuuugguaacuaccagucuaaucucuaccuuugugagaucuacccuuuuagcucccacauaugagugagaaugugugauguuugucuuucugugcuuggcuuauuuuauauaauaugauggccucuaguuccauccauguugcuacaaauaacaggauuucauucuuuuuuauggcugaauuauauaccauuguguauauauacacauuuuucuuauuccauucaucuguuggcaucccaaaugaugucagaucccucuguuaagugugggcaggcacccucuaccccacugcuugguaugcgucauguuugcagguuuacauuuggcgauuaucugacuaauaccuaucucggcauuggacuguaacccuccugcauacaggggacugugugccuguuuuugcucauucuaaggcucagauaccuugcaggcuggccucuuagucccaguguucucugcgauugguuuguuucaccgaaccagcuuuucuucuaugucucucaguaaaucuugagugcauguacgaacacuuaguaucugagaugacuagauucuuuuucucucugcuuuuucccauggauucuuauauacccacuggguucuggaguguugcauaugagcuggagcugacagagaacugagcaaaacacaggagagaaugaaugacaacauggggcucauuuccaggcuccucaaugaccucuugggcagagguucugaucacuugauggcugccuugguugguuagcacugcauguccacagagcggcuuccuaggcugacucaaaagggugucuauuaaaugaucugugucuuucuaacucccauuugugaaaauuuagcagccuauacucagcuaaggacuaggcaacaaauaucuguuuaauaaauggugacuguguaugccaaacaguaguuacaguuguuaauuuuggagugugggugcccacaugccccuguguggggaaguguggacagugucagggagcaagucaagggggauugcuuuggaaauguguggcucuccuuccuccuuaggaaaggcgucugugcccugcucugcaaugcuuuagcuaugggauuuugggcaagugacuuaacucuugugaaccacauuugcucaucuguaaaauggagugaacaccuugcagggauuuuguggagaauaaaugagauuguguguaaaauucuuagcgaauuucuuagugccugggacaugguuggugcucagaauaauagauucuccuccaguugcucaauuuuagggguauauucauuuuuucaauaaaaagaauauuugagaauaacugucauacuuguagauuuucagauuauuuuggaguaugcauuuaaaauuuaauguauuauuuauuuacuuuuuaaauuuuuuauucguuuuuuugagauggaguuuugcucuuguugcccaggcuggagugcaauggcaugaucucggcucaccgcaaccuccgccucccugguucgagcgcuucuccugccucagccucccaaguagcugggauuacaggcgcucaccaccaugcccagcgaauuuuuguauuuuuaguagagacgggguuucaccauguuggucaggcuggucucgaaaucuugacuucaggcaaucugcccgccucagccucccaaagcgcugguauuacaggcgugagccaccgcgcccagccauuguauucuuuaaagugacaauacucuuuaaauauuuuuauuuauuuauguuuuagagacggaguccagcucugucgcccaggcuggagggcaguggugccaucucggcucacugcaaucucugccuccuggguucaugccauucagcugccucagccuccugaguagcugagaguacaggcaccugccaccacgcccagcuaauuuguuuguauuuuuaguagagauggaguuucacuguguuagccaggauggucucuaucuccugaccuugugauccgcccgccucggccucccaaaguguugggauuacagacgugagccuccgugcccggccuauuuauuuauuuauuuuuuagauggagucuugcucugucacccaggcuggagugcaguggugcgaucuuggcucgcuguuaccuccgccucccagguucaagugauucuucugccucagucucccgaguagcugagacuacaggcgcccaccaccaugccuugguaauuuuuuguauuuuuaguagagacgagguuucaccauauuagccaggauggucucaaucuccugaccucaggugauucgcucaccucggccucccaaagugcugggauuacaggcaugagccaacgugguuggcccaauauuuuuaauuuuuauggacauaucaguuguauauauuuaugggugacauagguauuuugcauaacagucacaucaagguaaguaggguauccaucaacucaagcauuuaucauuucuuguguugcaaacauuccaguuauacucuuucaguuauuuuuaaauguacaauaaauauugacuguaguuauccuguugugcuaucaaauacuagaucuuauucugucuaacuauauuuuuguacccuuuaaccauccccacucccuuccccaccaccacuauucuucccaggcucugcugguaacugguauucuacucccuaucuccauaaguucaguuguuuuaauuuuuagcucccacaaaugagugagaacauaugaaguuugucuuucuaugccuagcuucucuuaacauaauuuccuccaguuccauccauguuguugcaaaugacaggaucucauucuuuuuauggcugaauaguacugcauuguguauaggcaucgcauuuucuuuauuccuucuccuguugauggacacuuagguugcuuuaaaaucuuggcuauugugaacagugcugcaguaaacauggcagugcagguaucucuucaauauacugauuuccuuucuuuuggguacauaccuagcagugggauugcuggaucguaugguaguucuaguuuuaguguuuugaggaaccucucuauuguuuucuguaguggcuguacuaauuuaacauuucuaccaacaguguacaagaguucccuuuucuccacauccuugccagaauuuguuacugccugucuuuuggauuaaagccauuucaacuggggugagaugauaccucauuguaguuuugauuugcauuucucugauaaucaaugauguugagcacuuuuuuaauaugccuguuugccauuugugugucuucuuucgaaaaaugucuauucagaucuuuugcuuacuuuuaaauugaauuauuugauuuuuuuuuucuauugaguuguuugagcuccucauauauucugguuauuaaucccuugucagauggguaguuugcaaauauuuucuugcauuuuguggguugucuuacacuuuguugauuguuugcuuugguugcccauacuugugggguguuacugaaaaaaucuuugcccagaccaauguccuggagaguuucccccauguuuucuuuuaguaguuuuauaguuugaggucuuagguuuaacucuuuaauucauuuugauuugauuuuuguggugagagauauggggguccaguuuuauucuucugcauauggauauucaguuuuuccagcaccauuuauugaagagacuguccuuuccccaguguguguucuuuucggcacuguugucaaaaaugaguucacuguagauguguggauuuauuucugggaucucuauucuguuccauuggucugugugucuguuuuuuuuccaguaccaugcugccacaaaaacagcaaugguaguaguauaauuugaagucagauaaugugauucuucuaguuuuguucuuuuugcuuaggaugacuuuggcuauucugagucuuuugugguuccguauaaauuuugggauuacuuuuuuauuucuguaaagaaugucauuggcauuugauagggauuauguuggaucuauagauugcuuugaguaguauggacaguaaugcucuuuuaaaauugcuuuguuaaaauauaauuuacauaccaugacagcauucauuucaaguguauaauucaguuauuuuuaguauagucacagauagcugcaacugugcaucuauugauggacaguuggauuguuucuaccuuugucuauugugaauagugcugcuuugaacauuuguauacaagcuuuuaaacaccuguuuucaguucuuuugaguguauauccaggaguagaauugcuguauuacauggucauucuauguuuaacuuacugaggaaccacuaaacuguuuuccacaguggcugcaccauuuuauauucucucuagccuuuaccaaauucuccacuuucuggcaaugcuuguuuuuuuuuuuuuuuauuuuuuuuaauuguagucacccuaguaauuaugaaguagugucucauugugguuuugauuugcauuucccuaaugacuaauauguuugaacauauuuccugugcuuacuggccauuuguugaucuacguuggaaaaacaucuaaucaaauccuuuguccacuuaaaaaucgaauuguuuaucuuuuuguuguugaacuguauaugauuugcagauacgauuuguaaauuuuuuuuucauucuguggcuuaucuuuucacuuuuuuuuuuuuuuuuuuuuuuuuuggagagggagucucgcucugucgcccaggcuggaguacacuggugcgaccucggcucacugcaagcuccgccucccggguucucaccauucuacugccucagccucccggguagcugggacuacaggugcccgccaccacgcccggcuaauuuuuuguauuuuuaguagagaugggauuucaccguauuauccaggaugguuucgaucuccugaccucgugaucuacccgccucggccucccaaagugcugggauuacaggcgugagccaaucuuuucacuuuuaagugucuuuugguguauaaagguuuuaaauuuugcugaaguccaauuuauuuuuuucuuuuguugcuugugaacaacagugcacuuuugaguaagaaacguucuggauuuuagcuaaguuggaagaaacguauuuaauggugguacuccuaagaaauaauaaggauuuaucaaggguuuguauaucuucagauguucaaaauuauguuguucucugaugcuuaauauuuauaugaaacccauggacuuaauuuuuaaaagcguaaucgaauugugacuaaaacaggaaugaaaaagcagccaaguagcaauuugaaaugggcuuccugucuguaauagaauacuucaucuuuguaugauuccuucuuguugcuagguuacccgaaggccuuucggcuuugaauggugagaauaugagaguuaaaaauauguugcuauauagauguuucuucuuuuuuucaucuccauauaauuagcaagccccuugaagcaaaaauuacaguuuuuccuuccaugaguuucaaaaagcaaauuauuuguaaguuuuuaaaucaugcagaugugcuuaugcucaugggagaauuggauuuucagaaugaaagacccaguaauuauggacuacucaguguccuuuaucugcaaccacuuaaugaucuuuaauuggauuugauugaagcgaggcccaugaacauuaauuugguuaaaaaauacacaugcuuuugaguuucuugagcaaagcuaacauguuuaugaggaaagauacaaacuaucaucuugguuaaauccaugauaauucuauaauaaauuuguagcugaaguaaaagacccaauauuuauuugcuaauaaaacuauaaaguagauaacaaguaaucauaacauuauuggcucuuauacaugaauguacaggguaucauuuuguugccaaaugcauuuugcuuuaugguuuuacacuuaaacaacuauaacuugaaaaauauuacagguaucaguucuacuuugucggaaaugagaaauaccugugcaagucugaaaacagaccauugacagauucuguuagauaagaucugaauuauugcccaguguggcuaggacaaagcauucauuuaaaggcaaaucaguugucuuuucuuuauuaagaagccaagucauuauuauccaugcuuauccuuuaaaagcaaugauugugaauaaguggaucaggugccaauucuagguucacacucucucccagugcuuguuuauuagacuaugcauauuacaagguuugggauagugguucaguaucuuaggaaaguguuuccauagucacgaauacaaggauaauguguuuguuacaaggcuggcauauguguugagcugugcuaagaagcccaccuaaaauagccuggaagagacugcuucugauggcagcauaagucgcauaagcugcagcagacagcuuauuuuauuuucuguguggaaauaagguugcuuuuugauauuuuucuuuuuaagauuuguguuaggaauauucuuuuucuugagggggaagaacugguuuaaaaauuuuuaauaccacuuuuaaagaagacucucuuaaaugaguagaguuggauggagaaggcucacaccuccccccagccaccaacccccaacccuuuuuacaaaaucauuguuagucuaggcuuuuauuuuggaauaggguggcaguugucauuggugcugccggaucacacugaacaaguguggguggagaguuugcugaugcuuaaguugcugugaguagguauagcuuucagagcaguguuuuuauuugguaccaggauuacugacaaucaugacuacugggaaagguaggcuauucuaauauauucugaaaaguguuuauaauuauugcugcuuggcuaggaaaugcuuaaauauuuuauaauuccugugguaacuaaaaaucauggaugaaacaugggaaagauuguuaugaauguuguugguauuuaagcagugaaaaauugugaaaccuacagggaaauaaacaucaauguuaaccuucuaagacuaggagagaggaaguaggcacaguaggcugaggcuagcuguguuuuuaucuucuguuuauuucaugggcuuuuaauuuuucucugcuuauguucacaguaugaggguuaugaacauaaaucuauuugcaauugcaagguauuuguuaauaacgcuaaguggucuugaaaauaaucuacuggcuagaaauuucuaaguuuucccaguagguauagaggaaaagcauaaaugauagcagugcaaggaugcugcuucugucuuaagucauuguuuauuuuuuuccccuuuaaaagauuugcauuuuuaaaaugcaaaaauguacaggaaaacuacaaaagaaguauugcucacaaaaaaucuucuugauuagguuucagucuuuccacagagcuuuuucucagguuuggccaauaucgaagugauuuuaaaagauucuguguaaacaggguuugcauuuaaagguauaggguacaguugaugugaugggaacaaccuguaucacugucuugcuuuccuagugguuuugcuggcagacucuuaauuuguugucuucaaaggguauuuccagacucuucuacugaaacagguauugcacagaguaaaauugcauacaguaacaaguguuuauuugucuccugcuguggggaauugggcacacauccaggacuucugcucaguguuuauuuuguaauggauuauuaaagguuuguauagcuauuuucuuaaauuugguuaaguugggcugaaaguacuggaagaugccacauuucugcucauauuuuuaaauugagaauuuaaaguauauuuguauucuuuaauugagaauuuaagguauacagugauaauauuuuuauuucauaccuaaguaucauauucuauuuucagguuaaacugcugcaggaaaucaauaccugggcaggagaguuaaauaauucauguucugaaguaaccucucucagagccuuuccuuugaggauuugaaagugugucacuuacaaguagcauuugacuuaaguugugauauuuucauuuguauuuagcaacaggucaaaauaauaugagagucagcuuuuucauguuaaaagccauggagauagccuccugaaucugaguuuaaaauaaagacgauucuuucacuugauauauuuuuucaaauugccugccuccuuagucacuaucaccuggaauucaggcuuacaugcuuugguaacuuuuacccucaguaacugcagucgugauaggaaacaaggauuaaaauacuguuucuuauggaagugguaugucugaaucauguauuaauucaugaccauuaaaaaucugcaaaauauaacagcagcaggucucccaagguguguagaguacuuuaguguuuucagagcacuuuccugcguuuuuuguuuuaugaaguucacagcagccccaugaggaguagguagggcagcuuuugaacacagauacugaagguuuuggguuuucuauaauuggguuaguugcaggacaggggagagcccuaguuuuugcugucuuagacaagucuuuauuccagaaagccauuuugucaggccaagugcucuggaaucccucagacuggguaugagugccaccucugcaugggcaguuugugaccugggacuggcagcauggcuguccaccuucauuuucucaugugcaaauuggggaugauagucccuuugcugaggagccagugagggggccuugggccuggcacaucaaucucauccuauugauacagggacacauccacuguggcagcucuaggugaucucauaacaggagguaugaagguugaacugagguuuaaaauaauauaguugaucuuuuuguguagauauggaaagguauucuaagaaaacaagaugcagaauuaaauguauccuaagaucuuguaaaaagaaaccauccaguacccagaucuuggucacuaacacuaccagggcuccuuggggaaauggcugaguuuagggcuggagcaaggugagccaguguaucucgcagggccagaaaguaaggaagugguugaaaaaaucaaagaaaaagcaaaacaaaacaacaguggggguauugcugagagacacaggagucaacugaaagugcuuccaauagccaaagcuagaaugcuuuaagcaacacagugaaguauuguugaguuuuaacccaaaguauaaaauaaauguuaaugauccauacgauguaaacaaaaugauugaaaaguguguaaauggagaugaagagacgaaccucuugugcagaauuauuccaaaucauuuaugcaaauaucccauucuaaaggaggggagcauaacuuccuagucggucagugugguggguguucuugauaggaugugaugagaauggcauuuuaccucuguggucuuccucccaaagccccauaagcucuguggaaacauggcagaagccucaggcaaacccaaaaugaaagauauucuguaaacucccuaaccaugucaaggucauugaaaacaaagucugagaaacugucacaaccuagaagagccuagggaggcaggauaacuaaauguaaugugguguccugaaugggauccuggagcagauaaaggacauuagggaaaaacuaaggaaugcugaauacgcuggggacaauaguuaaagguaacaguugaucugcguguuggguuaugugcuuuaagaaaaucuuuuucacuguuucauguauuuaaaacaggucauuaaaaaaaacaaaacauacaaagauuaaagacauggacaccaguaaggauacuauuugguaauacagaucuaccugagagaugaggaagacccgaauuagguuggccucagugggacugagagggaauggaagugagaggugguucuaagcagcacugaccacacccagugcuuauuuagggcaguggguggggaaagaccuggugggagauaggaggggaagaguuaagagcaauuccauauuuuggccuggacaaauggugguaggaccaacugaagucaggaaccuggaggggagagcagguuuugaggguaagaugauuauaggugauuauaguuuuggacacuuggacauagaauuuuguuuguacgugaguuugauucagguagguuuguaucuuggaguagacuugagauugcuauuagaggauuaaguauuauuggaacauggcuauuuauguuaaauugucaucuucuuucucuuugucuucguauguagcgguaugguauuugccucucuagcuaaagaggguucuggagaaagagaucauuaaagcagagauggaagauuugaaggauuauuugcacaaauggcaaauagcucuuaguguaauuacuuuaaaguaugagagaacauucugguaggaaaccuuuuccaaauuuggcucuaaguuuuuccaacugacuuacuuuugugccuauguagugauugucaaaaagaauugggucaggauugcuacagugauaauuaaaaugacauuuccaaaagagcacaggguguagaucugauaucugugggauuuggguucugacauuuauaacuuucagggcaaguuggaagguaaaauaaguacugugaucaaagggagaaaugaacauuuaaucaaugaaaggauauauggugacucuuauguaauaugacacucagagauuaucuaagguguugaaauuuuaguuguugacuucuggaagucucaguuuucagucaucaguuugcaaacuuuauucacaucccuuaguguugcuuaaaacuuuccccuuugccaugaaauaauaaaaauguaagucagaauaugcccacuuaaggccugcauuguaccuuuucaguuccuuuuugagggauaaaugaugauuucaauguccuacuauucucuaaccuauuaccaggaagaagcuugugguugucauuauuacuauaauuauagucacccagucucguucauuacugccuuugugucuuugccauuccuaccuugcccguuucuugccccagggagcuugcacacauuauucucacuuagaaugcacuucacuuuccucaugccugccugguuuucaggucugggugcagaggcuuccucagaaaugccuugccuggacuucuguggccucuaggaauucgcuuuccuaaggcuccuuaugcuggcuuaugaucagcuuugugagaauaaagaugggagcugcuguguucaccucugaauuacgagcagccugcccagugccaggcacaggacgggcauuuacaaacauccuuggcauacacaaaggguaugugagcuggugugguggaccaugccuguaguagcugggauuacaggcgccccccaccaugcccuaauucuuuuuuuucuuuuuuuccagcagugacaggguuuuacuguguuggccaggcaggucucaaacuccugaccucaagugauccgcccgccuugaccucccaaagugcugagauuacaggcgugagccaccguacccagcucaugggucuuuaaaauacaaaauuugaaggaaaaacacacacacacaauuggaaggcccucuuuucuaucuuaaaacaauuuuuggagucuuuaguguacuuggauuucuuuauacagaaaugaaaaugguguuugagcuuggcuuacuauauucaguuaucugcaguuaggccaggcugugauaaccugugugcauaugcugguggccaugaggguagacccacaggguaaacccuuuccaaagagaaagaguacacuuuuuguagggccccuuuuccugccaaaacaguuagccuugcccugcugcuuagucaaaggcauucuuuugcuucauuguucaaggcaaauuggaaccuuccuucuaccuuucucugccuccuacucuuaaauuccauguccaugacagagaugccugaguaauccucucccauguagaugagguuaugccuuugguaaaaggccuacagcauagugugauuuggccuucucugaaccaccauguccaaaaugucucucaccacccucugccuuuccccucacuuuguuacagaacacuguucuuuuucuucuuugccuuuaucacagauuugucuuuacaaaugucauaccccuuuguacuggaaagucucuuugggcaguuagcaugaauguuuuauucauacuguauucccaggaacuaguaaagugccugaaauguaguagauccucauccucaaugaauaaacaaaagagggagauaguuauccaagucagguggcaacuagccugcuccuccuguaaacuaucuuggcuguuauuucuugaaguaaauuaaugcuuuacuuaugaacucagagcuuaagaaagagaaucuguucucucucauucucccuuuguuccuuucuuguccccuuuucucccaccucuuccccaccauguucucuuguaucuuuccauuguuuccucccacugccaucaagaaguccauagucaacuggaagauaauccuggccuccauauuugugagcuggauggaagcccugugauggggcccaagacccuggcccugcacuauuugugcucagaaguucccugcauggugguguuugugcccagcaaggcugacuuuuuggcaugcaggacaaaggggaccaugggauguuuguuggugcuuauaaauugggugugaaauuucucacacaaugguugucuuuggcauaaauugggcaaugugauuauuaugugggcaguuggcuugggagcuggggaacacagagggaagcugaagguaguggugagcaggcuucaguggugggccgagaugauggagaugugguguguggcacacucacuugaccuauuugggcuagaaaaugagcauaugaucaaagugugaggacaguuaucaaauagguacuuuuaguaauauaucuauaauuuacaaaaaucucuuuaaagauauccuguaccuuacguagaauaacugcacuuaucugcacuuccuucuccuaaaauacacuugcuugaaaccucucaugauguugauuccuccuaagcuuugcuuucuuccuguuuuuagccugcaguuguguggccuguauacccggccaugcaucagaaugucuggauaauucucuagacaaauaauagcagggaagcugagugccauuugcauuuagguuuguaauacuacccaaauguaauuaaaagaauuuuagaaagcuaacuacuuugaaauuuugaaacaaguuauuuuugguuuauguuaauucuuuauaauuauguaaauacagcaaugagaacucuagauugcuauuguuuuaagcauauguaugcuguaguuauccaaagguguuauuaaaaucauugaaaaccaucaacuaaaauaugauuuuaacuuuucaaauuguaggacuggaauuauuuagauuugaaugaacauugcaccaaaaaaacagacauauuaauauuaauuggagaaaauaaacccaaauucuuguguguguguauauauguauacacacauauauauacauacauauauauacacacacauauauacauacauauauauacacacacauauauacauacauauauauacacacauauauauauacauacauauauacacacacacacacauauucauucauauucucccucuuucucucucucucucagauauuugcuaggaaaaaccuucagauuccuaaaguaagaacuuauuuuuuccuucacuacaaugguuaauucuuuucaugcuauccugaccuuuacugagcuauuguagauguuuauagucauccuguuuccacagagagaagcuugaaagcagcuagaaauucauggccagagaguacagaagacaauagugaggugauucacagacuaacuuucuaccaggcccuguguggggcggggagggggaagaggggcagauaaaguaggaugcccagauggaugaagucagucuucugcccaggagagcuuugguaucuagaagaggaagauuccuacagaugacuacuuauuucagccccucuccccucccucucuugcuccugcuggaugaacucugaguuagguggcugauggaggggacuagaggacggucccagcucugcgaaccuagcaagugggagaagcagaagcagcucucuuggagaaggcucugucuguuuucaucuuacccugagucuguccgguccuggggagaguuugaggcacuaacacacauaugucuggaaaugaugguccuuaacgacacaugaagccagguuuucagucuaagagcucuuguggauguugaggaaugguggacguuucuauggagaauugaguuccuguggauguuucagugugagugucauuccaggagaugauacugugggcucagcucaggugcucacagaguuuuauguuggggacuagcuauuccagcaggaaggauaguuuauccccaucuucccuaauucacccccuagggugcucuuugguacucuggauauuaaaguaccagucucuuuguguucccuuccuuugcuuuuuggcucuaaggguaaguuuauagucuuucugacauauguuuagagauacucuucuucaagacugaucuuagucacucuuggcgugucgcuguaaguucuuuucucugaggaaggcauaguauuaacaggguuaacuuaaacugggccuccaguuuggccaagagauucuaacuucaggaacccuaacuccuggacaugacuuggagacuuugucuuuaauucucuguucccuagugucccgaugggcacacucgcagaguaguggggcaccugggccuguccaggugcagagggaagcuggcuaguuuguucauuauccccugucaggaguuccuugccccugcuacaucuguucaggaagagucuuuggaauuuguucucucucgcuguauauucacugagcaugguagcccaggguauuccugaguuaaguaggaugugcacacauuuaaagccgcucacacucucaguuaauguuaaauggacccacguaguacgggucacauccgaggguugguuggugggcacaguggauccuuucuaaauuuguuuggcccuauuuuggauucauaggucauauugugugugugcuguuaggaaaaccucacacugaauccuacaugcuguugauuguguguguucccacguuggacugcacuccagagugagaaccaugacuucccuuucugcaucccagcucccaacaaaguacuucagacacaagcaugcuuacuagagaaaugcuggagagaagaaggaagaugcacauggucaccuauugguauucagaggcgguauccucuccaguagccuuccagugguagaggcuagggcaagacuggugcucugggaguccgguuuuauuacagaaguaacaaaaugauuaguuugagaccaaaucaccuguaaggugacccugugcucuggacuugaacuuccaaguuacagggcauggaggauuuggagagaguuuaaaacauugauuccacuugaugaaagcauauuccuaauugagcuuuuuucuuuugcuuacaaaugacaaauuauuuucuuuccugugacccugagaaaauugucauugagaccuccuaaggacgcuugacaaaggggaaauggauacuuucccuuuggaaucaguucuagagaaggugguuuuaaccuuuggaaucaguucuagagaaggugguuuaaccuccaugucucaauaauguccauacauuuuuuuuuuggcugccuaauuugaauuaguuguauggccuuuuaagcccauuuuuaaagaaaauuauguuccuaauuccucacuucuauugaaauauuuuugaagagcugguuuuuugcacgcaaagcauagcacaaauaaugaggguauaaaauagcugccauuugucccauacuuaugguuuuccugucuuuaaugcauuuugucuaaucugcauuacaucccuuugauauaguacagagaugcuuuggguugccagcaaugcaggccucauuccaagugguguaagggagaaggggagugacuuggcucauggaacugagaagucugggugugugggucuugcgguccuccuuuggacgcaugccaggcauuagacgucgguucucacugccccugacucugcuuucuuuugcuuugccucucucuuaggcaggcacugccauuuguuggcuccaacagcuccaggcuuguaccugcauagcucuaaguccacaagaagagagguucuagaauuaauuaccguaauggguugggagagcccugaugcuguggccagguuccacugaggcaaacaaaggugucaucacucugagagugggggagggugguuacccugggcugucaguagaagaaggggguugauauugggugggcagcacauuucauagguagacaggaucauccuuuuucacacagggaaacagaagccuaucucucuucauuuucuuuuuauaccucaaaugagguuggucuugcugaaagugcaggccugugacguuacagcucugccccaggacaggcucacuacccagugcgagcuguggauuucuuccugcacagaaucaucccugggcuccucuguugugaguaugccugcaucucucuggagccugguuauaaguuauguagcagcagccagggcauuuuccaccugagacccaaagaggaauugugccuugaucugcaccugcagggggcacucagcagcucuuacccagugugaacuuugagcuccuacagugccuuaaggagcaggcaucuguggaaauuggcuuucugcccuccucacaguucauuuaccucuccaguuuccgaugguguuuuccuugccugucuuuccccggugucgucccauuugaccucccuuugugaaggacuaguaaagcugaaaugaauuuugaguugucaccugucugugcucuaguucucucuucucacguuaucuguaccaguggugucauuguugagaucgucuuaaaaugccagcccagcuuuuuggcagcaagcuuuuggguggaaggaauggaacgugauugcauuccacgcucacuucugugguagaggauggauuacuggugccaaagggcagaaguagcacucugcuagcacccucagagcuucuauuaugccauuuccaccuuuguauugucaaaaaugccaacauuuccagccaagcuggaaauuuuuauauucccuguguucugacaaaagccuuccuuaauuuuguaaacagggagagggauuuuuguuucagaauauggauauuggaagauuuuuuguacagagugguagaaccggcccuaauaacacugguccauauugacuggauugggggugauacguguaccccaguucccauacuuugauggagaaggggagguaggaacuuagaagaaaaagucuuuauccagccauucaauucagacaguguguuuugcacuuuuacacuuuucuauuuauccaacuucgguuaaaauuaagaggaaacagaugggcaaggaauauaguuuggauaaugagcaaaaauuccucugauauaugaacauggaauaucuuucuacuuauuagguuugucuuuacuggaucuuaagaauguuauguaguuuccuuuuguugaaguuguuagguguuuuuauugaugcuauuguuguuuucuuaauuugauguauagaauauacgauggauuuuuaaauauugguuuuauauccuguaaccucacugaacuuguuuauugguucuaaguuuuugcaugcauucuuuaguguuuucuacauaccaaaucaagucauuuguaaauggagauaguuuuaguucuuccaauccagucugcaugcuuuuuuuuuuucuuuuucuggucggauuucccuggcuagcacgucuaccacaauguugaauagaaguagugagaguaaacaucuucccuuguucuuggucuuagggggaaagcauccggucuuucaccauguuguugaugguguguguguguguguguggggggggggugugugugugugugggguguguguguguguggugugugugugugguguguguguggggugugugguguguguguggugugugugguguguguguguggugugugugugggggguguugugugguguguguguggugugugugguguggugugugugugugguguguguguggugugguguguguguggugugguguguggugugugugugguguguggugugugguuguguguggggugugugugugguguguggugugugugggguguguguguggggugugugguguguguguggugugugugggguguguguguggugugugugugguuguguguguggggugugguuguguguguggggugugugugugguguguguggggggugugugugugugggggguguguguguguguaugugugugugugguguguguguguguuuugagacggagucuggcuccaucgccuaggcuggagugcaguggcgcaaucucagcucacugcaaccucccccuccuggcuucaggcgauccuccugccucagccuccugaguagcugggauuacaggagugugcugccacgcugggcucauuuuuguauuuuuaguagagaugagguuucaccauguuggucaggcuggucuggaacuccugaccucaggcaguccgcccgccuuggccucccaaagugcugggauuacagaugugagccacugugcccagccuguagguggucuuuaucagguugcgggaguucucuucuaaucccugcuuguaguguuuuuagcaugaaagcguuuuacuguguuuagagaauauguuguuuuuugucuuuuauuauauuaauaugacaacuaugauguauauugaacaaacauuacauuccugggauaagucgcacauggcuauaauguuaauuauuuuuauauguugcugaauuugguucgcuaguauuuuuugaggauuuuuaauguucauaagagauauugaagauacuguacuugagaaauuaucuuaaauaauuuuaaguaagcaaacauaugcaguaagaauuaaacaacacaaugugcagaacauacuuagcacagugcccagcaccuccuaagcaucagcuuaugggaauugcuuuaagaccaaagugacaauaguccuucucucagcguugucaggaggauuuaaugugacuaugcaaaaccaaacccaggaccugguacacaguugugugcugugauucuauuaguuguuacuuuucuuguuacuuuuaagcauacugacugcagugguauuaugaaggugaaaaauugaaaacaauucaauaucaauaaauagaugauugauuaaauauagucuaugcacaaagugucacaauaaguagucuuuaaaauugacuagauuaauauugaucuagaaaaauauuggcgugcaaaaaagcaguuuuuaugcauguguguauagaauucauguuuaugaaugcauuaaagucuagaaauacauauauaucaaaguguuaguuuaauuuggggagcuuauauugcuuauaguggaacuaugacuuaauuuuaaaauagguauauguuuuaucaggaaagaaggauauacauuucuuucuagcaggaaaauuuggaagcuuaaaaaguauuugagguuuuaauugucuuuguugauuugucuucaguuauuuucauagccuuguuugaauuuauuauccaauuaaaccauaugcacguuaaaaaaguaauaaaagcuucuaaaaaagauauaugagaaaagauuuucauccauucacaaauuuugccuuucuucauguggacuaccagaauuaaauuuuucugaaugucuacuggguguuggcccagacucuguucuagauguuguaaauaccaagaagaauacaaaguggucccuacuccagggacagagagaccaaacagaucugcagccagcuaauuucagggggcaaugaaguaaaugguacacgcaaguuagagccgggcaggaucucaggcuagcaguagacuuguguuuucaagaaugcauaggggugugucuggcagacaggacaagaauugcagauagcagaaacagccuuugcaaaagguuuggagcucugcaaauucaagaagaaagaaauuuugggauauuuaugaaaagcagccgccuuugggcucauuauccugucucugugcagcuuccucuugagagagcuaauuauagucuaguuaguaggcugccacauuucuuacucccuuggaggagaaucucaauuagcagggagugggugaaucugaaagccugucaggauagcagcuucuucaaagugacccugcugcagugaagcagagagauaguugucuuuucuuuagaaaaugaggcauuuucuccccauugggcuucuauccaucaaagccugccucagaagaagagaaggaaaagcuuuguaguuuagguucuggcuuuccuggcagauaggcaaugagcaguuauuucuuaguuucugugacuuuuuguuggucguuauagaugaguguuuaaauuuuccgagcgaacaguauggcccaaagcuucuaauuacaaguuccagacaccagacuugaauucauguuugucuuuagauugauaucucugccccucauagccaaacuuguagccacagugguauauuccuucugaucugucuguggcuuguugcuugguaucuccccuaugcagccugguuaaaguucaguucuggggcagcugggcucugcuggggcuuucuuagggacuucaguggaggcugcugaagggacugguucugaccuccuagugcuggcccuggcuaucccucagccucucugcagcaucuggaccucaguaguagaccuguucagcuucuggaagucugcuaguuugcuucuaaggccauggaugauuguguuuguaaucuggcuuuauuuuuacuguuuuacugcuauuuuucccuucauuaugucuacuuauuuggauugccagggguggggugauucaggguuggaugaaaauuauaguaucacucuguagaaauuucaugagucauuuuuaagugguuuauccugaugcuguagaagguggaauggagcucaggugauuuuuaaagaaucaaaggaggugaugcuugcuaggaacugaaggcuuccaucugcuuauuucagauuucuacccgagacuaucagaugagagaaguggcccucccauggcagucugcaguggggcugaagauacaauuaauuauuucugugggcuuaaagagaacuuccccuuaagacgauuuuauguguaacauauguauuaugugaaaauguuaaaauugauguaauggcacaagccugcaguuaaaaauacucauuuuuacccauuucugccuuaguuaaagcacuagaaaaagagguuagauacuaccagacguaugcuuagcagaaaagccuaaagaaaaugggaauccaaauggcuaguagaguucaguauggguuaauuuagcugagaaauacuguaacguuagaaccuggaugugagacucuucauccuggacuguaaccaugguccaguugcagauacagcuuauuugcccaguuaaagaauggcucauuccacauaguggaauuucccaguuaacugaaacuagguaccuuucugaugacccagccuccuuuuaaauugaaucuuaauuucugauaucugaaaagcuaggaaacauaggcuaaacuuauuuuuaaacaguauguuaguuaaguuuucaaauaauuggcucaguugguuuuuauccuccaaaagccuuugcagguguuucaguucaaagcauuguguccagcucuuaaucuagaaaauaaauacacuuuuuauccuuuguuuuccugaauuuccaaucgagaugggaaaugugaauuacuuccuucacuaacucacagaucauugaaaaauugaaucuuaaguuguugugcagggucauugugcuguuauuguauagaugugauuugaccccuguacugucaacuguauucuaagcauuuuggguuuagggguuuuuaugugcauguguuugcuuuucguaguuucuauuaggcuauuaggccuucagcucacuuauuaacauuacuuugcuuaauucuugcguccuccuucucacuaucccuauaguuaguugcuucuaaucugcuuaggaaaucagcuaaguaagcuuguuagauuuguuuccaaaggguaaguaaaaagacaagcagccuccuaaaguucgguuuaaaaagcccuacauuggcugcucaguaugcccuuuccuccuucucuuuuuuauuugaaacggagucucgcucugucacccacgcuggagggcagugaugcgaucuuggcucacugcaaccucugccucuuggguucacgccauucuccugccucagccucccgaguagcugcgacuacaggcacccaccaccaugcccggcuaauuuuuuguauguuuaguagagacgggguuucaccguguuagccaggauggucucuaucuccugaccucgugaucugccugccucggccgcccaaagugcugggauuacaggcgugagccaccucgccuggccuccuccuucccuucuuugggcagcauuacauacagguguuggugaugaagggcaugucuucucaguaagguuugugauacacuauugugugacaucuucaggcaauuuagacaaguuaugauuaacuuugaaaaauauaugcucuuugaggauggaaauggaaccacuuccauuuucuucaugccuucccugugccuuacuuccuguauaguuuugugugugucaucuaguacagcaacauauauccuaauuuugguuccucuggcccccagguuauuggccuauuacauaagaauauaaaaagaaugaaagcuaaauauuuuugcuuuaaacagucagucaucuuuuauagaaaugauaaugugaaagaauuaaaacaggagaauaaauaauaaaauaugaggagaaagucuuauauuuauccacauauuuacuguaucuacuguucuuuauuucuuuaucuaaauccaaguuuccaacugguaucauuuuuccuuuugccugaagaucuuccuguuacauuucuugaagugcgggucugcugaugacaauuuuuguuuguuugaguuuuuauuuugccuuuauucuuaacauguuuucacuggauauagaauucuaggguacuucuaggugaauaccauuuucaagcaucauuuccauuguguucuggcuggcaggguuucugaugaagucugcugcugcuuuuaugcuuguucuucugugugcuaugucucuuccccuggcugcucuugucuggguuuaagcaguuugauuaugaugugccuccguaugcuuuucugugugugugucuugcuuggggcaugcagcuucuuggaucuguagguuuauaguuucuaucaaauuuggaaauguuuuggccaucauuucucagucuuuuucuguccuuccccuucuuccccucguccugcaggccugcaguguuguguguguuagacugcuugauauuauccuucaugucucugagacucuauuccguuuauuuauuuuuucagccuauuuuguuucugugcuucugugcuuauuuuggauaaauucuauugcuauauguuuaaguucccugauuuuuuucuuuacuucuacaaugucuagucugcacuuaaucucaaucagugaaauuuucauuucagauauuauguuuucuuaaaaucuguaaguuccauuggauucuuuaaaaaaacuuucuuuuuucuuaugaaugucuauguauuuuaauauugaacauaguuauaauagaaguuuaauguucuuauuucaucauuucucagaaguuuacuauuuucugauuuuuuugccccuccugauuaugggccacauuuucuucccucuugucauguuuaggaaauuuuuuuuuaaggcuucucuguacauagugaaggaauuuuuuauuagauauuguguauugugaauauuaccuuguugagugucugugucuuguuauauuucuuuuaggaauaucaugcuuuguuuuggcaaaucagauaaguuacuugcggucugccuaaugcccuguaggccugcuuuuaagcucugauagggcagauuucauuuaacuugcacuccagacauacuucagucucacuaagaccugacucucugggggucuccauugaaugccuugggugggucaccaagaacauuccacuuuggcuguuuggagcuucccuacuuguguaaacucuaagaauuuuucauuucacaccuucuugguuguuuucugccuugcuuccuggaaguucacucacacacgugaggccuagaacuuagcacauuccuguagcccucuuucuguguagcuuccuguaauuucuagcacccucaacuucucugaacucuguucuuuacugucugcaguauuuaaucuguagggcuacuauguuuaauuugaguuccccuucccuguacuuggugaccuggaaauuauuaacaccuccaggcagaaaguuggggugauuguauagcuugccuuguuuguuucuuuucuugcagggagaaacaaacaaauccauaucuuuaugcaaauuagcugaacagccaaguucugaacugcccguuguccggugccugcacguaguucuuuuauauauacugucagguuuucuagcuauuuauugcaagagguuaagucauccacgucuagucuaucacugaugcaagcaaaaauuucaggaauuccauugaaauugguccauugaaaauaauucuuggcaacugaguacuguucuaaaugacaugccugcauauuuuagaagacugaacuaaacauaauuuacaugaauuugugagugaagcgugauagugucuucaugucucccauuuauuuuuuaccugucccacagacuggaacuguucccacucagcagaaugauuaugauuuaagguaguagaauaaugacagcaguucguauguucuuggagcuccccagaggacagauaggcugagugagaucuguccuugucacugcuaaugcuggcaguacucagugggugacuuuuccuuuggguuguucuuauuccuuacauuagacuuaaauuuuccuuuugggaaggccauuaugaaccacuuucugaauccacgggaagucuaugcuaauuaagagcacuguacaucugaaucaaugaaaaauggauguauggauugaaagaaccaucuugaaacagaauggcauaacaagacaaucugggggauuuaaaggcacagugaaaggagcuaaucugcauaaggacauggauuugugaagaugucuuuccuccucccccuacgcuguguugaauaaacugaaccauguaauuuggagggcauuguuguugaguuuuagggagcauuggggucuugaguagacacaagacuuggcuguugauaauuuagcuuaagaagcaacuagaucaaggaaaacaggauucuauuuguguguuuuuuggauagcaaugauuuauuucaaacuuauugguaaagaacuaaugcccauuucagaaaucaugaauauugccagcuacagauguuguuuuuuuuauuuaaauuacucuuaaguucuuuguuuagccuccuaaaugacucacucuuauacuugauacauaaacuuuaauuuugcaucauuaaaguguuugcauaaauauguugauuuuuaagauuccaaagauguuucuuuuuucucgagacagggucuugcucugucacccaggcuggaauguaguggagugacccuggcucacugcagcuucaaguuccugggcucaaguugaugcuccugccucagccuucugaguaucugggacuacaggcacacgccgccauaucugacacauuuuuuuauuuuuaagagacaggaucuugcuauguugcccaggcuggucuugaacuccuggccucaagcaguccucccauuuuggccucccaaagugguaggauuauagcuguguuuuuuuaaaauuuuaaaugcaacuugaggaguauugauuggauccacugcuguuuagaaaauuuaaaaguuaaugaacuuacgaaaaaaauguucaucuucacuaaaaaagaaaugcaacauagaaagugaagucuuuuuuuucaccugucagauugauuaaaguuuaaaaaugguaauauuaaauguuggcaaugguguggaaggaugaguacuucuuugaacuucuaggagaaauguacauuuauaugaccucucugauaauuuuggcacuauacaucaagaacuuuuacacucuuugaccuacuauuguugcuucuaugguuuucauuccuaaaacuauuggaaauucaaacaaacaaaaaaaaguguaggaaaguauuggcaauauugcauuucuaauggugaggaauuagaaacacccuaaauaucuaacaauaagaguguuucacuuguaccauuuuccacuuacaaaguaccauacaauuauuaaaauggugguuaugaaaaauauuucaucacagaggaaaaauuuacauauuugaaguaagcacuauuccaauaugauauauacucucaucucagcuguuaguuuaaaguguguaccaggugaccaaguacaguggcucaugccugucauccuagcaccuugagaggccaaggagggaggauugagugacagugagacucugucuucaaaaaaaaaaaaaaaaaaaaaaaaaaagcauggauggucagaaauguugcagaaugugaaaauaacuguuucaagguggugguuuuaugagagauuguuuucuucuuuauauuuguucuauuuuucaaaauuugagugcaaaaguauucuggguaugugaaagcaaguaugaucuuuguagcuucauucugggcuuaaccuaaggcuuuccagacccuagaggagcaccucagauuccaaaagaguaugcagaaucagucucgaagacuaauuguuuuauaaucaggugaaaaaguauauauauauguauauauaguuuuuguuuuuaaaaaaacguugguuucugugcuuacuguucagauaaaaauuucgacgaugaagauucuguggaugguaacagaccuuccucugcuaguucuacaucauccaaggcuccaccaaguucucggagaaacguuggaaugggaaccacccgccggcuugguucauccacccuuggauccaagucuucagguuagucuaagcccuguguggcguucuggggucagcuaugccagcuuuucaaaccagaggugcacguacuugccugugguggcccucagaagugauacaguccccauaugcagcagguuucugccugcuauucuuuaauugaauuagcauugcgauacugaugcugauaagcugguaaguuguaaauuugagcuacuauguugacuuuugccacauucuaguaagguggagccugcaggagaaggaagccagcacagaggaaagcauagcucagagauaagagcaagagcgcacccucaucacauuguuuaguuaucuggauccagcaaugccugaaaccacuaggggcauuuuagacaauuucuauuuaacaagacugagaauaauccagaagucacacuguaacuccugucuuuaaaauauauuuuguagacuggccccuagguauuggggcauguguguauacuccgcaugcagggucgugcugugggugguggugaccagccaucucugcuccaguucccagugagccauggugagguggcagcuguuggugugucuguuggguggcagcaugaaguagagcugggccagcgggagguagcucugugggaguggaaggccuguauuucucuaccuggaccgcaggcucuucaugcaggaagggcagagcucaacaccucaaagacaaucuguagaaagcugaguagcagcagccccacggaagagugaccagacuguuaaacgaaaaacaaacagaaaacagcaacaacaaaaaaccccauccaaaggaccacaaccucaaagaucaaagguagauaagcccacaaagaugagaaagaaucaacacaaaagcgcugaaaacucaaaaagccggaguaccccuuuuccuucagaugaccgcaaccccucuccagcaagggcucagaacuaggcugagacugagauggcugaaaugacagaaguaggccucagaauguggauaauaacgaacuucacugagcuaaaggagcauggcguugggcuuaggauugggguuaggguuaggguauucacauaggaagagaggaagucaaacuaucuuuauuugcagaugacaugauccuauaucuagaaaacuccauugucucagcccaaaagcuucuuaagcugauaagcaacuucagcaaagucucaggauacaaaauuaaugugcaaauaucgcuagcauuccuguacaucaacaccaggcaagcagagagccaaaucgugaaugaauucccauucacaauugccacaaaaagaauaaaauaccuaggaauacagcuaacaagggaagugaaggauuuccucaaggagcacuacaaaacacugcucaaagagaucagagacgauacaaacaaauggaaaaacaguccaugcucauggauaggaagaauuaauauuaugaaauggccauacugcccaaagcaauuauagauuuagugcuauuccuauuaaacuaacauugacagaauuagaagaaacuaucuuaaaauccauauagaaccaaauaagagcucauauagccaaggcaauccuaagcaaaaagaacaaagcuggaggcaucacucuauccaacuuuauacuauaaggcuaccccuaaccaaaacagugugguaguaguacaagaacagacacauagaccaauggaauagaagagagaacccagaaauaaagaacccacgacuacaaccaucugaucuucgacaaaccugauaaaaacaagcaauggggaaagaauucccuguuuaauaaauggugcugggagaacuggauagccauaugcagaaaauugaaacuggaccucuuccuuacacgcuauacaaaaaucaacucaagauggaugaaagacguaaauguauaacucaaaacuauaaaacccuagaaggaaaucuaggcaauaccauuuaggacauaggcaugggcaaagauuucaugacgaagacaccaaaagcaauugcaacaaaagcaaaaauugacaaauggaccuaauuaaagagcuucugcacagcaaaauaaacugucaucagagagaacacucaaccuacagaaugggagaaaaauuuugcaaucuauccgucugacaaaaggccuaacauccagaaucugcaaagaacuuaaauuuacaagaaaaaacaaccccauuaaaaagugggcaaagaaaaugagcagacaguuacgaaaagaggaugaacaugcagccaacaaacaugaaaaaaagcucaacaucacugauuauuagagaaaugcaaaucacaaugagauaccaucucacaccagucagaauggcuauuauuaaaaauucagaaaaacaauagaugcuggcgagguuguggagaaaaaggagugcuuuuacacuguugaugggaguguaaauuaauucaaccacuguggaagacaguguggcaauuccccaaagaccuagaggcagaauuaccauuugaccuagcagucccauuauugggcauauacccaaaggaauauaaaucauucuguuauaaagauacauguaugcauauguucaucccagcacuauucacaauagcaaagaugugggaucaaccuaaaugcccaucaaugauagacuggauaaagaaagugugguacauguauaccacauucauaaaaaggaacaagaucauguccuuugcagggacauggauggagguggaagccauuauccucagcagucuaaugcaggaacagaaaaccaaauacuacauguucucacuuauaagugggagcugaaugaugagaacacauggacacaugggugaggaaaacacacacugggaccuguugcaggguuuggggugggaggagggagcacaucacgaagaauagcuaaugugcuggucuuaauaccuaggugaugggaugaucugugcagcaaaccaccauggcacacguuuaccuauguaaccaaccugcacauccuacacaugcaccccugaacuuaaaaguugggaauaaaaauaaauaagauaaaacacauuuuguucuuacaagcaacaugguuccuugugagaccaguauggauguugcauuaaauaaauuguaggagauuucucccauaaauucuuccuuucaccccuaauguagacaguuugguuguuauauacaacucuuauuuucucucaaauuuuacauuuacaugcaaauucccucugaaauuuaucucagaaaaauuguguaggugcugcucuuagaaccauuuucacugauggcugugagcuuugagcaguugguggugguggggauagugguggguggggaaucccaugagccaaaaaagaugaagcugagugggccaaguaaaagcuguacucaugguuagcauuaaaaugcugucuccugauggccucuccugaauucugaaccggcccuagaauauugguaucuugaccagaccagcaugggaccacucugccuccucaccccagcaucugugauagaggagcuguaggaauguuaauugugcuuauuucuaguucuuucugauuauuuuuuugguguauuuuaaaacauuuuacuuuuuguuacugaguuuaaauucucauaacauaaaauuagccauuuuaaaggugauguuuucaguguuucaucuaccuuguagcauauaucaauacuuuguuccuuuuaaugccugaacaaucuuucuaaucuuuuuucuugaacuauucuuggguaauuauccguugcacaaacaaggcuuagaaaauuacuagacuuuuaggucuaacguuuaaguuuuuaauccaucuugaauuaauuuuuguauaagguguaaggaagggauccaguuucagcuuucuacauauggcuagccaguuuucccagcaccauuuauuaaauagggaauccuuuccccauugcuuguuuuucucagguuugucaaagaucagauaguuguagauaugcggcguuauuucugagggcucuguucuguuucauugaucuauaucucuguuuugauaccaguaccaugcuguuuugguuacuguagcccuguaguauagucugaagucagguagcgugaugccuccagcuuuguucuuuuggcuuaggauugacuuggcgaugcgggcucuuuugugguuccauaugaacuuuaaaguaguuuuuuccaauucugugaagaaagucauugguagcuugauggggauggcauugaaucuauaaauuaccuugggcaguauggccauuuucacaauauugauucuuccuacccaugagcauggaauguucuuccauuucuuuguauccucuuuuauuucauugagcagugguuuguaguucuccuuaaagagguccuucacaucccuuuuaaguuggauuccuagguauuuuauuaucuuugaagcaauugugaaugggaguucacucaugauuuggcucucuguuugucuguuauugguguauaagaaugcuugugauuuuuguacauugauuuuguauccugagacuuugcugaacuugcuuaucagcuugaggagauuuugggcugagacaaugggguuuucuagauauacaaucaugucaucugcaaacagggacaauuugacuuccucuuuuccuaauugaauacccuuuauuuccuucuccugccuaauugcccuggccagaacuucuaacacuguguugaauaggaguggugagagagggcaucccugucuugugccaguuuucaaagggaaugcuuccaguuuuugcccauucagcaugauauuggcuguggguuugucauagauagcucuuaugauuuugagauacgucccaucaauaccuaauuuauugagaguuuuuagcaugaaggguugucgaauuuggaagaaaaccuaggcauuaccauucaggacauaggcaugggcaaggacuucaugucuaaaacaccaaaagcaauggcaacagaagccaaaauugacaaaugggaucuaauuaauaagagcuucugcacagcaaaagaaacuaccaucagcgugaacaggcaaccuacaaaaugggagaaaauuuucgcaaccuacucaucugacaaagggcuaauauccagaaucuacaaugaacucaaacaaauuuacaagaaaaaaacaaacaaccccaucaaaaagugggugaaggacaugaacagacacuucucaaaagaagacauuuaugcagcuaaaaaaacacaugaaaaaaugcucaccaucacuggcuaucagagaaaugcaaaucaaaaccacaaugagauaccaucucacaccaguuaggauggcaaucauuaaaaagucaggaaacgacaggugcuggagaggauguggagaaauaggaacacuuuuacacuguuggugggacuguaaacuaguucaaccauuguggaagucaguguggcgauuccucaaggaucuagaacuagaaauaccauuugacccagccaucccauuacuggguauauacccaaaggacuauaaaucaugcugcuguaaagacacaugcacacguauguuuauugcggcacuauucacaauagcaaagacuuggaaccaacccaaauguccaacaaugauagacuggauuaagaaaauguggcacauauacaccauggaacacuaugcauccauaaaaaaggaugaguucauguccuuuguagggacauggaugaaauuggaaaucaucauucucgguaaacuaucgcaagaacaaaaaaccaaacaccgcauaugcucacucauaggugggaauugaacaaugagaacacauggacacaggaaggggaacaucacacucuggggacuguugugggguggggggaggggggagggauagcuuuaggagauauaccuaaugcuaaaugacgaguuaaugggugcagcgcaccagcauggcacauguauacauauguaacuaaccggcacauugugcacauguacccuaaaacuuaaaguauaauaauaauaaaauaaaauaaaauagaaaauuacuagacuggugcuuuccuucccaucucgcguccauaccccuuccagaagucccugcuguguagauuaugcacauaucagcccaguuuuccccuucagcccugcacuuauccuuuuugcauguuguuuaaugccauagucaugaauuuccugauuagcuccuccucaucagauagcuuaggcucagggacuguuguuggccuuugaguccucuucaguauauguggguacaugguguagggccuuaugcaaaggaggcauucagggccuaucugcucaaugggauccaguuuuuaugcuaaaacagacacagagcaccacaucacagugagugacggucauccuuuauaguaguuagcuuuuccacagugugagugaucuucagcaagagugaugacacacauuuacugcuaccugggauugucuuuaaagccccuuucugucuggauaguuaucaggacccugaacaccagauacaugagugguaagaaggucuuagaaaagcaaucagacuaauccauguaaaucauuaauggggguuaugaagaggacuauagauaccaauuuuuacaaugugaaaaaaaucugauaaagcaucacuugauuuucauacauaaaggggagcucauauuagcaaaaagaaauacuuucuccaauacuuuuaauuauacaaagcaucuuaggguaaguuuguaggagaaacuuguaacugauucuuaagugaaaaaaaugacaguuaucaugaguucaaggaaauagaaauguuuucaaacuaauauaaaguuaaauaaaacugugaaauuauuuaggacuuguuugaauauucacaaauuuguuaugcuggauucccaguaauaacaauuuaaguuauucccugaugaauuaaauuuucugcuugauccauuuauuaggaaucuuucaaaggacuuguauguuaauacaauaucuaaauccuuuaaaacccauacccucccugcuuaaacagguagucuaagugaccuuaagcuaauguauauagcauuguagaauuacuauauuucaucuugauaugaagucaguaauguuugucaauuucaugacacuucaaaguuauaugaagccuuuuaaaaaaauguucugaaucuuccaaaauguaauuuugauuguguauguuuagacuucuucaguguauguguuauagacguuguuucauauuguuuacauuuuuaaaauucuuuuuuacagcugcaaaagaaggagcuggugcuguugaugaagaggauuuuauuaaagcauuugaugauguaccuguaguacaggucagugaggauauuugaguaugauuacaaacaagggucaacuuacucuucaaguuuuauuuuucaauucugccuauguaauguuguuuacuaggucagguaauuuuaacugucagcacuacaggagaucugaggugcagaccagaaaauguuggagcaaaagucaaggcccaagauaaucuuucaguaagaacgggaaagacauugguugcucuauuauuaaguuuauggaucaggucacauaaaagagaaagaaauagaugacgcuaaauuagagaauaaaaaaaguauauuuauuuagggauuuuuuuuuuuuuuaauucauaaguuugaaggauuuuggugucugaaaaguuauggagaaugguuuaauaagagcuuaguuuauaccuucuuugaugcuucacuuuaaguaccuaacagaugaaacaaagauuauuuauaaaaauugggauacagccacaaguuugacugcuuugugccuuaguaucgucuguugcugauugagacuaauacuuuuccucagccuacacugacugucugugcucuggauuccuguggcacuuacugucuguuauguacaacucucuuugccaccuugguugccauauguguauaaagcagguaacaagaaucucaguggccuaggcgacauggcgaaaccucaucucuauaaaagauacaaaaaucauccaugguggcuugugccuauaguucuagcuauucgggagauugaggugugaggcucccuugaacccgggagguggaguuuguugugaauugagauugcgccacugcacuccauccugggcgacagagugauucccagugucuuaaacaaaaaacaaucucggguucagguucauccuuaaguacuugaccugaccuucccagcauacaucaagauugauuauacccuguaccuuaccuguuuucuagguaagauguggggauaaaugagaaaguagauuugaaacuguuuaaauuuauagguauagugucauguuauaaauaauacuaagugagaaaugacuuaggcaucacuggcuguuucccauuagccuuguuucucuuuguacaugaaaucaucuguuaaguuuauaguaaagcuauguuugaggcaggguuauucacauauggcagcaaaucuuguggguacacauuuguagugagaaagauccucauuauagacaaaacuguucagauauuuucucauagguauuucuuaaaaaaauaauuucuuuuaccauacuuaauguucuugacuucauguaauuaagaaauaaucuguuuauucugcauguuuuuauauugauuguaaauuaauuuugcuuacagauuuauuccagccgagaccuugaggaauccauaaacaaaauuagggaaauauuaucugaugacaagcaugauugggagcagagaguaaaugcuguaagcuguugacuucaugugauuacauuuucauaagauguauuuaaauaucucaaauacuuuauugugaaauugggacagcucuaaugaauucuaaauaguacauauuuuaaguucaaauuaucauauuuauacuucaccuuuuuaguagagugucuccuuuuauuuuuauuuugaaaacacaccaacuuacaccuuuaugaaucgccuagucuuuuaacaaagaccugacuguggaauguaugguaauagucuccacucucaccuuagcagaaauuucauucugugauuguuugccuuuaagguggcuuuuuuguggcauuuuuaguguaugucuccaauauucuuuucuuucuucuuaucacuugcuagaaaguugugucuccuuuauuuuuaaaaguagauuaauggaaagugggcucagcauuaaagugagggugugucuuaucugagaaggcuauuuucuacugguuggcuggcaagaagagaagugguacaauugccauuauauuguauuucaaauucagaccagccauuuaaugguucaguggaggauaauaaauacuauaggaaugcuucuuccuuugauucuuaaauaaauggcaguugaaguggggugucgcggggagguaagcuuaggaggggauuuucacaagccaaaaguuuuuaauuauuuaucauuaguguuguaggaucuauaaauacuuuaagauauuucaaauguaaaacuuuuuuugcagaaauuauaguauaugugucacaaauacucuaguuaaaaauuauuuagucuuauuugugauauguagauuuguuuauuguauuagcuaauauuuaacuggcugaauucuuuugggaaagcuuucuaaucaguugaacuuuaacaaugaucucuuuuguauuugaugacuucuuuuguuguguauagucuguguuagaauuguuuucuauuuuucugaauuuucucuauuccauuagcuaaaaaagauuagaucuuuacuuuuggcuggugcugcugaguaugauaacuucuuucaacauuugcgucuuuuggauggagccuuuaaacucucugcuaaggaccugcggucucagguagugcgggaggcuuguaucacguugggguaaggacugcgaugcuccauauucucaccauaaaauagugucaccacagagcuucagagaugucuccuugaacaugugagcugggucucuuuaauguaacuucugacuagucuccaagacccauuccaguuaacacuucuuucaguaguuuuacaauacuuuuugcucaauuaugugaagugugacagauuuuaaauuuuauucagugacauagcucugaagucuuuauuucaaacuuugaagcaguuauuaauauggaaaagugaaauucuauaaaauccuguuucucugauuuuucauugauuuuugcuggcaggcaauagcguguuuaucagaauguuuguuccuagaagaguacuguaguuauaaaguuaaaggcauuuacugcaguaagauuuuauucuagcuguacguguacuagugaucaaagcuauuaaaacuuuguguuagaauguaugucggaauaucaaagcagcagcagcagcaggaggaggcauugcagcuguuuuaaguuuuggcugaagucagauuuugaagccugaauauuuuauguuaagauaaaagaaaaaagaaaaaggagccaagggugcuuuuucauauuuguguuuuauuaauauauaaucaguuuguuugcuauuuuaagacuagcuggggcaggugggcugguaugugccuggagucccagcuacuuggaaagccaaagugggaggauugauugagcccaggaguucaaguucaacgugggcaagguagugagauccugccucuagaaaacaaacaaaaagcuccacagacuaguuggaaauguuuuuuuuuaaaaaaaaaaacaacaaaacuuuugggcuaagaacuauuugccaaguucuuaacaugcacaucggaaaucucagacccuuguccuuucuagauaacuuuaaaugaaggcucuagauguuaagugguuuauaugcuucacugucucuaagaaaaauaacuauaguccaguauccuuuucuuguuuuaggcaucugucaucaguucuggggaauaaguuugaccauggagcugaagccauuaugccaacuaucuuuaauuuaauuccaaacagugccaaaauuauggccacaucugguguuguagcuguuagguuaauuauucggguaaguauguuauaggccaugcuugaaauaagcaagugguaaauacugaugguugauaaauauuagaggcauuuuuguuaacauaauuauauugagucauuaaauuuauuagcauaauuauauuggaauuuuguauauauaucaucuuuucccccuacuuaauuguggcaugugagcuuuuuauaauccauaaugugaauuaugguuguguuauaaaguuaaugagguauugauuguuaacucacuauugguuuaaaauguucgaacauccggugucugcuucugaguuuauauuguauucuuguuacucggauauuacucuuagucuuaccuccuuagucccaguccuuccguuuuagguauuggugcuugugguuuuacuguucacccaaaaguuuaauuaauugcacauaagcacgaaacaaaauguucucuuugguuagguuuucuaggcacuuguuuguuuaaauuuaaauaauuauccaaguaauuuauacacagguuuuuaacaaaaucuaauaguucacaaagguuuaaaaugguuuuccacauuaccuccccaccacuuucaagucauuuuugcccagaggcagcucuugaaacuuugaggcuugaugauguugucuaaaaucuauccagaauauucuugauuauugguuauuuacuuuguauuauaaguucuuacuguucuuacuugcacugccugcuuuaacuguuaaacccaaggucauuauuggacauuucuauugaaauaguaucaaaauauauuggucugaugacuccuuucaaacccacuccuuuuaaacccacucagaugucuacagcugagauaauuuagaccucauacuaaugauuguuuuaggcuuaucuucaugucaucauguugccuguucuuaacucuguaaauuuucuaauggcuuuugacaauauccugugaauucuuuuuuucuuuuaaaacucacugacauucuaaucugaauauauaugugcuauaaguagguuaguaaggaagugauucucuuaauuuuguuuuguuuuuguauuugcaaguguugaccucuguuuuuuguuguucuucacagcacacacacaucccuagguuaauaccugucauaacaagcaacuguaccucuaagucugucgcaguuagaagguaaauuuuaaaggauuuucucauuguuuuugaauuguuuaaaaaccaaaacaaauuccaaaucuccuuccauggauaaaauuucauguauaacaugcuuaguauuacuuaaaaucacugcaguaaaugacuuugaguugaagaaucaagaucuaaauauuuugggaaaugaauguggacaaccucuauuauguuucuguguguguguguguguguguguguguguguaugucugugugagagaaagugaguuuggguguuaguggcagaaggagaaggggagaggacucccuguacauuuuuuuccugugauaauccuccuaccuuugucaucggucugcccuauucccugaguaaaggcaguaacugcaugcaagaaaaaaauaccguaaacaucaauggcaauaguuuuguauuaacauaggugaggggaaagguauguguuugcaucuucuguuagcgauuucugggauucugaaucuucacugucacuuaguucugugcaguugugggagauauacccagaagacacaggcaaauacaaccuggguaacuagcuagggguuuguucccaagucccuaucuuauauguccuggcgagcugcccuaaacuacgugugaggaauaaagacuguguucuuucagcucagaccugugauucuugaguguuuuaagagucuuuuaaaaucuaugaacccucuuuccagcaagucguaaauguacagaauaguuuuguguagguuuucagggaauucaugaauaccacuaaagcuguuccaguagacuguauugggagucuuauaggauaauuacuggcaggcuugggcaaccucuuggccccauucccuuagcugugugucuugaugcuagcccugugaaagaguccuucacucuuaagauuuagagcccagaugaccuuugccagccguuuaccuuuuuuccuggggugucuuguugauccugcuggguuucuauggguacaagacccucuuaaacaugaagcagcucuauauuugucguuuuaaaauuuauuuuauuauuuuuaacaaauuggccagagaccgccuuuuuaaaaauuuucuuuccuuuccuuuucuuccuuucccuucuguuuccuucccuuccccuuuucuuuuucuuccuuuuuuuccuuuucuuuccuuuuuccuuuccuuccuuccuuucuugccuuucuuccuuuauugcuuuccuuucuuuucuuucuuucacccaggcuggagugcagcacacuguaaccucaaguuccugggcuuccaaguagcugggacuauaggcacacaccaccauggcccacuaaucuuuuuucuuuuuuuacuuuuuuuuuuuuuuagagacgggggucucauuauguugcccaaggaugaucucagacuccugggcucaagcagucuucccaccuugaucucccaaagugcugggauuauagaugugagccaccaugcccaaucuuuguuuuuuuaauuggcaaguaaaaauugugaagacuuaugguguacaacaugcuguguugauaauguguauacauuuuguaaugguuaaaucaagcucuuuaacauguguaucaccucacauacuuauuuuuuuguggugagaacacuugaaaucuacucucagcaauuuuaaaguauauaauauguuguuacuaacuguagucacaucacuaugaugugcaaucgaucucuugaacuuacuccuaucuaccugacauuuugcaugcuuuacaucuccccagucucccaacccccagcuucugagaaccaccauucuacuuucugcuucuaugaguccaauuuuguuugcuuuagaggugguaccucacucugucacccaggcuagagugcaguggcacaaucauggcucccugcaaucucuaacuccugggcucaagugauccucccgccucagucucccaaguagcugagaccauaggcguccgccaccacgcccccagcuaaguuuuaaauuuuuuguagagauaaggucuuaucauguugcccaggcuggccucaaccuccaaagugcugggauugcaguugugagccacugcacuaagccugagucgacuuuuuuggauuccacacuuaagugagaucaugcaguauuugucuuuguaugccuggcuuauuucauuuaagauaauauuuuccagguuuaucuguguugucuuaaaugacaagauuuauuuuguuguuguuaaggcugaauagauucuguuguauauauaugcuacauuaucuuuaucuccucaucuguugauggauacuuagguugauucccuaucuuggcuauugugaauagucuugcaauaaucaugagaguucagauaucucuucaacauauugacuucauuuuuuggggauauauaccuaguaguugguuuuauauccaucucauuaauaacuacaugaaagacaaaaagagaaaagaagaauaauccagcuaucuaaagucacgaaaaaagaaauuuauaccuuccacugaaaaaauguaauuccuuacuguguggcucaagugcguaccccagggaaugcaaucuacccuugaccuaggguucagcuucuccugggguuagaguggaacagcuuuagcuuccccuagagaugagaauguaaaguuggcaugccagagggaugauuaugaacuucagaaccugaccagcaucaguugaaacauuccucucccacuuacucguuugacuuguuagguauaaagguaccccucuguaagguuuggaggauucacaaucauuacguaaaacauuuagugaaagcuuaauuuguugcagcuguggcuguuguuauuuucauuuugcugcuguuguuuucauuucgcuauuguuagguuuccaagagaaauucagaauguguuuuuccuugcguaaggcaaaauuucuccgauaagaugacacggaucuuuguuguggaacauugcaagauguuuaggggauucaucaucuugggcugccauuacaaaauacuacagacuggauggcaugaacaacagauuuauuucucacagucuagagcaagcuuguccaaccaugcagcacaggacagcuuugaaugcccaauacaaauucguaaacuuucuuaaaacauuaugagauuuuuuuuuaagcucaucugcuaucauuaguguuaguguauuuuauuuguggcccaagacgauuauucuuucccuguggcccagaggagccaaaagauuggauaccccuggccuagaggcuggaaguucaaagucggcgugccagcaaggucagauucuggugaggacucucguccuggccuguagaccaguguuuuccuguguccucacaugggagagagggagagcagggugggaaggaggaaagaacaagcuaccuguuaucucuucuuauagggacacuaaucucauaaugagggccccauuaucaugccuaaucuaaaccuugucacuucccaaaggucccaucucuaaauaaccaucacauugagaguaaggacuucagcauauuaauuuuggaggggggggugggcagggagauaaaauucgcuucauaacauuuagcaguucuggccuuuggcacuaaauaugaguagcacccuacaguuauugugacaauagaaaugccgccacccucaccaauuucugaaccacacacucagauuguuauuucuguauuuagccaguggguaucagucagaacuguaugucuuaaugcugagagaaguaauagagaccaucuugcccagucccucugcccucugcccucagaaagggagagggagcuuaagagagcaguguaagcaaggcagugcaccuucuuagcuacauauucagccuguacuuagcuucgcuucguagaauugguaacaaauggauuacacacacucugacauuaacguauauauaguggaauuaggaguucagauacagcagugauuaaagcuugcugauguuuucccaagaagcuucauagauggguuaaaaaugagcuacauuuugaaagaugaguaggaauaagugcaguaaagagccaagaaaaacccagacugggaaaugccacaggcaaaagggugaaaguagaauaaacauggucuagauuggggauuggggcaggaauggggagggugauggugaggaauguguguguguguaguuggugucuuuuccuuugaaaaggcuugcucuaccacucuggccccaccacugccggcccuaggaccaagcugcauggcucuccugugagcugcuggagccccuugcauucuggcaguguaacuguuugucucuuauguucucugggcugugucuugguuaucauuggaucuccagcaucuagcaugggguaaagggucaguaaauaauuauuuuuauuuauuuauuuuugagacagggucugacuugguucccuaaacuggagugcaguggugcaaucauaguucauugcagucucaaacuucugggcccaagcaauccacccaccucagcuuccuaaauagcuaggacuuuauuagugcaugccaccaugcccaacuaauuuuuuuaaaaaaauuuuuuguagagacagugucuugcuuuguugccuaggcuggucucaaaugccuggcuucaggugauccuccugcuuuguccucccaaagugcugggauuacaggcgugagccgcugcucccagccuugauuuauugagugauuguguauggauuauaaguugugaauugggaagguuguaggaaagaaagucuggucauuucuuuagagaaagauuuuacuucugauuugugcguucuugaauggguuccuaggacuauuaggauuuauucauacaaaaauagaaaugcuagacuuaggaaaaagaaauuuuuauuuguuuguuuguuuguuuguuuauuugacagagucucgcucugucgccuaggcuggagugcaguggcacgaucucggcucacugcaaccucugccucccggguucaagugauucuucugccucagccuccugaguagcugggauuacaggcgcccgccaccaugccuggcuaauuuuuguauuuuuaguagagaugggguuucaccauguuagccaggcuggucuugaacucaugaccucaagugauccgcccgccuuggccuccuaaagugcugggauuacaggagugagccacugugcccggccagaaaaagaaaauuuuguagagguagaacccgaaguggugauguaaucuaaauuguuuuugugcacaaaucagaccaagaaaaaucauaaaagugaaaaggcuuaaauagaaggaugcugaaacauccuucuauugguugguuggaggaaagcaaaguaguuggagaaaauccauuuuaagcacuauuuagggccuuagcaugaaaauauggagagcacuuaguuuuucaagguacuuuuaacuuuuuuugugcaaagcauucuccgaaauuaaugcaaagaccugauugugucauguuuguugaucuucugugcauguguacauucucuauuaacauauuacuuaggauaguauaaaaaugaaugacagugguaaguccuuucagugauguugccaugaagugcaagcuucugauuggagagaaaugcuuggauccugucccugugucccuguggcacuaauaggugcuuaauuacuuucauuugcuuugguuuuuagucaguucugauucauucuuuauguucuguuuuucuaaucauaaaaaucagaagaaauguacuaauuauaaaaaauaguauugggucacuuaagaaaaaugccguuuucauuuucacuaaaauauguauuaauaaguuguguauuucuuaauacuuuuuaggcgcuguuuugaauuuuuagauuugcuuuuacaagaauggcagacacauucacuagaacggugagcaucugauuugaaaccauuuuucccucugaauugagccuuuagagugaaugcuuuggugagugguccagcuggcuuucuguaagaauggaggaauauaugcguuuguuuucaugacuacgucuguuguuuuacugauguuggccacauaauauucacagacgcuuuuagugaauuucauugguugaaauacuacuauguccaugugcauucugacagcugcagagccaauguaaacuguuacugacucuggcccugcugcuugacauuccugucaguucccaugagguaacaguuuaaaguugcuguuaguagacaaguguuagauccuucaaggaauuucacucauuugaaaguuuucuuuuucucccucuguauuugauguagacagccuauuuaauguuaaggugauuauuucacaguuuccauagaaacuaguucugaugugaaaaacacaagcuuuuguuguuuggguucguaaaagauugagcuauaagugcacauuuuuaaaaaaucagcuuguguuuuuuaaaaaaaaucccacaagagaauaggguuaucaaaguccuuaggcguggguagguuggaguggcgcuaggguguuggggcaggauugggaguuaaaggacuguagguaggagugccgugcuuugcccagccacgugggaacugaccagccuuggcacagaggcucccagcuccauguugccauuuggaaguuauuucucccaccugguuucacuugcaucaaaccauacauuuaugauuguuacugcuuucuuuucuaaauaucuagacacauaucaguauuagcugaaacaauaaagaagggaauacaugaugcugauuccgaagcaagaauagaagccagaaaguaaguuuuuauuguacaccacuuuuuaaauuaacuucuucuauauuucacaugaauuauaggauugccuuauuaaaaacuuaaguuacuugaacauauuuguuaaccaugacuuuuaaacaugacccccaaaaggccauuuuggaauauuucucucuuuuuuuaauaacaucacucaagcuuguaaauaaacaggacugagggagacaaaagaaugcucguuuuuuacauucgucacaaauuaucacauagcucuggaaggcaguuguauacaugcucaauguauucuuuuacucauuaagccauauuguaauccaaagcugcuuuaaugauuuaccaugaaaaaucuuggucacagggaauucucucccugcagucacuucuuugcaagcaucugugguuccuuggugugaaucauauuaaggggaguuggaucgacuaaugccugggauuaucacagugauaacuuguuguuucugucucaacaagugagguacuuuugccauuaggacugaguuuccuccaauuauguggccauggccucuguauucguuaccuccuuggaaauuuuuuuuuuuuuuugagauagagucucauuuuguugcccaggcuggagugcaguggugcaaucucggcucacugcaagcuccaccucccagguucucgucauucuccuaccucagccucccaaguagcugggacuacaggcgccugcccucacgccuggcuaauguuuuguauuuuuaguagacacaugguuucaccguguuagccaggauagucucgaucuccugaccucgugauccacccgccucggccucccaaagugcuggaauuacaggugugagccacuguguccagccuuggaaauaauuuuugccagugugacuguaaauaccagaauuuugauauuaagacauucucucuugggcagugcauugauaacuacugccaguguugcaucugugauuuuuuuugaauuuacucucauaguugaccaacucuccuaauugauaugugcuaaaaucuaauuguacuagccugcaacguuacgguuuuacuuagcugcauuaauacauccugaucuaguacuuauugcucuuugacugccuucacaguuaaauuauauuucacuuguuucugagcuuauuauaacuaugaaguguuugugccaauuuuuucuuugcuaguuucuaccaaaauaagugauauaauuaaucguugcuaaaaacuauuaggaauggauuuguuaauaaucuguuuaugcuguuuuuauccuuguauuggacccuccccacccccggcccauuuuuucuuggucuuuaauuauaaugugauacugauuucaaguagcucugaacauuuuaaaauuuuucuuuugcacauguuaccuaaggcaauuuuaaauacuuugugucaagagauguaaaauugcauguauaauagcugccauuuuaaugagccuauccuguguucuagguauggucuuagauguuuagcuccaccuucccuaagauuccccaguuuugcaaguuaggcuuuuuaauucccauguuauaaaugaggcugagguugagagaggauaagugacuugcccauagucuaaaagacaguaaaauugugaggccaggauucguaccaggucuccuuuguuuacccucuccuccugcuacuauuagcggcuaaacugaggcuuccaguccuugaaaaucuucugugguguacuccagaguucagcaaaagaccuguuuggauccuugaauuagaccaggauuuuguguguuuccucuagauguuacugggguuuccacagucacuucagcagagaagcagagcacuuguaccacaccuuggaguccuccuaccagaaagcccugcagucccaccugaagaacucagacagcauagugucucugccucagucagaccgcucaucuuccagcucucaagagagucuaaaguaagagauucaucuuugcuuaucauucaugugagaauuuguauuuaaaaguuugucacaugaaaacacaaauucuagcuauguuuuuacaugggugcuuguuaaaacgcccccuuacuugagguagauccuggugcaaaguaagauaccaccauggaguggugagaaauagguugcuuuggucucuaccguacuguuuuucaguuaaauguauacggcaguccuagaauacaguuuuagaauaacauaagugaauuauggaguagugugaacuauacacaccagugcuucagagucuucucagaggauguaagugugaaccuggagacaaguuuggaaauggaggucauucaaacucugugacuuaauauauuaucaucucugcucuguguuucuaauuucugucuguaguuacuauuucacucucuguauuugaaaggcaguccaaaauagauugcuaaagcuucguugggaaucagggaguuuacaacauugugguucacauugcccaaaaaauucugaaaacucugaaauaauucuucauuguaauaauuuccuguuguaguuuguauuuguauuaauucagguacaguacauguaauaaauaauauacaucuuuacuuuuagucguccgcugucugccaaaagaaguccuacuggaaguaccacaucuagaggugagacugacagccguggagaaggccuguucuccgcucuggugggcuguacgugcagcugcaagaggcugcccaggcacaggaggccaacggccugcccucaguuccuucuuaggcuugaauguugccugcucugcccugcccugacucuccagcagagcuccgcuuugucagggccacucgcugcugaggacaacauugacggggugacuuaggaaugaagcucugugaccuuuucucuccaccuccccugcauguugacauugccacaaacuguaccuccugucucugauccuuugaugagacagugaagacaucuugguggcguuuugagcagcagcugcagcagugugauggugguuaguggugggagaguggcauguuccagaaagaggagggcucuagguaagagggcguggcacaguuaugucauuucaugaggagacgcccuagaugugagcauuuuuuccuuauuucacuucuucguaguaagcagaaacaugguccauuucuuugggguuuauagucuucaauaacaagaaaacaaauguaauugauacauuacaauugagaucacuuguaguuuccuucggcauugccugaacucucuucagggaccaggagaaacuguuugucaguuuuuuaugcuccagcauuuguuaaaacuugguauuuguuuucaggaaagcaaaacaacaucagauuuuagcaauguauuuucaaaauucuauguaguccuuauucauauuuccuccuuuaucacuaaagcuucuacaguuaguaccaaaucugugucaacgacugggucccuccagcgaucucgaagugauauugaugugaacgcagcagccagugccaaauccaaagucuccucaucuucgggcacgacgccuuucagcucugcagcagcuuugccuccagggucauacgcauccuuagguaaccacaccccugucacccuuucccuccugcacugcucugcaagagaugacucuuaaccucuuagcaaaauacaaacccaugauugaggcaagucucacuguuguggggcuacuauuuaaaucuaaguagcuucgugcacuugcugcugaucagccagccacccuuguugagugucccuuucuucgaugcaucauccguuuuagugcugaguaaguacacaguacacucaugcucggaggguguguggcacugagcacguccuuuccucaacucuuccucuuccuccauggcaagcccagccaccucccauauugucaaagcuaaguuuuuucccccucugacacuggugggagcagagccagcagguucagugagggauucaccaaagguagucagugucauuagguguuucucaauuugagaauauaaccagagcuggcagggauaaucggguuggguuguggggaauggcaggaggaaucugaaggaaugugaugagcucaugaaucagcauaaccaugucugugcaaaagaguguuguccuuccauguaucaccuugggaggagcaugcccuuacucugaugauugcccaaaaaaguuuuuuaaaaacuacuuccaaaacuuuuagcaucugacauagugauagaucgacuauucauauuuuucagcaguugcuuaacacguacugugugucaggcuaauuguuuauuucguuuuguuuuuguaagagccaauucauucaaagccaaaaucuagggacuuagcuggauugguucuacuuuagauuuuaaggaaaugaauaaaauuuaaacuuccugaaauauugagguggaguuacucauguaacuuucagacaaauuccagagucaguucuaaaacuaauguucugaaaauguuuugaacauuggaagcacagugaacaaauagcacccagagaagauuuuagggucugccauuuauucgcucugugaccuggaguaggccguggaaucuguaggucuauuuuccauaccugcaaauuacuuguaauaauagccaccuaacucauauaugaggcaaaaugaaauuauauaaagguucuuuauaaacuauuguucuguaagguggaagaaagugugauugugauaggaacauuauuaauuugaaagauauguguucuggaacauuugcucagucagucuuguuuuuauggaaauaccucauacacccauaacaauugagaagaaauucauuaagaacucucuuuuuaaaaucguuuuuaacuauugcagcauuauguaggaguguuguccauauguaaccauugagcaaaggagaaguaacaacucuuccuccuaugcugaauuaguucuguuaauuuuaguuuaguuuuucaguacuuaccuaugcuuuaguauauuagauccaccuuuaguauuuguaauuaguauuuguuucauuguuggaaaaagugaguaaaaaucagccucaguauuuuuguuuuucugucuguauuauggaguguuugaauauggcugguauagacuucccccagugcuaguaaaagcccucacgucuuuugguaugauaauauggagcugacccuucagaagcacugaugauaaguuuucaguccaguauuaaccucuucaaagaacgagacuggaguauucaaauucucuguuuccugagaauucuaccucaacuucccuuauuuuguccccaaacaaaaacaccaaaaaauugaaauauagcacaauccuagugagaauuuguuacaguugcuaccuagguugacacaugacaucuuugcaaaaguguagcauuaaagcugaugauccuuuuccaaacuucuagaguccagacacaugagggaagacauggaguacauaggccuggacucagguaccaugcucgacagcuuuugcugcuggacguguaguugggauaggcauugcuagagcaagcuucucugagcuucuuacuuggcucugccuuuuggguaacucuuuaguauuuuagcuucuaguuccuccucucugcccuguucugcugguacuuucuuccaagaaaaaggaacucuuaagaggaugagaguuggcuaaaacaaaaaauaaucuuucuuucaacuguggcacuacccuggguugcccgucuguguuuuauuuuccaaaggcaaaaaaaccauuaugcuauguuaagcuaauuucaauacaaggcacacuuacuugcuucagacucugcuuugcuguugaacuuguuucccuuuuaauuuuguuuuaaauuguacuuuugcuuuuuuaguagcuaauaacauucggcuuuuuaauuuuuugaauguuacuaacuguucccuguuaucccuucccuuguuuuuuaauuugcuuaaagaugguacuaccacuaaagcggaggguaagcgguuuguuucugugauugaggugugucucacuuucucugguccucuguucucaccgaguguugcccaguacccacuuguccucaccaaggucccugcaugagauguugcacgcuguuucuccuccucucuuuucauucugucgccauuggguuuuugcccuaccucuaccugaguucuccuucccuuucuuguucagucuuuguucuugugaauuuuagcacuaaaguaugcugcgugugguuuuuauugcugaguccacacucuggggaggagcauugaugucacacugugugcuacuguccucauggacugccugucuuggguuuuauuacuccugaagcacuaccuuagcuuuuguuuccuuuucuuuccuuuugugcuuuugugggccucucaggauuugccuuucuguuuugaaaguaaauuucaaugucaauuauucagacuaaaggcugguaaacauuuccuaacagguaauuuaaagaaauaaaaaaauauauuuuucucuccucuaaagguacuacugacuuauaugaugcuauuuuuuauuugucucacggacacacaccccauucauucauuuacucucauucauccccucaucaaccguguauuaaaugccuuccaugugccauguucuguacuacacaccgaggauauaguaaugcuguaagaaauaggcauauccagauccacuuuauuuuguuuuuuaugccauucucaagaagcucuuucuauuuuuguauuaccuuuugaauuuuagacauaguuguuuuagucuuugcagguuuuugauaagugcauauaaggcaauaucauuccuuugcuagauagaaugcaugaaaaugcuuuaaguaauugaaauuuagaggaaccuucucugccuaaauagaggcuuaaacccaccaaccuucaggauauuuacuuaacaauuaggaacagcuaguucauuuucauauauuauuuagucacccuaaagggcuagcaugcaaaguuagcuggguuuagcuugaugugugcagcucaguucuuuuaauccguauguuacuuuccaagggacucauaaaagaaagauaggaauggauuuuuuuuuugaaggugaacaugaucccaagagcaguguuucuuaaauuuaucacaucgugagaauuacuuggauacuuacuaaaaaaauacucuuagguccuucacccugaagaugcugauuaaguuuggaaggaacuagagaaucugaauuucuaauaagccucacuggugguucuuagggucggacaaguuuguaaaaaaaaauuccagaauuaaaauaaggacaagaaaccucuguccugaugaggacgucaugucugacagcagacggcagaggcuggugugauugggaagcugguugauaauuuucuucauuucuuaagcugauauggguaauuuuauguuucuccugcccaaagaaacaaucccgaguguuuucucagccuuacugggaggggaggaggagaguggaagagaauaauguagaugaaauggaaagcaaagacauuacaugggaaauuauauguuuuuccagaaugcccugauuucuaugccuauauaacagaauugaaaucagccuuuuauuccauccagcccuaggacuuuuuaacuuuuuuuuuuuuuuuccaccaguuccacaguccugaguaaggucagaauugcccucucaguuauuguccaggagacuaacucucugguuuuuccuucuucugggagaaauuguuuuuuauagagagcucagacuccgacaauagagaccguugcugaagaagcauagggagugucaguguuuguguacuggggcugcacaggcuguggcaacacuggcuagucaaagccuggaaagaccugugaguuugaacucuucuggguugccauuguucuguugguuucagcagugagacugagagagccuguucuguuuagaaaagccacagugguuuucuagguaaagucugcaggagaugucacuuggugccuuuucaauacgaguuuuccaccugcauuuuuggaaccauuaugggccuuuuaaaaauuuauuaauaagucucuuaaauauuuuauaaucuagcuucugagacaagaugauuuuaaaacaguuauaugcucuaaauuaaaaauuuagagggugagugcaguggcucaccccuguaaucccagcaguuugggaggccaagcaggugaaucaccugaggucaggaguucgagaccagccugaccaacguggugaaaccccgucucuauuaagaauacaaaaauuagccagaugugguggugugugccucuagucccagcuacucaaaaggcugaaacaggagaauugcuugaacccaggaggcggagguuguagugagcggagauuaugccuucauugcacuccagccugggcaacagagcgagacuccgucucaaaaaaaaaaaaagaaagaaauuuaggcaguacguuugaguuuacuggcaauuuuauuacuauaguaauugagaaaaauauauauuccuuaggaguuauucauuguccacaucaaggaauccuaacauuuaugacuaauuagaaaaauacuuuuuguaaagaacgaaaaacuaaacuuuuggaugaaaguuuauuucuagguuauuaucuucaguauguuauguucaguaauuuuuggagauuuugaugagggaaacauaaugucuuuuauguugcacaugaggaaguuuaugauuagaugucauaugguaaaugaaugcauucucauacuuuuuuaaaaaagcuaguaugcuuaggaaaagcauucauauuuuucccaaaauaaguaacuuuaaaugaaaaguuacagugcuuugaauggccuguggggcugacaaccauuguuuguuuggggaauaaucauguuuauuaagauguagucaaaagccauaucaacuuaacuuucagugauuuuaauuaagauuacacgauaaaaauuauauagccuugucuucucuucaggaaaaagaacuuagauuuuaguacaauuuuacugggaaauaaaauguaaaaaauuauccaagaacugugaauuuuagguaauuguccuuuuuacacaguggaaaaaguaugcaugucuauauauagaaguaaaaggguguuaagcuucuuuuaaauuuuuaaaauaugaaggaaauuuuuuuuuuuuuaaaggcagggucucauuuguuacccaggcucuggagugcaguggugcuauuacagcucacugcacccuugaccugccaggcucaagugauccuccugccucagcuccccacccugucugucagaguagcugggacuacaggcgugcaccaccacgccugccuggcuaauuuuucaauuuuuuuguagagauggggucucccuauguugccuagucuggucuuaaacuccugggcucaagucauccuccugccucagccucccaaagugcugggauuacaggcguaagccaccaugccuggcaggaaauuauucuuuuggggagaauaguuguagguagcaaaauguagaaaugaucaaguuccucuguuuugguucuguaaaagaugucaguguaugaguaaaggcuggguuuaauuaugcccccaagcagugaaacguacagcagauauguaugccaaaacgucccagugugaugagaacagagacuuacuuugaagaccuuuuaauuuuauaaucuguaauuugggaauuugcuagaaaauuugaaacacguagggaacagaaaaacccuagugacauaaggcucucuagugguuuuucauuugccuaacaagaagauaggaaaaccaggccuacaaacuacacuugguacgcagggugaauuucuccugguuuggagucuuuucuagaagguauggcaaugugagugaaaaagaauccuuaggagcaguauuaaaaagucaugagaugaaugaucuuucuuuauuccaugaaagucaaaggcuuugggcuccucuuacaagucuuuguuuuccucugggucugguuuugcucugguuagguuuguuuguugaugcuuaucuuauucauccuucccuccaaaauuauuuuuguuguacaguucuuuaccucuuuuuuuuuuuuucuguuacuugugcugacuuuuuuuucucccuucacaucuaucuacuugucucugucacuuaauagauuauaauacagaacugaaguauauuuguacugcuuguugcuuuauuuuuauuuauuguauuuugagguggggucuuacucugucacuuagguuagaguacaauggcaugaucauggcucacugccgccuugacuugccaggcucaaguauccucccaccucagccuuccaaguaacugggacuacaggugugcaacaccaugcccugcuaauuuuuuguggagaugggguuucgccauguugcccaggauggucucgaacuccuggacucaagugacccucgugccuuggccucccaaagugcugggauuacaggcgugagccacugugcccagccugcuuguugcauuuauugaaacuuuuuuccccuaauuaccacagagcauuuuauaucaucuuuuaaaaacaugcacagguacucauaguaauauugccaaaucaauagacugaaaacaaaacaaaaugaaacaaaagacaccuuuuccuauaaaauaaauauauaucugaguuuaacacaacagaggcccuuuaagcuguauagcuguguucccaaaaaaguaaggaaauguucaaaaccaagaggaucacagacuggaaugacaagcuugaacugauuuuuaaggcuguccccgagggcuuaguuuuuuuuuuuuuuuuuaguuuuuuuuuuaauuauacuuuaaguuuuaggguacaugugcacauugugcagguuaguuacauauguauacgugugccaugcuggugcgcugcacccacuaacucgucaucuagcauuagguauaucucccaaugcuaucccuccccccuccccccaccccacgacagucccagagugugauauuccccucccuguguccaugugaucucauuguucaguucccaccuaggagugagaauaugcaguguuuggcuuuuuguucuugcgauaguuuacugagaaugaugauuuccaauuucauccaugucccuacaaaggacaugaacucaucauuuuuuauggcugcauaguauuccaugguauauaugugccacauuuucuuaauccagucuaucauuguuggacauuuggguugguuccaagucuuugcuauugugaauaaugccgcaauaaacucaaaaccgcucaacuauauggaaacugaacaaccugcuccugaaugacuacuggguacauaacgaaaugaaggcagaaauaaagauguucuuugaaaccaacgagaacaaagacacaacauaccagaaucucugggacgcauucaaagcaguguguagagggaaauuuauagcacuaaaugcccacaagagaaaggaaagauccaaaauugacacccuaacaucacaauuaaaagaacuagaaaagcaagagcaaacacauucaaaagcuagcagaaggcaagaaauaacuaaaaucagagcagaacugaaggaaauagacacacaaaaaaacccuucaaaaaauuaaugaauccaggagcugguuuuuugaaaggaucaacaaaauugauagacugcuaacaagacuaauaaagaaaaaaagaagaaucaaauagacgcaauaaaaaaugauaaaggggauaucaccacugaucccacagaaauacaaacuaccaucagagaauacuacaaacaccucuacgcaaauaaacuagaaaaucuagaagaaauggauaaauuccuggacacauacacucucccaagacuaaaccaggaagaaguugaaucucugaauagaccaauaacaggagcugaaauuguggcaauaaucaauagcuuaccaaccaaaaagaguccaggaccagauggauucacagccgaauucuaccagagguacaaggaggaacugguaccauuccgucugaaacuauuccaaucaauagaaaaagagggaauccucccuaacucauuuuaugaggccagcaucauucugauaccaaagccaggcagagacacaaccaaaaaagagaauuuuagaccaauauccuugaugaacauugaugcaaaaauccucaauaaaauacuggcaaaacgaauccagcagcacaucgaaaagcuuauccaccaugaucaagugggcuucaucccugggaugcaaggcugguucaauauacgcaaaucaauaaauguaauccagcauauaaacagagccaaagacaaaaaccacaugauuaucucaauagaugcagaaaagggcuuaguuauugaugugaauagcuagacacacagaucacaagaccuugagcugacccaaggugaagauugagaguuggcauuaagccagcauugacaagggggcuguauauccaugacaagguggacaggugagaaaaacaaaacaacacaaaaaauccucuuuaucuucaaguugauauaaugucugucuugacuuugccuuaaacagagggggaaaaaaaaccccuaaucuuuucucauaauuuguaacuaagcugucuacucacacaaguugugguuuuaaauuuacuucaccugugguguuuggaagacuccaagcuaaugaauuaaaguaguuuguguuuauagcccccaagggugccugccaggaacaaacauuaaacuucuguagaggaagcuacucucaaaucuaauuccucgggguucaugcagauggaaaucagugaaauaagaguucauacucuguguuauauccauuaugagugagaggcagcagagaaaaagaauaaaaacagaauguacccuuaaggacuuaaggaucuguuacaaaauguaaaauaacuaaaguguuuaaaagaaauaaacucgcauuuuuuaaggauauauacaacuuaguagccagaauaauccucccaguugagaauacauuacuauucuagaguaaaagcagugaauccacacagcuucaaaccuaagcauggcaggagcccugguaugucagggucaaugcuggccgucacccugaggcuuuuggcuaaacccugggguccuugggcauuugaugugaugauugugcaggacauaaaggacagaaagcccaagccuauuuaagaccugcaucaucauuagugaacaaaaaguuaacuuuacuaaacugaaaagaacagagaaauuugcccaucuuaacucuggugcugguuagagggggaaaguaaucucccucgagaaugugcaaccaaaaucuugaugcaggauucuggucagaguuuacguuaccuuuguagucugaaaaacccaaauagauaaaucauuuuaaguuggcuguggauuacuuguguccacagcacacaaacaaaaucagagaucuucuuuggaauaauucagcuuuaaucuagaucuuaaagaauucccauaaauuuccaagaaaagugaucguuucauugucuuaacaguuaaagaaauaaagugaaauuguagaaagggaguaagaggcuaucaagaaugaccaagcagauuuugaagaagagcaaauggaacuucuagaaaugaaaauguaguacauuauuaaaaucaaaaaguggucaggcacaguggcucacaccuguaaucuuaggaauuuuggaggccgaggcaggaggauugcuugagcccaggaguuaagccugggcaauauagugagaccccaucucuaccaaaaauuuuuuuuuuacaguuagccaagcaugguggugcacaccuguagccccagauacuugugaggcuggggcagggggaucgcuugagcacagaagguugaggcugcagugagcugugaucauaaccgcuguacuccagucaggacaacagagcaagacccugucugaaaaaaauaaaaauaaacugcauggguaaauugagcaguagaaucaauguaacugaagagagaacucaugaauuaagaaagcuaggaagaacuuauccagacuguaguacagaguuagaaaauaugacagaguuguuaaguuacaugcaagauaguaaagaaauuuaacaugucuaaugggaguuuaagaagaagagggagaauggggcagagacaauauuugaagagaugaugguugggaauucuucauaauugaugaaagacacuaaagccgggcacaguggcucaugccuauaaucccagcacuuugggaggcugagguggguggaucacugaaggccaggaguuugagaccagccuggccaacauggugaaaccccgucucugcuuauaauaccaaaauuagcugggcgugguggcucgcaccuguagucccagcugcuugggaggcugaggugugagaaaugcuugaaccugggagguggaaauugcagugaaccgagaucacaccacugcacuccagccugggcaacagagugagacucugucucaaaaaaaaaaaaaagacacuaaagcacagauugaagaaacccaauaaauuccaaguaagacaaaaauaaaaaaucugcaguuaaacauaucauaguaaggccagguacgguggcucacgccuuaaucccaaugcuuugggaggcugaggugggcugaucgcuugaggacaggaguuugagaacagccuggccaacauggcaaaacccugucuccacuaaaaauacaaaaacuagccaggcguggugguacaugucuguaaucccagcuacuagggaaacugaggcacgagaaucacuuaaaccugggaggcagagauugcaguaagcugagaucacaccacuguacuccaaccugggugacagaguaaaguucugucucaagaaaaaaaaaaaaaaguaaaauugcacaacacgaaaggcacagaagccacuagaaaaagaaacuaccuacaaaggaaagccaaagauuaacugcaaagaaaacagggaaaucugaauagucugaauaggaaggguggagcauaucaguguucauguccuguuucugauuuuauacuauagcuuuguaagauguuaccauugagagaaacugcauaaagaacacacaggaaucuuaaaacuuaaaacugcauaggaaucuauaauuaucucaaagagguuuaauuuuaaaaggagggagcccuuaaaauuacuguaucuccucuaaagugugauuuaauggcugcguuuuucauaauauuauuuaaagauaguaaagcaucuuuaaaaaauuaauccaaaagaaggaaacaaaggagaggauaaaaggaaaaugaaaaaucaagacaaaagcaugcauauaaaaagguaaaaauagggcgggcaugguggcucacgccuguaaucccaacacuuugggaggcugaggcgggcagaucaccugagguugggaggucaagaccagccugaccaacauggagaaaccccgucucuacuaaaaauacaaaauuagccggucgugguggcacaugccuguauucccagcuacucgggaggcugaggcaggagaaucacuugaacccgggacacagagguugcagugagcccagauugcgccauugaacuccagccugggcaacgagaacgaaacucugccucaaaaaaagaaaaaaagaaaaagaaguaaaaauaaagucaaauaaaccaagcuuugugguuaaaugagaaagauugucauacuugauuuauuuuaaagcucuagcaauauaauauuuauuuuuuauuauuuuuaaauggagacagggucuugcuauguuucccaggcaggucucaaacucuuagccucaagcuguccuucugccuaggccucccaaagugcugagguuacaggggagagccaccacgcccagcccaaugugauauuuaaagagagaaaucuaaaacuuaagacuacagauagaagacaaaggaucaguagaagaaagcuguugaagaguauuuaguaacaaaggcaaaaaaaaaauuuguaauugaugaaagacacuaaaguugggcaugguggcucaugccaguaaaagaggauugcaggcgugcaccaccacgcccagguaauuuuugcauuuuuaguugagacagucucuccauguugcccaggcuggucucuaacuccuagccucaaguaauccaccugccucagccucccaaagugcugggcuuacaggugugagccacugcacccagcaaaauuucaguuuuugaaaauacuaaucaaguaggcaaacuuuugaaaaaugucaauugaaauacagaaaagguacaaauuaacuguuaagaauaauaaauuaggcauaaauguggaucaguagaguuuuaaagguaauaggaagccagguacaauggcucacaccuauaaucugagcacuuugggaggccaaggugagaggauugcuugaggccaggaguuugagaccagccugggcaacauagugagacccccaucucuacagaaaauuuaaaaauuaauauggcguggugacauacaccuguagucccagcugcucccagcuacuagaaggcuaaggugggaggauagcuugaaccugggaagugaggcaucagugagcugugaucgcaccauuccacuccagccuaggcagcagagcuagacucuguaucaaagaaaaaauaauacuuuuuugaaauuaagguaagauaaaccuaugacagcuuuguuaacaauucaaaaacaaguuguacaaguuucaagaaaacccaaaacuguuucuucaaagaaacaagcaaugugaguaguuuuaagacugcucauuaaacaauuugaaucaguaguuaaaaguucauuguucuauucccacccugccaaaauaaacuuaauaaaaauggaaaagauacuccaaaaauuccugccaugcucagaugguuucgcacacaaguuguaucaaagacuggauaauugcauugucaguuuaucaguggagaugcaaaaaaaaauaauaauaaaaacauuagguaauuccagucuuacguaaacucagagaauaggaaaagagggaauacuucccucacugguuuuaugcagcuaguaugaccagaguaccuacaaacauuguguaugugaguguguaugucaugaccacguagguuuagcccagguuuaauuuuucuucuuuucuuuuugagacagagucucacuuugucgccuaggcuggagugcaguggcacgaucucagcucacugcaaccuuugccucccagguucaagcaauucucgugccucagccuucaaaguagcuggcauuacaggccugcacaaccaugcccaacuaauuuuuuguauuuuuauuagagaugggguuuugccguguuagccaagcuggugucaaacucuuguccucaagagauccucccaccucagccucccaaagugcugggguuacaggcgugagccgccgugccucaccuauuacuuuaaaauuuauuaauguaguuuaaauucgggagaaaaacccucuuaucuaaaaagaucaaaacaucaaaaaauucaaacauuuaugauaaaaauuguuggcaacuaggcacagaaaugaauuuucuuuuuuuuuuuuuuucuuuuuuagacaggguuuugcucuuuugcccaggcuggaguacaguggcacgaucuuggcucacugcaaccuccgccccgguuucgagagauucuccugccucagccuuccaaguagcugggauuacagacaugcgccaccaugcccagcuaauuuuugcauuuuuaguagaaaugggguuucuccacguuggccaggcuagucucgagcuccugaccucaggugauccgcucaccuuggccuccuaaagugcugggauuacaggcaugagccaccgcucugggccaaauuuucuuaaccuguuggcagauacacuuucugugaaauuucagaaauucuuuuuaaaaaucuuguuugagucaacagugcuuacccucacugcuucuauuuugcauuauauuacaugaccaagacaccacaauaaaggcaaagaaguaaaagugaauuauuugaggguaauaagcugaugaguuauuuguggguguuauucuauuuagauaaccccaaaucuguauacaaguuuagcagaauccuagaguguuaagaucaaaauauaaugauuccauucuuaccugccaagaacagaaaauauaauuuaauaaauuauaaaaauaaagcaacuuuaaauaagucuauaaaaauugaguaagaacuuugaaaaaaugaucagacuuuaucaaaagauauugacaaaguuaaauaaacauagaagauacaaugaaugagaagaccaauauuauaaagcuuuuccccuuaacccagaguuucacauaaugccagucaacauuucaacaggcguuguuauugugucugcacauacauauggaagacagcaaagggcuuaggaaaaggcgaauuuacuuguccugccaauuagcaggaugucuuuuaaaaaaggcuaaucacaggccggggacaguggcuccugcccguaaucccagaacuuuaggaggccagggcggguggaucacuugaggucaggaguuggagaccagccuggccaacauggucagauccugacucuacuaaaaauacaaaaauuagccaggugugugguggcauguuccuguaaucccagcuacuggggaggcugaggcaagagaaucgcuugaucccaggagguggagguugcaguaagccgaggucacacaccacugcacuccagcaugggcgacagaaagagacucugccucauauauuaauuaauuaauaaauuaauaaaaagcuaaucacaguauugugaugucguguagguauggacacauugacuagugggacagacuagaaggcugagaaacccagacacacauaagugcugcuugauaaacaaucaggcauuuuaaucaguaagaaaagcguuaaguaaauuuauuucaacauugguuaguuauauggaaaaaauaaaguauauccguucuuuaucgauacauaagugacuuuucacauaaaauauuagcaaaauaguaagcuuuagaaaaauauagaccuuguguuauaauuuaaaaacguucuaaauauguaaaacaaaaccacagaguuauugguugugaaaacauguauuuacaaaaaaaaaaaaaaaccaagggaaugcugaacacuggguuuaggaucauguuaccaaauguugggggaaaguagaauacgagagguuuagcaaagagaguuuuuauuuuuuaagcuaaaugaguauacauguucauuuaaaaaaucuuuuugugaccuaaauauuuuauaaugaguuuaagaauuuaaauucaguuguuuuuuucauguucacuuugccuuugugauuugccuugauuuagcucagugacuuccuuaggaaaaucagaggucaucacucauaggcuucccagucagccaggcacagguaucuagaccaguagugucacauugaacaaauuaauuaauuucccuguuucucgguuuucucaucuguaaaaugggagugauuacuuuauaugcugugaggauucugaauggacucauauauaguuguuaguaaaugguauagcuuuucacuucuguauagauuauagaguuuauuuauaaguuuuuccuuaaacugaaaagucauugauucuuaacuaguuuuauuauuuuuuuaaugccagcuuucuuucauugcucuuuaccuuccuuucuugaaacuuuuucaagcuuuaggauuugcuuccugcauuacuucucuguaagcuuugucgcuuguggggguagaagugauuuugaacaacauaaaagccagugggaguucaaguugguuguguuuuuccuauccucauugaguuacggccggagaggcauuuugugcucccucgaaaccaaaaaggccuauuuuuuuuuuuuuuuaaaguuuaaucgcuaaucauacuagucuggucacuaaugauuuuguguuucugaauucauuuuuauuuuuauggcuucgugguucaauaauugcuguaauuuuuucauaacugccuacagcauuggauuaucuuugggccaucauuucucuagguacuccuaauacugauucuuuuuagcuguaucucucuuuuuagcuuuaucuuuucuuuaucuuagaaacuuacugacuuacaugcuuuaaaaauagaaguuuaaugcugcauaucaaaaacacauuuauucacuggggagcuauagcuucugugauggcugaguuaagaagguagacuuuuuuauuuuggguuuuuuuuugguauuacucuuauuuucuauaguuuguuuuuuacagugacaguaaauauuuucuguuuuuggaaauuugucagauuuguagacaauaaaaaagaaaauuuaaucuggaaaaaauuaugggaaauguccucaaauggauaucacuuccuugucugaagagauaacauacuaaaauagcuggaaccuaaacagcugcagguccauggcuccaucucaggaguucauccuguguucguagaacaguugugcguggaucauaugcgcaugugcgcaugcacacacagggagacguggcagaccucguguggaggaucugcucacagaagcuguugcuccccauguaguuggcuggucagugccccucuuuuggggcauggcuucuuuucuugaggagguggcacuuacuggaaauguugugaaacacuguuuuugcuguguccuccaggucggauccgcacaagacggcaaagcucugggagugccaccaacgucgccucuacaccugauaaccggggccgcagucgcgcuaaagugguuucacagucccagcguaagaaacauauuuuaugcucuugcuuaccucaguuuuauucaacagcucauucugcaguugaacauuuuacaaucucuauauugacuucagagggaaaaacacauuuuuuguggcucugagauacugugaguaaucuuacuguuuguuggguaagcuuaaaaaaugaaacauuucaggcauacauuugucuccuguccaggugauuuacauuuuguauuguuaagcauuaaacauuaaaauguaguuuuucgcccuccuuugaagccugucaaauuguagcuuaucuguucugugacucauuuuugcauugauaaggaauccuucugauguaauuuuagaacaguacgugggcagaaaacuauuaaugcuauguucuuuccagugguaaauaaguaaauccauuaaaagcucucccccuuuaauucugugcucuaacauuugcagcccgcaccucucuuccugccaugugggcucuugcuuugccuagcugcuuccaugauugcgucucuguauaugugaagucaguugguuuguuagccuuagccaugaaagcagccacagcuggaaugaauuuauucuggucacacuucagauccucacuuggugucucacuuuccagccacacauaaacuuuaaggggcccaccuccucuuuuaaggggcccgccuccucucuaugcaugucgaguagagcuggguagcagagugcuccugggcaaggugagcgugggaaggaagagucuuccuguccccaggagcugcaugcggucccacagcacagcacucacuagcugacauuugccugccuccuuuguggcccaaggaacugucugucuguuguagagagugaucagucugcaccaaaccuuaagagcucccuuaguauagaaaauggccuuguucaacaccuucugaauuuaaauucuuuucccuuugauaacugcaguccucauguuauauaauuucugcaaagaaagcagaagaucaguuauagugcugccuuuggugaggcuacagaaccuuccuguggccuagguuguauuguguagugugauacacuacaagcauggguuucagugucagacaaaacuggguuugcauccuggcuccagugugauguugggugagucuuuuaaccuuugugagccauuguuucguugucuguaaauugagugauaacaguucccacccucaugggguuuuaaugaggauuuaaugagcauuaggagccuaacauguaauaguuaaauggacgcaagcuuuauagucauaguuguuucagaucagcagacuuccauccuagcugaaguugagccuccuugaucccugucuacuucaguagguuuaggaaagaaggcuaggaauggauuuacaugaugagggaugcaguucaggauagauugaguccguuaagaccaagaaugcccuccuuaguguagaacuuaaacuggauuuucauucagauccagggugcagguguagcccagaagugucugucgugggaacaacuucuuggcucugguuauucuguugaacccuagugaugccuggagacacaaaaggauauuugacucauacauaugggucaaauuuuacugcaaaggaauucuugacaaaaaguguucaaaucucagaaucuaggucaauauaaugaaauuaagccaaauaaaaaaugccuaagcauguaauuuugcaguguugcuucccucuguggggguugaggguugaacaguauuuuacauauuucuuucuaaugcuguuuaucaacacuggggucuuugggguucccugccccagcuaggucaaugcuguaauuuucucuccuauauugcagguuuuaggaauguguagguuaccuuggcagguggugaagauuacaguucuuucucuaauagugauuagggugauaauagagcuuuaauuuuucagucuuauaaaaauacuguaccuagccuuggggcuccccuuuuaaaauuccuuaguuuuacuucacucaccaaaucguacucaggaagagugaccacacuagccagugaucaagccuauaccuuaagcuuaugcauauaaauuaaauauuuaaaaaauuauuuuaauaagugguaaaucuaaguguauauaucacaaauguagauauacuaguauucauaguccugauuuaauacuaaguaggcuucauuaauauuagauuuagggcccuuaauaauuggcauauuuuaaauauuugagguuuaugggaagucaggacaggugaaacuaguuaacagcaguuucuuucaguuaguugauguuuauugagcacuuacuaugugguaagcacuuuugaagaugguagugauacagagaugaguaaguuacaaucacuucccucagguugcuuaaagcuagaaagcagaugugagccuggcacauuguagguuugaaaguguuuuaugaacagaucugaaauaaaugcuaauguagaaugacaaagauaaacauaaguacaaaaauaggaggaacaaguccuaggaaauauagcuguuuugcuaauguauuugugaacaaagaccuuuguguuguguugcaugcugaccuucuguauuguguuauugucuuuuaauccacuuuuugccuguccuuuggucugcucucauaaucaaggauccagaucugcuaauccugcuggugguaagccauuucucuucuugccuuuuuuuguuguuguuguuguuggcauucuccccgaccccauguuccuugcacaauauuaauuucucucuuuauuguaagcuuaguuaaucuuucugcguuuuucuuuguguucaaauucuagaguuugaaauggauuucuuuccccuuuauacauaguuuaauaguuuauauagcucaaauuuuauggguaaaauuaauagguccugagacaaauucuucauugguuuuuauaaugauuuuucacuucaauuuuuaguuaaaucauuauaaacuauuaauuuuugugaguauucaccuacgugguucauuugaaugauggugguuuugauuuauauaauauguauuuuuaaauaauauauauuuaaaauaaacacacauauaaauuuacagguaaguguugcuucaaaugcuuucuuccucugggucauucuauucuaguacauaguaaauguauacuuuauauuuuagaauguauugccuucucuacuuagggagguaaucugucaaugcaaaugauugccauuugaguguauuggugugaugcuuaaaauuuuguuguuuccucugagagagaauuaggucccacaagaaauaguaauauauguaucuagcuacuuaccuauuaauaaaaauuaucagccauauuauuuguuuuuaauuuccaguuuuauugcauacuucucagagaaugugguccauguuauuucuacuguuguagauuuuuuuuugagauuuacuuugaggcuuaauacacaauuuuuauuuuuaauauucauguguggaaagguaaaaagaauauguguucuaucuguugggauauauauguguaugugggaaguguguguuuuuauacauacauauacacacacagacacaauuuugacugcucugucaauuucugugagguauauaguuucucaauauuauuagucuuuccgugaggucuuucgguaaguauggcuuuuuccauuucuuccuguacuuuuaucauuuuuuaguuuuauauuucaaaacuauguuguuuggagcauaaagguuugugauuauuagaucuucauggacaauuauucuuucauaaauauuaaauauccuucuuugucuuuuuuaaaugcuguguuuuauucuauuuguuuuuguuugugguguauuguuugacuuuuaaaaauaccagacagcugaauuucauuuuauuuuacuuugcauuuucuuuucuuuucuuuuuuguucuuuuuuaagagacagggucuugcucuguugccaggucugaagugcaguggugugaucauggcucacuucagccuugaccuccugggcucaagugauccucccaccucagucucccggguagcugggacuagaggcauguaccaccaugccugacaaauuuuuacaauuuuuggagaaguggggucucccuguuguugcccacacuagucucaaacuccugggcucaaacuccucccaccuuggccucccaaagugcugggacuacagacaugagcuaccagcccaggcuuguuuuaaucucuuuuaaaucgaugaauuuaauccagccacauuuauuaugauuaacuaauauguuugagcuucuaucuuauuuugugauuuuuauuuaccagguuucugguuauuuuaucccccuacucccuuuuauaucauuugucagauuaauagaguuuucuuggauucauuuucuguagcuaaugcuaagaaaauuguuauaguucuacuucugcucuucuagcagugacaccuaaaauuuuuaacauaaucagcucuuacagaauuaaaaaaacaaaauaagaauaaacaccuuugugacauuuguaguuauuuacuguggaauaaggaggcuauuccaccaguaauucuucuaaguauauucuuuuaugauauucaauugucuuuuaugcuccuacauuuaaaaaaauuacuaccaccaaauaaaaauuuauuuuuauauaaaauuguguauuuuagccaaauuaauguguaaaaucuggcuuuugaaaguauuauaguucauuccuacauuuacaucuauuauucauugucauuuugcuucacuuuuagcuggcagccggucaaguuccccaggaaaauuguugggaagugguuaugguggacuuacugggggcuccucacgaggcccaccugugacaccgucuucagaaaagcgaagcaagauucccaggagccagggauguagccgggaaacaaguccaaaccgaauaggauuagguaaggauucucaaagaucuuggaauaccauucccagcuuggucauaguuuugauuauaaucuaaugacuaugucuaauguaggaaauauagaucuauuuuuugaacugaggaugucacuuugccugggugugcuuuauacagauuauggcauauugagguuucaguuagaaaaauauaugggacuuaacccuucaaauugaugggaaggaauuaugucauuguaggcuuuuguguuuugcagucauuguacaaagcacuggaauuggggaaauagcaggguguuucccccacaauuagaagcaguguugcuuuucauuuuccuuuuacugauuagcacuaaguagacauuaaccuauaugaauuuuucaaaaacagcauuuaggguccacauuuauuuuaauucugaucuucucuaaucuaauuggugaaacuuauggugaaaaaauaugcauaguuacuuuugacauagauuuguuuaagcaugaaagcuaggaauugauuaaaaccaauacauaauauuuaguuuuguguuacuuaguuucuuuguaauaguguguagaaucaugugaauuacugucagccgcuuaaauaccuuuuguuccauuuaaaaucuaauucauacgcuaacuuuuuaaauauaaaauuuagaagucuuugugauauaauacaaaaaaucuaaauucauacucuaugacuucuuuacuuccuaaggguaaaauguauuaauauaaaaucagacuacuguauucuuaaauuguguuggcuuaucuuucucauuuauucauuuaucucaucaacaguguuuacugugauguaccaggcacuuuguuagaccugagaauuagaagauacaugagauagauuuagauucugacuucaaaaagcuugauaucuauuggggagagguggaaauguaacacaguaugacgaauacuaugacagggugcuucacauaaucaaaacuaugaccuaaaaaaggaguaucuuagacccuuggccaccccagauuucuugcuaggggaggcugcccagaguagauucuguuuucaugaaguacaaaaugggauugguccggguggggagaugaggggaaagguuucuagaggagagagaagcaucugcagaagcagucaggcaagaggcagccacauguaauucauuuggcugcuguaaaggaagucagagugggugggaguugggggcagagacugguagaguccagcucaugaaagucuuugaagcccaccuuagcuacgagaaggcaggagaagauauuuaagaauggauaagauuugauuugaaauccuauuuccaaagcaaguagaaaguauuucuugguuuuaguaaaucucuaugaugccaacuuuuuauuggcauugcguaguguggucucuuagcugacaaguuauuuggguguugauguggauacaaucauagaaaaggucacagcuggaauaucugaauuuuaugucugaugcuguaacauauuuguguuuggaaaaugcauuugauuuuaaaucuagguguuauguuuuagcugucuuuuuccauaguuaauuguuuaaguuuauaggaugucuguuugcaauccauguuaguuuuauacauuuaaagauucuuuucuguuuugagauuuuuuuuccuuuuauauuauuaaagaugccauuuuaaucuucuucuugaaauugggaaauaacccaacuucauuuaucuaacauaauucuaauguguuccaugguuuuaacuaggaaguuuguguuguguguaguugaaaagacaauauuuuauauguuuuuaaaacaguuauuauggagcaucaguaggaacuuaagccuguucccuuccaaagaguuauuugaaauauuauuugaagaaaguuauuuccuugaugcuaauuaaagggaucaguuacguguagagcuuugaggucauacauauaguuuauauuaaagaagauauuuucuuuaaauuuccacacauugcgagaauauaugcauauaaagaaaucuauaugaauaaaauguauuuucauuuuuuuccugugguauugcuuagagauugcauuuaauaggguggcagacauaauagcauuauucaguaauagauuauauauuacuauuaucauuuaguauauacuggauauaugccuguguuucuuaacauuugacucauuguauagcaguuuucaauauaauuguugaaaaaaagaggaggaacaucuuuuaggaauauuuucuauaauucccaaaccaacaaauucaacaguuuuaaugauagcuaaacuagguuuggaauuugcacugagaauuaaucguaguuaucuacaaaucguguuugguucaacuaugccucuuuuuguuugaaaugauacuucuuaacaaaauuuucuuuuuucauuuguuuuaaaacugaugccaaggcucuucuuuggcauuuagauuuucuuaagcagaacagccuguaauuccuauuaaauauucaagaagcaaaauauaucccugauacucuuuuuucuuggugauuuguucccucauaagcuaucugacuaggaaaauguauuuuuaaguuguuuuauuucugugugucuuaaagauaauacuuuauagauacaauaaagucacauaaaucacuaguaucuauagugauuauauuuuggaaguuugcccuuguucccuucucccacuccucuauggaaaggcuaugaaaacacauuugacauuuuugcagcuuucauucuguggauguguauuuuaaauguuaagguuuucugguuaaaauacuuugaaauaauuaaacauuaauaauaguucauuucaacugugaaauuagacuacugucuaagaccaagacaugaaaaugucuagaccagagagacauuucaugucuuuaacuucugguuguuuuuauuaauucucuuauauucugcuuuuaugaguccugguuggacccuuccuuaagauguaaaagucaagauuaccauuaaaacacugaaguaggguagagugucuaucaagaaauguaaaccaaucaaauggguaucuuacggcuucccagcauuucauguaagcagaagaccccagagguaccuaggaauacugcuuuuuuaggaaguucacaguacaaguauguuuuccuggucucucccucuuaugccuucucuucuguaacauauuuucacauagaacauuuaguuuggcacuuaaagagacaagacuauuuuggugggauuuucuucuuuuaguuuugaucaccuaauuaauucauuuauaaaaagucauuuauauacuuauuuuaggccgggugcaguggcucacgccuguaaucccagcacuucgggaggccgagguggaugaaucccuugaggucaggaguuggagaccagccugaccaccauggcaaaaccccaucucuauuaaagauacaaaacuuagcuggaugugguggugcgugccuguaaucccagcuacuuaggaggcugaggaaggagaagcacuuaaaccuggaaggcggagguugcagugagccgagauugcgccacacauuccagccuggucaacagaagaagacucugucucaaaaauaaaaaauaggcugggcacaguggcucacaccuguaauccuagcacuuuggaaggcuaaggcggguggauugccugagcucaggaguucaagaccaggcugggcaacauggugaaaccccgucccuacuaaacuacaaaaaauuagccgggcauggcggugugcaccuguaaucccagcuacucgugggacgagaaucacuugaacccaggaggcggagguugcagugagucaagaucacaccauugcucuccagcccaggugacagagcaagacuccgucucaaaaaaagaaauuaaauaaauaaauauacuuauuuuaaauccuucuuuuagauuagucuuucaaaguaguaguauaagugaguuuguauuucucuuguauuuuaaauuauuuaacauuugaaccauggaugucaccacuagauuuacuuugaugaguaaaugaugccaaagcucuugagguuuaggguaacuauggccauauuuucacaaaaucauaaacggacaauuaguuuucucuauacugcuacuagccauauguuaaaugagaaaaucagcucgaaugggugaaugaacucucucugggugaaauaccggagggggguaaaccuuguuaagaaauuuaugcauacuguuauuucagaucauaucuguuuacugcuguuaaugcuuuuuauugucuucacaaaacagacucagacgaaaaagagcauuuuuuuccccguuguucuagcauguauaugaauuuaaggaaggggauggggcuaggaagaauucagaaauaaucaggcaagaacuauuaagaaaaugcucaacuaagcaugaacuuguuuaaacaacuaucaagaccuuuuauagcuuuuuuauuauuuguuuuggagugggcaguggaauacgacaaaauuuuuacaugugcucuucagcaagggacuuggaaauacuuauguaugugcauuaucucacaguacccuucucauuuaaaaugaggggacguguucuuuuuccucguuuuccuaaugggaggcuugagacccaaagaggccaaguggcuggaccagugagauagcauggagcuggaauggucauuuuuugacucagauuuggcauugguucucuaaggaugagugguauugcuguguacauucuaggaaaguuguccguauugguagagccaguacacacgcucccuaguuuuuuaagcauuuaauuuggcaucuccuuuugucaucauuguaggagcuguuuagaaugucaucaagaauugcugacuaaauagucacuacuacuuugagugaaaauucagugcuuucacaucacucuggcaaaauuaaggagagcuuaagaauuucuggugaacccccaauaaagcccuuuaugucuagauuguugagauuacguuccugugcuugacuuuuuuuuuuuucccugagcaguaguaagcauuuggauaucacuuaaaugccuucagagucuaguuccacucuaguacugagcagcugagcacaauagaaaguuggcuuuaguuuucccuuucguauucuuuuuuuaaucagggaguguuaugguucugguuuauaagacauucuuguuauacuuuggcuguauaauaaaucuuugcucucaaacaauagacuaugcucauugcaguauagaaacauacuuguuuugauaucagugauucaaguugauuguuucuaaaaugucuugacauuuuuuccaguccauccucucaggauggaaacguauauuguccccaucagcuauuacauuaggcauuccaccuacauguauucaguauacaagguuguuuuggaguauuuucccaguaauguauuuccauuuucucagauggagaaacaaggguauccuggucuuuucuaagcuucacagcccaguuauuaugagacccugggcuauucaugcaauucugucuuguagucucgguguuuuauaacaugagaaugauuaacuuuagccguagauaaucagaaaguuauuugcuguucucaggucaguggagagaucuuuccccaaauacugagaguauugaucuacuugcucuagacacagugugaaagacugggucagugguggugcuugguagagcacaggcagaucuuuucagauuuucauagaaaaagcagggauaaaauguugggaucaguaaaggaaaggauaacaguccccacuuuuuauaucugcugguuucgagaauuggauauguuugaagcaucuacacacuuacuuggaguggguaggcucucucucugguugugucaacucuuauggcuucucuuggugaagauggccagccugggagcagugagcccucuuccuuaucauuagguaaguucauggacuucagugaccagugugguuauucuguuuguuaauccaaauuaaauuaccuuucuaagaaacaagugcauaugaauacagcuuugguuuuuuguccucuuguugagaaguuugcuaagcucauaaaaacugaucguuucuaaaaggcuuuugaucuuguauuuucugaugacaguuuguuguucagaaagauuucuuuucacuucuuacauuuagguguaauuucaccuucguacugaaauucacagcuuucugagguauugagcauaaucacauuuuacccaaacccucccccguuggcacgucagucagugagaccucagcauggauagguggcucagucaucagaacuccccagcgcgaacaaugucguaauuacauuaaccaaaugugacugacauuuugugaguuuaucugucuucauuaaacuuguucaccuucucugaaacccuucaugcugcacgcuagcacggagcagccguaucccucgacccagcaugagucaggggugcagccgcgauaccagccgugagagcagccgagauacaagcccugcucggggcuuuccuccacuuggugaguacacguaggugcuggcugaggagcaaagaguuccuuucccugcuuguccgagacacugcuaggcggaaugaccugcuuuuccuccucuacuguccuugugauccuuucuucuuucuuuccucuuccuuaguuaccccuugucccccucugcaugcuugaauuuuggcaacuucgaauuuuuauauauuagaggaaaaaaacaccacuucacucuguacuguugucauugugaccacuugcucuugggcaagcccaucugugugguaauuucuaaccuaaggcaaaacucagccgaaguuaguugcugcuuaaaaguaaaguuaauccaaaguuuauucuuagucauugaauuuuuacaauuuaucuuuaauuuuacuacagaucagucuauauguaauuuaauucaaagaaggaacaaaaguacaauagcgauaauguuuaguaaaguaaagugaguuuucuuuuuagaguuaauaguccugccaucucuaaaauggacacauaauaaacccuuuuuaguuaguauaaacugucgauccccaaaagacaucugucaacacauacuuuugugaaaaggaauauuuuguauucuucaauaauuauuuuuggcugcuggccauguuaagugcuguacagauguccauuuuccucuugauaagcauaaacguagaaaucauuuuauaauacuuagacguagaccugaaauuauguggaucuguggacuccagcagucuguuaauuuuaacuauguauuuauguaacuggucuuuugaaaacuauacaugccacuacgaaagagggauguuaaaucaaaagcauaaggucuuaauauuugccucuaccuagccccuucuaauguuauucacuucuucugaucuuuuuucccuaaucagugucgguaaucaaaaucuagauguauuucuuuaugacccauuguccuuuaugaaauucugaaaaagaacagguaaccagaugccaaagcccugcuagauggucccugugauuuagcgaggcaauaccuguugugagguguuccaccuuguuagcaugagcccuugaguggggcaccuuaccuauugcaugucaccuauuccacagcagucugaagcauuacagcagaauucucaauaaucagagguggcaaugauuuuuuuuuuuuuucugaaugaacuggugauuuuuccuuuuaaauuaaggcuguauaucuuugcauccuugcucacuauuugaccuucugaacaaccuauuuaugaguaaaauucaauccuuuauugguuauuuugucucuuagaagcaauucaguguuuuccuuucaaauauguacuguuauuuuugauacuguccguggaagcauccuuuggaaucuggcauguggagcaggcaaggugugcugaauucuugagauccuaauugaacucugagugguugagugaaucuggucuguuuuguacauuguuugauuaaauggaucugcuuagcugucuuggugacaacccagaauguugaaauguguaauugccacuaccaaggcagaaggcguggguccucacaggcucuagcaucagcacgucuucuguuguggucagggcaauaguuaaggucuucgagcuaaaauuuuuguaucaugcuuuuccccaccuuggguuaaaccuaacccuaaaacuuauguccagcaagaacaacagcauugcucauguguacacacaccguuuggagcagucagcaggcauaaugccuuguggucccuguucauccucugggacagguauuaucaucgucagagucuuaggcagaauaagccacuuucucaagaucaugcagcuaaaugguggagccaggguuugaauucagguuugacuucaagccugccucauuuggaaguaguuuggauaauucagugucuuucaucuguuucucgaaaauauauuaaaugcuuguucugaggcuucuuggggucggggguuagaagaaguuucugagucauuuauuuccaggcuugggguuaggaccugggaacucaaagauauaucccagaagguuguuguccucaggggagcuuacuacacauccucugaagguuccuucuuuagcucauucauuuuaauaaucucuucccacccuuuuuggaaauuagugagauugugugucagugcuucuuugaauccacuuacguagccagcucuuuaacaacaacaacaacaaaaagaaugacaguacuuauauucuagugaauauauauuuuuaaguuugcauuuuuauuguuuuggaccauuuugaugguaugaauauauaugguuauggugauaauuuuugauuaagggaaauuaagggcucuagggcugcuauaaauuaggcuuucacauaagugggucuaccuuggauuccaguguuggguguuaacuugugaaugugacagaggacucauggcaugacagauuuuuuuuagaauauucuguugaaacugaacuaaaggaccacuuuuuaaggaaccuacauaucagguacugcuuaaaaacuauuucagucugaacuaucaagauagugaugugcuuguacaaaauguauaguuugcuucagucuuaagauauuuuaccaacuuccuuauuuagggaaagugauaauuuuauaauauucuuugccaauuuaguuuuaauuuuugugaaucuugagaaagggauauuuuccuuuuuuugcaagcugguaaaaauugccagguaaucuuugcuauuuaauaccacauguaccauagagaugcacauuucauaaaguaacauggaccuuaaaaauuauauugaagaauuugagguauugauauuuuaugacugaaugugagagcguuaacauguacagaauacucuaguaguacagauaaaauguagcacugcuuaguauuauuuuguuaaaccuauaaauuuucugugguauaaucacugugaauuuuucagaguaaugaauggaagcauauuaucuuuuguuuuuccugagguuaacgaaaagccguauguugcaugaaacuguagucaauaaguuaauguuuugaaccaagucuuuauuucauaauuauuucuaaaaguuguuuucuauccacaugaggacagaauuuagcauguauuucccucagguugaugaaguaauaugcucacuaagaauacuuguuaauaaaaugguacuauaaugucagauuguaaauuugagguugcucuuaacuguuacugccaccaccagcaccacccaacacuacuaaccaauguuuaaguugcuuuauaaucucuuuuaauccacucaguaacucccaagagguagguaccauuaaccauuauuagcaccauuuuacaaacaagauacugagacacagauagauuuaguacuuugcccaaggucaguccuauggcuaguugugauccaacgagcauuuacaauugcauuacugagcugguacucauaaccaguguacuguaacugccucuccaaggaagaucauugaacuuaauacagcuaaauucaaacgauuacacaaguacuaauaauuaggauauggccaggcguagcggcucacaccuguaaucccggcacuuuggaaggcuaaggcgggaagauugcuugagcccagaaguuugagaccagccaggcaacauagggagaccucgucucuacaaaaaaaaacaaagccgaaugugguggcacaucccuguagucccugcuacuugggaggcugaggcaggcggaucugcuugagccuggggaaucaaggcugcagagagccauuauugugccauugcacuucagccugggcaacagagugagaccuugucucaaaacaauaguaauaauaauaauuaggauauucaugcaacagaacaacaaacauuuugacuggggaaaauggaauucuaacuguugaacccccuuccugugauuuuauuuuauuuccguugaaguaacauuaugaacuucuaugcuuguuuuuggugcaugguugcauaugcaucacauacugauaaaacaucucgugagcuaacaauccgucuuacugccauuccgcucugggauguagacggugcucugugacuccugcuguucuucauguugcauauguccauacuggcugauagaggcuucauggcgugaauauaacccuggaguccgaguugguugaugcauacuuaguuuggagcaccuuuaagagcgccuuuguugugccuguguguuuaauagcugugugagagccagcuggccacugugaaguuuggggauuggcacuugcuguccauucauauccagcaccauuucuucucgugagaaaacauggccuuguugguagcagucucugcauuuccucuggacuguggcauuuucugucucugguacuucuguguuaauccuguggguguugccauuccuuuuaccugcagccucucgacgucauuccagguccacuagugcucucuccacugcugaaucuguugggcagucaggugaacaagugcuaacugcaugacuuggcuucuucauauguucuaguuucacacccaugucaacauuuguuuucaucugugucggcuagcacuuggcauguuugcaccucauauuuuuuccccaaugugcuuuaauuuuuuuaaguuauugaauguuuauaguucuguuaauaggcuguagaugcuucauagccuguuugacaacaucguuucuccaguguucauauuuacguuaaaacaacagggaaguaauucccuuccugccacucuguccccaggaaaauaaccaaaauuagguauuauuuaggguuccuguggggcaagggggcauggauaucauccaacagauucuuucccuuccaaagucuuuacuccaaauaaacugucaaauauuaaugcuaguuauugaugucaaguucacauuuuuaagguaccauuuaguuaacagcgcugcaaauuauagcauacauaauuucauauguaugaaaauaaguguauuguucucaaaguuuuauggaaaaacaagaucaggauucagguaaucaagucaggccagagguauccuuugcagccugcaaaccccaaaccugcucucucagcucuguuuagcaauacucaacauccacugguuagccacaguggcaaaaaguaagcauacaguaauacaucaauuuguuagauuuaacugccacuauuuuuauaugcuaacagucccuaaugacuacaauuuucucaauugaguaaggcauaaucuaugaauuuucagaccauugaugguaacaauuguuaccaauucaccgagucugguauuuucucuuuucuucuucuaaaugaagcccccuuugcuuuuuuuguuuguuuguuuuuguuuuuuguuuuugaaacagggucuuacucuguugcccaggcuuggaguguaguagcgugaucuugggucacugcaaccucugcuaccugggcucaagcgauccucccaccucagccccccaaguagcugggacuacaggugcgugccaccauacccagcuaguuuuuguuguuuuuuguagagacgggauuucacuguguugcccaggcuggucucaaaacucuugggcucaagcgauuuacccaccuuggccucccagagugcugggauuacaggcaaagccgccgugcccagccuccuauauauucugauuauguacauuucccugaagauuagggaccagacugagagcacagucauagguauucaucucuuggaaaaaucagacuucauaauaguaucagagccuugagaauauggaacagacuuugcucuggcgaaaacauaaagcuuauaguuuugcuuagauccagauaaacauuuccccuuaagauuugaaauucaaauugucugugauauauaucaaaugaucuauagucacucuguauggcaaagcuguaugcaucuuggaagcacagaauaauugcauuguucuuauaguuuuaauuuuguaucugaaaaaaucuguauauucccuggagcaagaauugcuggcaugagauuuuuuuuuuuaaauuuuauuagacuucguuuuauuuaaguuuaugcuggguaauuuuuuaauggcuuauaauugaauuacuuucauucuguuacucauaagucuccuacuaucuacccuuuuuuaaugaaaaaaaaaacuugaacaaagaucaucuguaaaacuaugugugcauaguaaaucucacauuuacacuuguuucauauuucaacugauauagauaaauguaauuuuuaauggccuuucuuaguuuauauggcacauuaccuuuuaaacauaaugguuaagaugacaguuggaaagaccagcaaaugcauuaaaaaaggggauaguauaacauacaguuuuuguuucuuuuuaaaaaauucaugacuguauaacuauugauuagcaguguuuaaauuuuucuccauuucuguggugguggaagguauaauguuuugaaauugacauuuuuaaaaagcuaaauaacaauucacuuuuuaaguucaccaguuuuguaggcacugucuuguugcauaucuaaaauuuuaaauacauuguuuuauaggaaagaucaauucauguaaaauagauauuagcuucccuuuuauucuagaugcuuccagaauauagcuaacauagagauuuucguuguccaaacgaagucuuauuuguuaacacagagaaaauauuuuaucuuaacauuuuucuuccaaagguuuuuauacauuggacuuuuaaauaagaaauuuuuuacugguagauaauguacaacacacuuaaugaagauacaacuuacacugccuuucuccuaguauaguuuuaaucuccagcacuuccuaaggaagguuggucagcugauuuaaugggacuuuaaaaagugaguuuucauuuccaugaucacaaguaagcuuaaaauacuuguuugaacuacuaaauuuguuuuaaauucuuuggauucuuucuauuauuuguuuaucuguauaaaaauugccauucuaaauuauuugaggaacccagguaaaacuuauauuaucuaaauuuuuaauguucuucagugaaagugcuagauuuuuuuagugauuauuaaauaauuuuaauaaauugauuuuuaaguaauuuuuguugacacaggcaucgugacgaacaaguaucuaaaauuaaaugagcuuaacaauaguuaaacagaagugacacuaauaaaaauuugcacagaaaucaauuuaauacauuuguuucaaauuuuaagcuuuuaccacacauugcauuagaacucuuaugaaaccaugaagcuuucuaauuaguuugaccaaacaucaaggccacuugccucuacagggaaagcuaaauagauuaaaagacucaacucauagccuagcuaccuuuuauaauaaguucccgcuucccucucauaucagaaacuuuucaauaauaaaauaccauguuugaacaauuucgagugacagugcuuuguggcacuauagcauuaaaugugaacagcuuaaccucuaccacugguaaacaagucaaguguaguuaaaauuggcuagagacuuuucaguacuucugucuacuuggugggaagaggcaguaguccuugcaaggaauugaaauaauuugaauuaaagugacacaucuuuugcuuuuguuuuuuaaauagaucgguuugggcuuggccagccaggaagaauaccugguucugugaaugccaugagaguucugagcacaaguacagaucuugaagcugcuguugcugaugcuuugguaagaggcacaguauguauguacacagucuuuuugaaauacucaucugcauuucucucuguccuaacaggaaauugcccccaaaucagguuaugaauucaucuuugaaacucuuuaaaauuguguuaauguuggguaaauuuauauuguuauuguuugccccuuaaacuuuuaccucugcacacauauaagugaaaauggacuuuacagaaaauauuagcaucaaguauuucuuaucugugcucuucaguaucaaggagcuuuugaugacccuggacuucucagaugucauugggcuucuuuuuuucuuuuuaaccauguuuuuuuuucuggcauuuccuuuuuuccauucuguugcuucuguugcuuuacagacuuugauggcauaaccuagacauauuauuauaauaauagguaauagaguuugagguuugaaaaucuugcauuuauucuauuaucuugucuguuugauuuuauguuguuuuuccuaaaucuuugaggaugugaagcagugguggaauauguuuuugcaucauuauaguguaauaucugaaaaacauaaaugaucauggauccuuuaauuuuuuugguuauaccaaaaaguuuccuaguagaaucagcuuguggucagauugcuuuuuaaagaugcauuucagcuagucacacagucucuugcauauucugguuuaugugcucagcauuugaaauggauauucuuuagaacugucugaucacuggccuugcucuugcuguuuuaagauuuauucucuuguaagggaaaaaaguauguaauauccugcuuucagacucugaaguuuuuaauccagccauguuuugucagaucaacauuuuauaguuuauggcuauggugauuccaguuuucauuccuucuugucuugcccucauuuauuccugcucagucagguucuuugacaagugucugugagcaguuugcugcucuccuaauccuuuuccuguaggcaagcugccuggccaccuguauuccucaaccuuauguauagaaagacuuuuuucuggcaggugcuagaguucaggguaacugcucuaaccauggcuuuaggagucaagagcuggaacagaauuaucugaagcuguuuguccuuccaaguugcagcauuuagaaucuguaucuuauuuguucagagacccugggaaguggaggucaaaggggugggaaaugauggaugugaaacccuuaguugagacuuccacuuaaggcagggaaauuucuuaguucuuuaaagaacugcauaagggacuguguguaaaguucuaggaggcggaauaggacuugagaguuugagcuuuggcuuaacuugacuggagcuuuucucugagcucuagcucccauuagauucaugcugcccuuguuacuuuuuguccaaacuguugagucucuccaagugaccugcuucugaagagaaaacacagaaaugguacagaaucuuugccucgcugaauagacaccacggcgccagacagaaugucucagaggaauagauaguagaauuaauggugaccuuagagauuugccucaccgauaugggaaaaguuuuagcaaagaauuacagcaaguuaccagaaggucuucugagacguggaggaggguuaggaaaugccauuuugaaagcauucuuuauuauuauuagcuugauaugaaacgcuugcuaaccuguauuuuugguuugcuaagauauguuuugcuguacacuuuuguugcaagaacaaucccuacauaugcuucugacauaauucucuaugcuuuuuccccauccuucaauauuuuccugccuacagcuguuaggagacuccaggagcaagguaccaguccuuuaacuuuuguuuuacaacuuuauuucuccuguugcaaguauauuucuuuuagaagcuagugaaaaccaaaaaauguaguauagaaauucuggucugaaauaugauuuuguugaaucauaacagugauucaccaucauuguugucuuuauucaugguggagucagccaccuuucauguacaucuguuuuaguauuuauuuugaaugucaagcucugcuccuucgccuaguaguguuucauuuuauuaacucaguuugugccuauucuuacgucgucaugauuucaugaauggauuuaucaacauuuuucuuauuuuaggaaucuggauuuugugugaccauguaauuuauuauccaaacaaaaaugcuuuugagauuaaaagggggaugcuaucaauaauuaugacaauaagcuuaaggcagaacaguccugagcaaguuggauuaacaauaauacgccauauuauuaaagaaguauauuuguaugguuuaagccaaucgcuauuuguuuuguuuuuaucaauuuuguauaguugcugcuauaucauauuuguggguauaacaguuuuguauucagggucagagaagugaauaaaguggguauuauagucuacuuucaaagaagccuauuuguguuucaaaacccuaagucuuuaauaaaaguggccaggaguucaaaaccagccugggcaacagagggagaugacuuagaaauccuuuuaugugggcugcuucugccauugacauuucaaauucugacuuuuuuaggaaacauaaauauucacacaaguuuacccauagacugugcucaagauauauugcuuuugacuggggaggggcuguuggcugcacauauuugcauugugccaggugcccagcugaaauauuuaacauauaauuucauuuaaucuucacaacaagccuguaugauagguuuaauuauuguugucuuaaagauggggaaacugaagcaaaaggccuaggaggcuuucagaagucaugcagcccagucaguguuggcaccaagguugugaucugucugucuuccuguaaagucuacgcacuuuacuagaggccauacucuuucccuucuacuacagagugcuuugcuuauuuaccuaauggaaaacugcuuuucuguuuuuauuucccuaaucuauaagcacaggaaaagugugugugugcaugugucuuuuuacacuuaacucuuuguuguagauuuuguuuggugugacucacagucauuucaccuuucuauuucuuccucaaucacucccaucccucauuggaccugucagaagaagccugugaggaggagauaugagccguaugggauguauucugacgaugaugccaacagugaugccucaaguguuugcucugagcgcucauauggcuccaggaaugguggcauuccccauuaucugcggcagacugaggauguagcagaaguucucaaccacugugcuaguucaaacuggucagaaaggaaagaagggcuucugggccugcagaacuuacugaagagccaaagaacacugaggugaggaccacagcaagaauaugagcuaaguuugaaucuccuguuggacucuucagggguuuaaagggauuuccuauaauuaauggagucuaauuccuauaauuaauggagauaccaagaggucugcuugcaggaacaggcacuaaagguaccaagaugacuaagacacaguccuugccauccauuugcuuugccauccauuugcuuugaaauaucuggcaaauauccuuuuuuucuuuacuuuuuuuuuuuuuuugagauggaaucucgcucuguugcccagacuggaugcaguggcacgaucuuggcucacugcagccuccaccuccuggguucaagcgauucuucucccucagccuccugaguagcugggacuacggggguacaccaccacgccuggcuaauuuuuguauuuguaguagagacaggguuucaccauauuggccaagcuggucuugaacuccugaccucgugaucuggcugccuuugccccccaaagugcugggcuuacaggcaugagccaccgcgcccagcccaucuggcaaguauucuauaauuuauuaagcugauaaaagauguaggguggacacaguggcucauaccuguaaucccagcacuuugagaggccagggcaggaggagcacuugacuccaggaguucgagaccagccugggcaacaaagggagaccccaucucuacaaaaaaguuaaaacauuagccggauguggugauaugcaucuguaaucccagauacuucggaggcugaggcaggaggaucacaugagcccagaguuggagauugcagugcauuaugauuacaccacugcccucuagcuugaguggcagagcgaaauccugucucaaaaaaaauaaaaaaaauaaaaaaauaaagaccccauauuugguucccuucuguuugauauuuguccaguagauguuauuugagaaaucuuccuguacaguaugcaguucagguuaaaacauaaaauaaaacaacucugcagguuaguaugguucauuauacuuuagggucuuggauuaaauguuaucagucuuaguuuggaaaauuuugauaugcaugugcauauauguagcuuauaaauguacauagugaggagauaacaaaauggagcacuccaaaauaguaacagcauugucuuuuagauggaucguuuuugcuuuuuucuuuguuucuguuuuauaaauuuucuaaaauaagcguguauuacacauaccaaaaaaguaugugguuauaccauauuuugucaaaucuaaggcaccauagacacacccuuauuuuuagcccuuuaauuaaugccacguauuaaaccauaacagugcaaaaaugucauugauuauaagaugacucaauuacagagaugugaaaacgggagaaaggagacgugaaugggaauuaagaaaugggcaacuuagaguacaugaaaugcagucuacuuuauccuuuggaugauuuuuauaagauaaguuaacggucauagaugggcaucccucuuggguucuguaaggcugagcacugccugaugaguugcucagcucucacuguggcucuucaggcagccugacuccacccucccguacucauaccugccccuauuauuugucuguucacaaagacgauacaggaaguuuugccuucugaaacgcaggcauccugugacacuuuggugaccugucaaaaauagaagaugauuugucacgauuguuccucaagaaucuguuuaauccugguggucccacuuuguagauucuuaguguucaccaaguacccauugaauaauuucuaggaaucuguugauuggcauuggucuaaucuagguuacgucguuaacaauauugaaggguucuugaacaaacugucucauccacguaagagggcauuaaucagggaugauuuguggaagagaggacacuucuaucaaacuuuaaacaugggacuugguaguagucaaggaucagaaaaggcaaagggcaccaaugugaaaugaguguuugcuuuguccuagguacgguagaagguacaauguuuuaucuuuuaauccucucagcagccacgugacaugguccuuauccuguuugaccaauaaggaaaucacaggcuuaaagauagcagaguacuuauuuauuuuauuuauuuauuuuugagacugaguuucgcucuuguugcccaggcugaagugcaauagugugaucuuggcucacugcaaccucugccuccuggguucaaacaauucuccugccucagccuccugaguaacugggauuacaggcacccaccaccaugccuggcuaauuuuuuuauuuuuaguagggacaggguuucaccacauuggccaggcuggucuugaauuccugaccuaaggugauccaccugccuuggccucccaaagugcugggauuacaggugugagccacugccccuggcccagaguaccuuauuuacagcagaacugagauuaaaauccagaucugucugacccugaaacacaugcuguuuuguuuuuucccuuuuuuguuuuguaccucucauuaaaaugcaggauagacaugcuuuuuaaacuuuauuccauugccuuucaguuguagcauguggaaaacacagcugggauaaaaugaaaaagauuuggugcauggcuuugucacuuccagauguguuagcuugaguaaaucacucagucuuaguuuccucaucuuaaaaugagagcaaaucucugguuuuauauuccuauuugauuuagcuauaaauuaaauaagaguuugugaaaaaacauuguuauguagauacgaauuauguaaagcuuauguaguugacugaucaaaaaaauuacccaggugugguagugugcaccucccagcuacucgggaggcugaggugggaggaucacuugagcuugggagaucaaggcuguagugagcuaugaucgcaccacugcacucuagccuggguaauagagugagacccugucucaaaaauaauaaaaguaguaaauucauugauuucuguuuuauuucuucuagucgaguugaacugaaaagguugugugagaucuucacucggauguuugcugacccucauagcaagguaagucugaagucaugccugcccugucuuuaccccugcaugucugugugcucugugugauauacuacccaagaaugagagagaauucccgauagugcaguuccgaccuuacagagucacaccgguuucagcacuaguguauguuacaucuuuuaaaaacagaauucuuggaaacuuaaaugugcauaaaauuucaaguuaaauaaguguguuucaaguaaauguuaucagggagagaaucagauggucuuucuuauauucagcaaauauuuuuguaugucuccucuuagccaaacagugagguaggugcuaggguauaagauuauauuauaauaucaugcauuuuuuaauguuauaguagugaagaaaauaaguauauaauuauuuuuguaucccguguagaauauguccguauaggacaagauagaaaaaaugagaauauguaauggauuuauugauaaaccagguuauuucauaaaauaggauuuugcuguuaccaagaauuugcugaacggggaucacuuagcuggugcccacaccuccugagggccauagggaacacuaagcccaaggaaugcuuuuuuugaugagagagucccagcugagggggaaaugcccaugaguaugggacagaacacuuuccaggggugguggaaaagacgugagacaggguaucuuuacagaaguuuacuuggagucuagauuuuaaauacuauuguuagggagaaggcccuuagagacuauuagaugcuuuuagaggaagaagguaagguguggaaauggauagaaccuuaaaugagcagaagcaaaucuuuaaugcugacaugcaggaucaacuacaguuuuccuaguaaagaugggcuccuccaagucuugcuggaagaaagaaaccugugauggccagagagcccagccaguuagucaucaucaucuucuuucuuuuccuauccuugcuuccucguaggaauuguccuugaaauaucaaacauccauccacccauucauucacccagucauuuaacauuuacugaguaccugcucuggggcagggauauagaaaagaagauauggucccagccuuuugaggugcucaugagaguaaaggggaugaaugcaaggguucuccuccccuccccccacaacagcucuccucacucagugucauucuugaagcaugucuuuaaacuuucugcugugacccucacagcaaagucaacauuaacaauauuaauaaaaauccacugggcacaguggcuuacaccuguaaucccagcacuuugggaggcugaggugggcagaucaccugaggucaagaguucgagaccagccuggccaacauggcaaaacccugucucuacuaaaaauauaaaaauuagcugggcaugguggcgggcaccuguaaucgcaguuacuugggaggcaaucacuugaaccugggagguggagguuacagugagcugagaucgcaccacugcacuccugccugaacaacagagugagacucugucucaauaaaaauucaggaaagacugagcuuaaaggccacauagauauccaaagauaaaauuuaucaagauuuuucucuaagguagugguaaaagcaguaagauuuaacucauaagcauaauuagauucuuaagauuuauaacgugaacacuauuagaugguuuagaacacugauaaauuucuguuaccugucaccccuagauugcugauucagaagcagaaugugaggauaaagaaggaaauuuguuuccaucagaagucucuuguacagugaguuuggaggucucaguuuaguuaguauuuguuagcugccuguaagugaagccaggaaucccacagcugaaugacuuuuuccugagcugucucacaggagaccccugguggugaauaguugcugugcuagaaaugaggcgguauaggguuugugguuuguccaaguagaacaaguuucauuaacaagguagggauacucagugcuacuuuucucucugaaauugguucagagauauuccacugugcacucuauuuugccuuagcaaaaaucauuacacaacagcaugaugauuauguuaauauuuuuauauauuuuauucuaagccguaaucuauuacuuuaugauaucugaaauugguauacaucaaaaugucugacgugaaaagcaauagcuacacaauagugaguagguguuuuuauuggcucauuuuauaauaguauuuguugacugcuagauagugaauaagaauacuauagaauuagggcaagaggauuuguuguuguuuaagaaagaaaagccuucaggauuaaacacagaaaaguuaauuucucucuguacugcuuuuuaaagacuuacauugauggaggagagaauauuucauugguuuguagccuuuucagguuuucuuaaaaaaacgcaugaaaaugguauuaauucacugccaacuaacauggaauuuguuuuguugcauggccucguuugcgguggaauucacaacagagaguaaguuccauuucuuuuuccuuuaucuguuuucugcacuacauuuuccuucuguacuaugaacaguuguuaacaguguuaaccuaaguuacaagagucugggcaaagcacguaugggcauuuuuaauguuuuguagacuuuggaggagaucgugaauucaauaugugaacuacuugguuuucauuugugucuagguuuucaguauguuuuuggagacucuuguggauuuuauaauaauucauaaggaugauuuacaagacuggcuuuuuguucuucucacacaauuacuuaagaaaaugggagcagauuuacuuggaucugugcaagcaaaaguucaaaaggcucuagaugucacaagguaaguguuuaaggguuagguccauuuugauguuacaggauacuuguaagugacuuuuugccauucucuuuuguuacccauggccuuugucacccccuugaauaucucuuuuacucaguucucacuuucuguuguugacauacuuguugacaugucccaccaguccaugaaaugaaauaccauaucuuccuuguguugauauuacuuuugugaguauuuaagacauauauaauaaacaaauguaaaacuuuggaaauugauucucuucucauuaaaaaacauuuaaagggaacauuuagaauauuuguuuacauuucucugaagaccuuaguauuuuuauuacuucaacuuacaagucuuacuagaaauuuuucuaucgguguaugauguagaguuuccauugguccaggaaaauucucuaaauuaauaguacacuggcuagagauuaauagcacauuugcaguaguugugacccuucuggcuguuaugagaaaagaaaagcugcugaagcccagaaaaguuagaaaaaguacaugcugcugcuguucagaaaccgcuucucuauugucuaugcaguuguggguccucaauaugcaaguaugaaaguugaaacaucucagaagacacuuugcaauaaugucuugguugugauuugguggaagauggauggggggaaugucaaauuggugaacuuuuuuaaagaacaaaggaauaacuuccaagucacucagaaaauuaucagggcaaugacuuuuauaaguuacuacaaacuggaauaauucuaguuaucauagaauuucaagauggaaggaccuuaaagaugaugcucauuuuaucagugagaaacagacaguuugccuugacuuuguguuaguggcuguuugggaacgcaaauccaggauuucugaagauugcacuguugucuguuuuuauuguugcaggcuaucuuguggguguguguccucaccuccugugggggcaggggggugguauggauagcacuggaaccuucucuucccucucuggcucccuugacuagcacaguagcacauccugcccugccggcaucucccuaugcgugcagcuuuuacaugacucugacuucaaaguaugcgucuguuccucuacaccaugaugccagcuguuuucuuuuggcccuugacccugucagucuguguaauugcauugcucuagaauucuguuauccagagcgauuacccuucugguuuuuaaugaacucaaaguaauguacuugcaucugucggugaggccauaaaaaaagaauauuaaauaaauaaauaaauaagaaucaaaguaauguacuaaauuugcaauaaagcuuucaaacuucgucauuccuuugcauggcuaaacuuaguggaguuagggagcauuacaguacaccauuauaccaguggauuauaaagguuuagccaagauugacugaggggcuaggcugauaagcugguauaauugaguggaguagauaggauggcuguugauagacuggggccgguuguggccacauugggacaugggcucaguaguaccagacuuuucaagaaaggucagaaauguggauuugggcaacauauuugagaauuuuuuaagauacugugaaggccaaauaaaacacaugugagccagacuuggccuguaggucgcuuaauuuaggugaauuuaccaaugaccagaucuauuucauauauuuaggaaugguaggaguauuaagauuguguuccuaaacuuuggugauuaaggaauacaauugugaccuccuguuaguuuuccuggaugccccuuuaagaguccuaaucucaguagauuuggucugagugccuaaagcguuuuuaauauucccuucuuuuucucagcaguugagaugcacagcuguuuaagcugaucuagaauagucagcgacugcuaauaggagguuuuagugauggcugagaauugcuucucaguuuauagacuugagugcuaaucugccucaauuuccuuuccuuuaccugugccuaacaauggcguauuucccgauuauacacacccauuacugaaauguauucuccauccaccccaugcugccagaagaagggagagacauuuugugggugguuuguugacauagucacuuaaauuagguauauuaaaguaugcuuuccuucccgaagagaucuucaaagauuccaggguauuauuggaucaaguuuacuuuuuauuaguaauuauauguaggauaacacugguaccugauaugugccaugugcuuuuuauuuuuauuguaugauuuuauugacuuuucaaaccaguucuauuugcuucauuuuacagagucaaaccuacuucuuuauuuuacuacauuuacguagauugggaaaaaucucuaagagaguccaaagaaagcaguguagauauuugccuugcauuuaucuuuccuguuaauauggaaguuacaucaccauuuuccacgugggccccauugugcaauuuuaaacuaauacuaguaauuacagcauuuuaacagaaagagcacugacucucuggccaagagagagaaggggcuucugggaccccaggcuucugugugugauuuguagcuggaugggaaauguuuugucgccaucucacaggcauucuucuguggugugcagggacccuaagcagugaccaggaccaaggaggaugauacgguuaguuuaagcagggucagcuguaagcagcccggucaggauguaaaaaugagauuuggguaucagaagugauuuuuauguuuaagcaauauccagaaagguagcuggagggaaaaugagcgaaucccuagaaaggcagguagaaauuucuccuuaguuuauugcuuagucuuaauuuuuuaaauagccacucaaaguaaguucaauuuguguuuggggacuugcaaaaagaucuuccuuuuuccauauuuucuguauaacauguauuacucuacauaaaacgaaaagcacuauuuauuaaaaaugugaacaggguuuuacauacauuaacuuacaaugguaugcuuuuguuaaauaguuuuacauuguuuuguaauaaauuucuuuaaaaauaagcacuuuuuucccaccaaccuagggacuccuuuccauuugaucaacaauuuaacauuuugaugagauuuauuguggaucaaacucaaacuccaaaccucaaggucaguaauuauuugucauuacaauucaacccuggaacucacauuuguuuaaauuuacuuuuguuuauguaugacccauguuuagcuauugugaauaaaucugcugugagcauucuuguuugauucuuuguggacauguuccuguuucucuugguucaguaccuaguaguguauuugcugguucauuggguaaguacauguuuagcuuuuuuagaaaccacuaaaaugguuauaccauauuguauuccuaccaguaguuuaugagagcucuaguuuugcugcauccucaccagcauuuggacaguacuagucuuuuucacaauuaauauuuaaacuagaaaauuaagacauucuuguguguagagauagguaucuuauuggaauguuuaauauuaacauucuaagcugugaaaguuaaucguuacauguuguggaaaaucauaccuguaauaacaagaccaaguuugagggaggauguauguuaauuugaauuaggucacguucaucaucuguucuuugaucauuaacuuuuuggagguuuuaggaugagucuaacaaauaauuaccuuuuccuccugaagucaaagcuaguugagaaguugauggugaaguuaggacagagcaucagcuugauuacugaaaaugcugccuuacagaacauggccuagaacgugugacaaaacuagagcugaacaugcccugcagucaguggcagagcuggaaaucccacgggccccucucaagggcuccugcccuggaagugucuugcagcauagaugaggagcagagcaagcuucucuacaggcagcuaaaaaugaagaaaacugagccaugugccucuuccuguccccaaacuuacccaucagccauuucaugcuuuuuccucuguuggaugucgcuccacguggaaacuaucgauacaggagaaaggaaggagaucccccucaccaggguuuacuuuucucuggccaccugauaagaauuguguucaaagauucaucaaguguacuuaauguuuauaauuauugguucuuucaggucaaaguugcaauccugaaauacauugagucucuggccagacagauggauccaacagauuuuguaaacucuagugagacaaggcuugcuguuucuagaaucauaaccuggacaacagaaccaaagaguucagacgugagaaagguauguccaagagaaccgacguguaauuacagauuguuccugggcuuguguuagagaaauguauuuagaaacuugaaaaccgugccacccacccacaaaccuauaucacuaaggcucugcuguugcccuuuucucucuccagcucugcccaguuuugaauauaaaaaugaaaaucugaaaucuugcaugaugggcuuaugguuuccccaggcaucuacuuuauauauuuucuaauaugaaaucacuaguaaauuagugucuuuuacacagauguuuguuuuccuuauaucaguuuguaauacguacuuugaagauaaaauugcagaucuagggcuagcuggcuacagggucccugaucguaaaaugugguugaaaaguuugauaagacguaauagaugcuuaaaaaagagcaaacgucuuucaauacguagcacauaaguauaugugugauaugugaguaugugcuuuuguaauggaauguuacuuaaguauugccugguacgggcugaaacuuauucuauauuugcauauuaccucgauuaggaccuguuugggacaaacuagcuuugaucauaauacccacucccuguggacaugcacauuagaauauuugaacuaggacuuacuguccuuauuauucuaaucagaacauuacagauaauuucgaaugauuagccugaugcuccaaaaaccucaacuuauuuuaauacuagcucaagccaaauauaaauagaacguuggauauauugccagaaaucacuuuguucauuugcuguuugaaugagcuucaacacuuguuuucaguuauuuuggauuauauaguguuacuuugcaaagcuuuaucuccacuggcgugcuacuuuccaugccugccccacuaauucuccuuucccauugugagguguacuuaacuccucaccuucacaccuaacuuauacccagguucuaggaccauaauccugaucuucagaggaauuucagaagauuuagauuaauaguucacaguccuggcugcaauuaaaaucaacauagauuucugagcucuauucccaaguaaugugauuuaauugauauagggcagagcguagacacucuguuguuuuuucgauugggguuccuuucacucuuggcugauuuuuaauacacagacaaggccuaguauuuugggccauggccuuggaaugaaucucaagacaugcagacuacugauauagucuugaucugguucuugcaaauucucuugcuacggaguguugcuccucaguaucuucaggacuaggcuuggccucucuguucccuggcaucuucccuaccucccuuccuuggaccuagaguguuugugcuuccucuaaacccacuuuagugguuagggcccuguuacccugggcaacuuccuucaaacugauggaauaccugccugguuuucuguguauugucagcucaaugcacucuguauugaucauagaaagcuuccuagagaagauaagauucauccucagauguggaauauggaugcaguuugcauaagugaugaguuuagggaaaggacaguagucauguuuaagaaaugagauuugucugggaacagugaaauagacugauaugucugaagcagaggguuugggaagaugagcaguaaggagacuguuuugcucacccugcaugcucagugccuggcauauaccuggaguaacauagugggcauugauauguuuugaaugaauuaaugaaugauaaauacccauauggaaauuauuucauuucaaaugauauuuugaagccaucauuuuuaagacuaguuuugaaaauucccuucuuuugacuucguuauuuguuuucuauuguauaacaaauuaccacauacuuagcuugaaacaauacagauuuauuaucucacaguaauaagucaggaaucugacauguguucucuggguccucugcuuggugucucaaaggcugaaacaagaugucaucuggaucugcagucucaucugaggcugaggucuucuuccagcucauugguccuuggcagauuucagucucuugcagguguagaacucaguugccuccuuccuuccucauugucaacgggcagccauucucagcuaguagaggcugccaggaaguuugcuuguucaaagcuaucgggagaauacaugaagaaauaauaucuaagaaacuccccaaauuugacaaaaaaaauuacacaucugaguagcccaacaaacuaaaaaaauuuguuuuuuugguuuguuuguuugagacggagucucgcucugucacccaggcuggagugcaguggcgcgaucucggcucacugcaaccuccgccucccggguucacgccauucuccugccucagccucccgaguagcugggauuauaggcacauaccaccaugcccggcuaauuuuuguauuuuuaguagagaagggguuucaccauguuggucaggcuggucucgaacuccugaccucgugauccgcccaccuuggccucccaaagugcugggauuacaggcgugagccacugcgcccagccaagauuuuuuaauaaaaggauucacaccuagacacauaacaucuaauugcugaaagccaaagagagaauccugaaagcagcaagaggggagaaacucaucccaugcacaaguuccucaauaagauuaacagcucauuucucuucagaaaccacaaaggacagaaggcaguggaugacauugaagguacugaaagaaagaaagcgcucagccaagaauucacuguuuggcaaaacucuucuucagaaauggagaaauuaaaacaaaaccagccauagaaucucucucauuuugaaucucucugaugccuuuuaagggcuugccugaugaggucaggcccauccaggauaaucucccuuuggauuaacucaaagucaacugauuaagggccucaauuacauuuuugaaaaucacuucugccguguaacacaaucaugggagugauauccauuauauucacaagucccgcucacucuaagggugggagagguuauauaggguguaauacguuauggggaaucuuaggggccgucuuagugucuugacuaccagggcuuuagugucucuuuuaggggguuggcagaaggcuuccauaguuauucgauaauuccuuggcucuuauuuuagaagggcgcuuuuuuaccuaucuaugcaaauuaugaugugguucaacuuacuuagcagaugcaugucuguauucuggcacccucuggauuuuuuuuuuuuuuuuaaucauccaagauauccguggcucuaaacuauuuggcuuucaguaacauucagcacuaacuaguaaagcauuacuuuugauucaaauagauguaucauaggacaguauuaaaauagauguccucaaacucuacauuagggcacugcagauuaauccuuuuuggagguagauucacuuuuauuuaaauucccuguuuugauguagcauccguugaacauuuauaaauauaguugcuuuuguaagugaugcagcugccuuacccaagaauaugagacguucuugaagcacugucaaaaugaagguagugccuaaauaaauuaaaauacuuagaauugugauguaguauuuaucacuacucuaagaucuaaaauugauaagauuuaaaauuauuuuaaacuguaugaaaacuaguaccauucuuaucuagaucauuuaacacacuaaacauaaaauacaugucuguauaaauaaacuuuguucugccucauccuucauuuccagaguuuuuuaaagguuauaucagggauugaggaaaucuuggugauuuaaaagcguuuugugaucuuaaaccaaguucuucugugaauguccugcuuuaauuuuuuuaggguagguauuccaaauacagaagagcccuucagucugaaauuuauacaguaaauucucauauuagacucaucucuggagaauauuuuauguaaacaguaccuggggacuuuucagacaacauaauucauucucuaaguccauacaaccauguuugugaaagcacuuuugaagcauuuuaaacuuauaacaagcugauauaacccagauuaauugauuuuagcauuuuuaauauuuuguuuuccuuagcucaguauauugggguguuucacauuuuggagggaggggugcuuaaauuguuaagguguuuuuaaaaucaaaacacgaacgaaucaccagugagugaggugugcuuaccacacugagacugguuugggcaaggugaaaaagcccaacccagucuguaacuagccugcuuuauuccaaaaguaaacuuuuccauuuucucagugugggagcccugacuaguuuaguugugugaugaaacuaugcagacguacacuagaccuuucuuaaugcacuguguugauguaagauaauaguauauauuacugauagaaagaagguggguucuggaguuugacauccauuugacaucugccucugccacucauuggggucagagcaaguaauuuaaucccugaguucuuguuuauuaucuguaaaaucggaauaauaauacuugccucaaacugggcaugguggcgcaugcuuguaguuccagccucaugggaggcugaggcaggaggauugcuugcagccacaggaagaguccuaucucuauacauaaauaacacuuaucucaggcauuacugagaagauuaaauuucauaaaguauauuaaaacuuagacauuuuauuugcaguugcagcucugcuauuauuguuugaggauuguuuugguuuugcugcugcuguuauuuauggaauaaacugaguaccagaauuuuuucuaagauuuaggaagccaggugaucaaucaaagggaaugugguaauggcaguagaauuuuaauuauauguuuacauuuuggaauuuaaaaugccuguauguuugcuuaucacaugugacucucuuugucaaaugaagcaacagauuuagcccccaaaccuuguuuugagaagugugggcaaaaaggcguggcgaagaaaccuagaaguauaaagaugcuguuggcuagagcagggagaaguauuaauacauaaauugccuucaaaagaugagauaucuaguugacuuuuaaaaaaauaugauuauaaaggcagcaugccucuagucugaaagcuauggguuuuacuaucaaauagcuggaucucagcuuaacugugacugcgagucucuuucaagucuuuuuuguuguuguugagacagucucgcucuguuggccaggcuggaguacaguggcacgaucucggcucacugcaaccuccaccucccagguuccagcgauucuccugccucagccuccuggguagcugggauuacaggcacaugccaccacacccagcuaauuuuuguauuuuuaguggagacgggaguuucaccauguuggccaggcuggucucaaacuccugaccucaguugaucugcccaccuuggccucccaaagugcugggauuauuacaggugugagccaccacgcccggacucuuucaagucuuauuuggacaucuuccauuucaucaccuguagcaagaauacuacuuucaagauuauuaaguaaaagaccuagugauacuacugaggguuaaaacugacagcuaauguuauuauucugauucuuccuuacuuucaaucaugugugucuugcugauuuuaucuaagaagccaaaugcuuuuauagcuaacagauugccauguuuaggcacuuucugcuucucucugauucaauccucccaacuuuccuguuugccaguccucacuucagcguagucgaguaggugaggauuuccccacuaggucagcuucaaccugcucugguccuggagaaggaaacuuggaagaaaguuguaaacagguagacugaaaacuguguacuaauuucaaacagcauacuucacuguuugcauuuuagauuauuaauaccaguugcccuugugaaggcucugggaagcuuuugagaaauguaaaauuaauauaauaauauaugagcguguguaugugugccugugucgacguuuguguugugguguguuuuaugauuaacuaccuucucagugauauagccauguuuaugucaaccacuaccauguuuuaauagaauaguaaaaacgaaagauauuaggccgacacaguggcacacgccuguagucccagcuacuugggaggcugaggcaggaggauuacaugagcucaaggcugcagugcacggugauuaugccugugaauagccacuguacuccagccugggcaacauagcaagacccccaucucuugaaaaaaagaaaggagagauacuaaaugagaaaugucugaggguuuugaaauaguuucucuuuggugacuuuaugaagcaguuuuuaaugagagucugaagggagcagugaguuguuuaauaaauuggaaaacucugccuuuccucucaaauuuuguuuucccaaauuaauacaaacacugaaguguuugguaaagcuuuguuuugaucugaucugcuagggagaauuccuuucugcuauaagaugugcaacauucaagacaguugaugucccugggaguugucuucaaaugguagcagugagaugugaagaaccuuuuacaaaccccaccucucaaauuccucuaugagggugugugugagaaucauuucauuuuaaguugccaugugauccuuaaaauaaauugcccuaggguugcccauuagaaaaagucagcaguacucugaguuuuucaucuggcugccuaacggucuugccucuuacgaagauaacaguucacauaugccgacaagaacaguggcguacuccacuuuuugagucacuaguaaacaugagcuaugccccaggcuuuuuuaaugcaucucuccagcccaguuccauaucuggaauuacuuguuuaaugagaucauauuggugguaaugauaaauauaacccaguuuucuuccuugcuuggauuccauauuuuaaccucucacugauucagaggguuggagauaaaauauuugaaaacaguaacagucuaauucguggcaaaacucugauauaaaaucuuuuaaaaauuggauacuugggcccggcacuauggcauaugccuauaaucccagcuacuccagagacugaggcaguaggauugcuuggagcacaggaguucgaggcugcagugcacuaugauuggaccuguaaacagcuacugcacuccagccugggcaaugagaccccugucucuuuucuuaaaaauaaaaaaauguauauuuaaaugauacuuucuaccguuucuagaacuuggaucuuauuuuuaaaagauuuuacuuuggaaacacucuaagcuucuaaguuaauaauuugcaucaugaaaagccucaaguuagcuuggacauuagguaacauucugggaagaaauauugucucuuaaauaaaggcaguggcacauuucacauaaaaagcguacuauucaagaauguaaucauauauuuuauaacuuucaaaugccauuuucaaccaacaaaauuuaagugccaauaucuuuuaauuaaauugauguguuuucccugcuacaauuccaggcugcugcuuucuuuccuccuuguagugcauuauuuuucugcaugcauuguuuuuuuuuuuucuaacaccuaauacaauguuuuuuaaaaauaugcagguuacuuugcaugaguuuuggaaauuguucuguuaugcaaauaugcauaucaaauaaacaguacauuaaauuggugaaauagauuccuucagauaauuuguuuaaaauguuuccaaaaugaaaugcagaaaaguguauuuuaguacaaguaauaauaaugcuuuuugcccaugucauaaaaauauuaugaccacuuauuuaauuuggguggaaaagguauuaaugacuguauuugaaauuaaaggggaaaaaaguaauguacuuuugcccaauacugugauuaaugaaugauuucaaaauguuaaaaaaguaacuuuugauuauauuuuuaaauucauaauucuuauuuuugguuaaauaccuuuggguuuuuggauuucuuuuccuacuccaggcacaaaauaguaauuuuguccuaacuggaccuauaauuaauuuuagcauuguaaaagcauugaaauauuuugugauguuuauuuccaaaagaauuucucugcaagcacauuuuuuguguaauauucuaugucauggaaaaaaauucugaauaauuacugcaaucuuaaaaacuacagucuuuggaaggacuuuauguuuguaaagucuuuaugguuaaaaaugaaaaauaagugauuauauucacagacaguuuuuuaugucuuuuucuuucucuugacucuuagaaauuaauuagaaaugccaauuaguauuuacuaaauuuuuuuuggcuuagcuuuuauaaaugaaaacuauuguaauuaauuccucaggcauugugcuuuaagcucagauugccugcuacuaaauccauagaaagcacaucacuuacuagaagcccgagccucauugaccacucuuguuccagcucauugcuuugccuaccucgcuaccacaaucacuacaagcaggcuugcaguguguugacucaauuaauaagcaaaaguagaacauuuuccaaaaggcagaagagcauguuuuuaacguagacuccuucgaaaucugauuugcuucucaaagucucucuccuugguuuauagguguaaaaguagaaguuuuucugagguauuuauacucguuuucucauguuucuuagucaagaggaguauggcuucacaagauaaccuaaugcagcuuguuuaaaaauaugugcuuuccaggguguacugagaucccuguucaguucugaauuauuaaagugggaucaaucuuaaacuuuuuaaaauuuuuuaauuguuucauuuaccuacuuaaccagcuucauuccuaguaccagacaacaagagaaaaguucuaggaauuuauuauuagugugcuguggaauuccaaggccagagggcauuaaaaugaagccagaguuuauuuucccgauugaagucagacugcuugugauugguauuauuuucuucagaugcuuuuuuguuuuugaugccuagaaugcccucuuauuagugauuuuacuuauaaaauauuuuuuuaaacaacuuuaaucaacauuuugaugaccuauuguacauuacauaaauuaaucaugguuccuuuuucuaggcagcacagauugugcuaaucucucuguuugaauugaauacuccugaauuuaccauguuacuuggugccuugccaaaaacauuccaggauggugccaccaaacuccugcacaaccaccucaagaauuccaguaacaccaguguggugagugcuuuggucacgauuggugccuaugugauguccaugaccucugcguagcccuuaucuagaaccuacucuaauagaauaccccguuuccuuguccucuuucaggaaaugucgagcauccugaggauggggccaucuuaagccccagugaaugaaugaaucugauauuuaaguaugccguuuuuucucagguuguucagucaacuacauuuucacuagguuauccaguuagucauucauucacugaguuggucuuauuuuucaacacuggaaagaugcaagugcucaauuuugucugucacucuagcacacccaacaucaaucauuugacuccaggagugcuuguaugaugauuauucauuuuugguuuauauacacuuaaaauuggccuuaugauucuaagggaaaaaaaaaaccauccugggcagauucuacccauuuauuuacauguggguuaaaagaccaaggaaagaauagaauauauucuauauacagcccuugaauaacgaugccuauucugcuucaccccagggcucuccaagcaauacgauuggccggacgcccucccgacacaccagcagcaggaccagcccccugaccucacccaccaacuguucccaugggggucugucuccaagguaaggucacuucuuuacuuuccacagauguaaagaaacuaaagcaccuuaauugcugugcauccuauuucuagauuuuuagacuaagcuaaauaacaaaaagaauauugaguaucaagaaccguggguucuaguccucacucaaauuguaacuguauaaucuuaugcaaagggguuaacuucugugguaagaugagucaugugugcugaauguucucucguucuuguagcucuaaacacucacuaguaccuaauaguaccuacaacuaaaaguuuguauuuaguacuguuuuacauagaauccauguagaagcucauuacccauucugcaagugguagaaccuaaagguauuuagucauccaagccaacuuguuauagucaguuacaccaagucuaggguaguuuuucaaccaaguaaucauucuaaacauaguugcuaucauguuugaagcagaaugcugcucugaaggacugugauuuagaaucugggaacuaaaauuggaucaacauugcauacucuuguugggaccgugcaaauauuggcccuauagaagcugaggcaaugauuuaaaaagagaaacugcuuugucuugggaucuuuagauaauacuucaccaucugacaagagccuuuagaagacugcaugguggcuuuagugaccccuucacaugggcugggaguuacccauggccccacucaaagcaguugcccuauaggccaaaauuuuuaggagagagccagugucuggaccagcaaggggcacacaugcucuguuugucuacaggauuaacucuuugggaucacuaacaauacaaaccaguaagcuuguguccugagggcugcugacaccaggaucuuaaaaugaaaugcaaauaccacaaguaugcuauuuucccuuuaauggguccuuguuacuaggaagauaucaaaacauaauugcuuuuacauuuaguuuuuuaaaugaucaagaaucucccacacuucuuccuuaucacugaagguuuccaguuccucauauccuuuaaauacuuuggaacauaagaaauuuguguuuuccucuuggugaaacaaaguauuuucuauagcuaucuuaucuugcuguucagauugcccuuauguuuacucccucaaguuucccucugcacuauauucagguagacugcaaugugauaucaugucuccagauuuggucuguguugucauggcuucaacaggcuguuacaauuaaauaauugaggccagagacuaaugaaaauaugcuugacuuuugaauaugaugguacaguggugacaguaaaaucauaaaauuaucuuuucuaguggagaaaauuauauggaaaacuugaauuuucuguaaauugucgccucugucuagaagagauaguuaugcaacauuaauugggaagucuuuucuuccauaauauacaguucauacaucuuuuaguuauugcauucuuaggguggcacauucuuuaguaagucaaaagggauaacucaaauuaagcauuuuauuauuuggacuaaucuaaguaaaaacuugauagugcuguuaguaucauucaucagagcuaaaacuggcuaagucagucuccauggguccucaagucauuaaaaauuguguuuuucaaggucauuauuccuucuuaauuggccucaucuuaauuuguauuuauaguuacagaucaguggaagaaacaaagagauuuauuuucaauauucaguaguucauguguggucuaaauauuuucuuguuaucaaauucuuauuuagggaauuauuuauguaguuucuuucuuggaaaaauauuuuuuuuuaacuugccgucauucaguguguaaauagccagauggccuuagccaacuugagcuuacagaagaaaugauuuuucucgcaacuaaaacuguccagcagugggaaaaacugcuucauguuaucaugucacuagaaauauuuaaauaggcuacauauuuucuaacaggaaaaugauaaaagaaaugaauuauugcacuaaauagaauugacuagguuaccucauuuaaggagacuacagacagauagacagaucuguuguauauaaucucagcuauuuuuucugagcauugcucuuaaaauguugauuuucugugaccugccauuucuuugaguuaucuugaccagacaguguuauuuuauucuguaggggaaaagcuauuaccaauuauuuguuuucagucaaauuaauuaauuaauuaauuuauuuagagauuaagucucacucugucacccaggcuggagugcaguggcaugaucucugcucacugaaaccuccgccuuugggauucaagugauucuuaugccucagccuccugaguagcugggacuacagguguacaccaccacgcccagcuaauuuuuguauuuuuaguagaaacggagucucgaacuccugaugucaggugauccgcccaccucugccucccaacaugcuggaauuacaggcaugagccgccacaccuggccuguuuuaagucuaauuuuaacugucaaaauaaacuuuuuuuuuuuaguccaaaauuucuauacuuggaucaugaugauagugagaaacuauucuaaaaugauaaaucugauaauuguuuaaaaauaucacuaguggcuggacaccgugacugaugccuguaaucccagcacuuugggaggccaacgugggaggauugcuucagcccaggaguuugaaacuagccugggcaacauagugagauccugucucuacaaagaauaaaaaauuagcuggacaugguggcacauaccuguguucucagcuacuuggaaggcugagguggggagauugcuugagcgcaggacauggaggcugcagugagccaucauuaugccacugcacucuagccuggacaacagaaugagacccugucuuaaaaacaaaaaauguguguguguguguguguguguguauauauauauauguguguguguguauauauauauacauauauauguguguauauauauauacauauauauguguguauauauacauauauauguguguguguauauauacauauauguguguauauauacauauauauguguguguguguguguguguguguauauauauauauauaucucaccagugaggaagucauuuuuuuuuuaucaacccaguaguaguagagaugcuguagauaauagguuaaacuuuuguaaaacauuccguuagacaucauuucugugugaaagaauaaacuuccuauuaccagcuaauacacaaauaccacuugguauuuggagaagagaucuaugugcuauaaauaugugaaguacauauuuaucuuuuacccaauaugauuuuacgguaaaugaaaaacugaguugcaaggggcuucagaagucaucugaaguccauuuccuuuaagaaaaaaaaaaguauauggugguccuugcucuggucugccauauguucuuggcaaacaugucauagagcaggaugacucuguguaaauagcauguaugucccuagcaauaggaaguaauuuuuagucaucuugugagaggauccagaguauggauagaaucaaaguggggcuuaacagggagaccccaccccacacucggagguggguguucugccacuccuuccccaagcagaggcccagccugaggugucaccugcaucccuccuaugcccucaccuccaacccagugugugcaucugacccagugugugccccacacagagaccagugugucuuuaggccucuguaugcuagugacuuugcaucucaaugccuuauuuuccuuguaaagcagagccauaccugugcucaggggagacuagcaugcagaggcuccugcugugacgaugccagugaaugccaguggcaggcagggcugcuguguaggcacccuggcacugaugccauggacuccacccauggccuuaccccacaucaccagccagccagcuccccacuuucccagucucucccuccauccuuuugaauugcaacaguuguuagaacucuccuucagggccucugcaagcccaggcacccagugacauuuaugaagggaaggugaauacuuguguuccccagagaauuucaguucucauauuaggugguaugagcagagggauuugguuuuuaugacccagcacucugagcugcccagcugagacuuaacaugcuagcccucuaguggugcuacgguuguuucagaaggaaacagcuugugcugucucugaacgccauccaacuggaucacagcaccaaagaaugcacugcuccaugcuggagagcucuggucagaguagcacggucucugaguccuccugcuggagucccucugguccgauuugaauuaaggccccaugauucuucuuugguucuuucuaaaauaacugaugaguuaacugaaagugagcauccauauuuucuuguguauuguguuauguccuucccagugcaugcagauacacacagccccucauacugacauauacacacagucucacgcauagacacucuuggaaucucaugugauuuuaaguaguaaacacauuccacguuugggaggggaaagaauaaagcagucucaucgaggaccaaauuguaaaacaaaauuuguucuuuucucuguaugaugaagugcuaauuuugcucugauuaacuuuaauagaacuuugucaaggaaagaagagacuaagacacuuaguguguagugcuuuccuccuccccuccccuuugcuuuuuguauuucucucucugauuuuccucuucugaucacugcagucgguuaugggguuggagugccgacggguuagcgaagcacccaccucccuuuucucagccuaacuccauccccaccgcucccucccacaaggcucucaggcgcucuuacucucccagguaacaagcuaccugucaaacuugucugaggugucacaauauuauugcauuuccaaggucgucucaggucuuugggaaagccucuaagcugccuccaguguggucccuuccuuggugucacauagcaggaguagagccuuggugagaagugugagcaggugugugaucuuugccaaaucucacaaguaugguuccugcugugucacagggacagaugacccuuuauaagcugaucagauucaucaccaccuauuauugugggccuuucuguacagugcagugcucagcccccagaaagaccucaggaaaugcugugaggucagcgugggcaauagugggagcaguuuccuuagcaugcgucuaaagugcagaagacauuccccugagaagccaaaaagaccucuuucccaaaccauaccugucacucucagccuugcuauugacuauuuguaacugauuucuuuccuaacauacugucauaugaggguagucugagcacacagauccagaaaggaguccccaagaggcaggauaacuguuacagcucacuaaggaugcccugccucuaagaaggagaaacgucagucccuucacgcacccccacaguugaugcugaaugcggcaucauggacacugguuaugcaacaauguuaugagucuggaagaaggggugggcuucccucagaugcugaaucugugguacaaagaaggguccacauaguacugcagaugucuauuucagggucucuuggggaugcuuuuuauaagguccaaagaucagagaaucucuucccuagaaaccuguuagagcacugggcaguccagcugucacuguucuuugugagaugaguuucuauccucuauaauagagggugugauaggaaaaggguuaaaaaaaaaaaagaccuguuacuuuugaaauacuucauagauagcuuuugugcagauuugcauucugacuuuuguggaauacaaauaaucuacauagugaagccaaaaacaguaaaugaaauauuuuaacaacaccuuccuuuugaagcucuuauaccucuaaaagucauuucuaaaauguacagagaacccugcgaugaauguuucuagauacacaagguuagggcaagcaggcgaggagacggcugcugucuuuaauguuaacaaagcaggucacuccuuuuucuuuuuuuuaagguuagcugugccuccaaguguaagaucaguugguugacuaucucccaguauguugaccuguauucccucaugggcacucagcuucaccaccagccagccaucaagauugccccuccagagcacaucccauuccuaggaucaucuuucacauacauacacgauacauauugaccuaacucauuaagagagaaugcuuacugaauacuuauaacuucuguugcccauuggaggcagggauaguugacuagagacuuuuacauuuagaaaaccuaucaguuacauaaaacuaagagggaaucuguaugucugucuauuuguucugugccaaaauccuauugauuccauaacaaagaaugacuauccuuauucuauacauuguacccuuuuccuacaaaaugacgaagaaggcaggcuucucucuccaguuucucucucuuggagaccugaccccauguucuccucccuccccacgacauggauccuuuagcgggcaagcccagggcugcuuucagcuuccauguuggguggcauggccuaaccuuaggucagugacuauuggcugauuaaggaauucucccuaaucuaaaaaacccuaagagagcccuucuggagucuaaccagaguauuuacaggugaucagggccugaccucuaacccaaggauuauguccugggguugucucagggcugaaacaagacaggcuguggggcagauggcagauugagguuuccccaggucucuucucagucagcuucugaggccguccugcugcucccucauauacugcuugugaggacacaauaucuacccucccugaugauggcuuccaugggaaguuccuuuuuccuuuaagugagaacuuaacagauacugauuuggaaaaauauaauucaagccaaagcauaaaaauagcaaagaaaguagcauggucuguuuccuccuagagguaagcaguuaugccucucaccugcagcucacaguuauagcuucauaccaaggagauacuucaaaccccaggcuagugagucuaaaagaagacaccuucaauuguucuugguucugcaaauggugcuccugaauugggaguuugaguugguuuauuaauugaaagugagaaggaggaaauuaccuggcagaauccuuuauuuucuuauuuuaaaaagaggcuauuguaauagugaagugaugugaucugaaaugaaauauuuuuaagaaaguucagguuaagaauaaugagaugaauuaucugaaagcugacauuaucugaagcgacauauggaaaauaauauugugacaucccuuaaaaaaacuugaacguucccccagacuuccucuuguccaucccaucauucuuucaguuuuuuggauuuuuuuucuuuugcaugggcuaugcuguuauuuuugguuguugugauuaaaaguauuuuaaggcauuuuuuuacaucuuguauauauauuuuuuguuugagucauaauacucagucuuuauauauaaaaaauaguguacuggccagauguauaaaugccuuguccauacaaaagcuaguauugugguguccucagaaggagcgggggagccucuggccccuuggucaugccuuucucacaucuaaggaguguugccucuuugacagacagccuugugaacauagaagagguugaaaucuuaaauucucuucagguuuuuuauucuaccuccugucaguuuagacauggaauuucaacagcaaaccuguucaagguucacauuucuuuuuguuugaugcucaagucaaucuuugaguugaauuuuuuuuuuuuuuuugugaacucuccaaauauucauucaucaggaaagguggguuuuaucugggccauauuugcaauucuagacaaauagcucccaucuuugagauuguggucagcucuugggcucuagaaccuaccagcaccagcccuagaaaacacuuggaucauugcuacaucaagccaguagagaucuggccacuccaagugagagcucuccaaaucuuaccuugcucaucugccccaacuuuuuuuuuuuuuuuuuuuaaggcagaauacuuaaggaagaguauuuacuaaauguucaucauuuuuacauuacaggaaacucacuuugggaauguacaggauugguuguguugcccuuaggaaggauacuucguuucuucaguuacuacucuuuugaagaacaggaagauugcuuuucuuuaguccuuaaacaguguugcaugcuuacagccaaggauucuucgcgugucccuagcaauccucaguauagcucaggacuauuuuaaaaauuaaauuagacgaauucaucugaucuuuucuugaaacuuucuugaaacaagugacauuuaaacuaagauuuuuuuuuaacuugcccuugguugacuguugcuucguguuuugcuugcuuuaugcugauauauccaucccaugcuuuucuuuuauauucucaggaugguuuuuguucucaggauucucccuguuucagugcacuuuccagacaucuaaaaggcacuuguugacaaacugcagugcaccaaaaaggauuguuuggcuuuuuugcuucauuucauguuuugcugugcccaaugucuauaaagacagcagucaauaacacuuuucugugaacaacaaauauuucuugcuuuuaugaggauuuuuagauguccauccaggaaugugacuuuuuauaaaaucugcuuugauuauaaaacuccaaacagaagcauguagaagagucugauauuaauagcaagcucaugggugagaugaugugagaguuacuuucugggccuguucauaggguggaucugacuuugagucuaggguuuuuuguuuuguuuuguuuuaauaggguuuuauuuguuuucuggauuggauaccugggaguauaaccuagccuugugaggucauuuacuuugcuccuuugaaauuugcuuauaguacuagcuuuauuuccaacugcccauuccucuuaaguuuguacauuugagaccaguaacaaccaaacuccuuuuuuccaucuucaaaauaagaaaguuauuuuuccacuuucauuaucucgugccuucagucaccagugucacucuuugaguuccugcauucucgugguuacuguuguuucccacugguuuuuauugagugcugauguaauguguuuggcagauuuaacaaagaagauguguaauuguccgguggugguacucuaacaaaagacgucuccuuuucauuccaaaucacccaauaaacaaaacuauaaauaugucuuauucuuuaaauugugggaaguaacuuaugcccauaucucaguucuauguauaugccucgauuuaagaaauaaaauauuuuuuaucuuuagcaugcuggacuaugauacagagaaccugaacucugaagaaaucuauaguucucuacguggaguuacagaagccauugaaaaguuuaguuuucgaagccaagaagaucugaaugagccaauuaaacgagauggcaaaaaggagugugauauuguaaguaucccuaggcuaaaagagaacucuguaugaguuaaaugacagauaaugagacuucugaacacugaccaucaugauuacugagcuucaucauuauuuuuauccuguaguuaaaauaauguuuuccuuuuaguuuuaguugacauguaauaauuauacacauuuaugggauacaaagugguauuuugauacauguguagaauguguaauaaucaaaucaagguaauuaguacauccaucaccucauuuaucauuucuuuauguugggaacauugaaaaauucucucuucuaguguuuuggaaauacacaauaaacuguuguuaacuguauuuacccuacaguacuuuagagcagcaguccccaaccuuuuuggcaccaggaacugguuuuguggaagauaguuuuuccacagaccaggccaguuggugggaggaugguuuggggaugauucaagcacauuacguuuauuguguacuuuaucucuauuguuacuacauuguaauauauaaugaaauaauuauacaacucacuaugauguagaaucagugggagcccugagcuuguuuuccugcaacuaguuggcccugucugagggugcugggagacagugacaaaucaucaggcauuagacucucauaaggaccacgcaaccuagauccccucgcaugcacaguucauaauagaguugacgcuccuaugagaauuuauugcugccauugaucugacaggaggcacagcucaggcaguaaugugagcaaugugggguggcuguaaauaagaugaagcuucacucacuugcccacugcucaccugcugugcugccuaguuccuaacaggccacagaccaauaccagucuauggucuggggauuagggacuccugcuauagagcauuagaacuuauuccucuuaccuagcugcaauuuugcagcuauuaaccagccuguuuuccuccccgaccccccccccaccccuucccagccucuaguaaccacaguucuacugucuacuucuaugagcucaacucuuacuaguucccauaaaugagugagaauauaugauuucggucuuaauguaccucauuuauuucacuuaauguccuccaguucauccauguugcugugaaugauaggcuuucauuucuuuuuauggcugaauaguauuccauuguguauauaugucacauuugcuuuaugcauucauuuguugagggacacuuagauugauucuguaucuuggcuauugugaauagugcuauaacaaacaugaggguguaggcaucucuuugauauacugauuuccuuucuuuggauaaauucccaguaauggaauuguugguugugugguaguuccauuuuuagguuuuugagaaaccacgauacuguuuuccauaauggcuauacuaauguacauucucaccaaugguauauaaaaauuucauuuucuccaaaaccucaccuuuguuauuuuuugucuuuuuuauaauaaccauaaaauaguauuaagaggcccaagguaauuaauuuuacaaaauuucaaaagagcaacccucagcuaucuuuucaaggaauguuaagugccuuuuuucucaguuugcuuuuguuuauucuggacauaguuuuguuucaugauguaauaaaaauagugagccugaaccagacaccaccauggcuuucugagagcuccagucucaugggagaggcagacagauaagcacaggaucauggugcagugaguauggccacugcucagcauccaggagacccguggcuaguuguggugccuagggaggauguuguauuagucaguucucacacugcuauaaagaacuaccagcuaggugcgguggcucacaccuguaaucccaacacuuugggaggccgaggcggguggaucaugaggucaagagaucgagaccauccuggccaacauggugaaacccugucucuacuacaaauauaaaaauuagcugggcuugguggugcacaccuguagucccagcuacucaggaggcugaggcaggagaauugccugaaccugggaugcagaaguugcagugagccgagaucgugccacugcauuccagccuggugacagagugagacucugucucaaaaaaaaaaaaaaaaaaaaaucagaaacuagguaauuuauaagaaaagagguuuaguugacucacaguuccacagguuguaugggagucacagcugggaaggccccaggaagcuuacagucauggcauaaggagaagcaagcacaucuucacaugguaacaggagagagagagugaagagggaagugcuguacacuuuuaaacaaccagaucucaugagaacuuacuaucauaagaacagcaagggguaaaucugcccccaugauccagucaccuccuaccagguuccucccccgacauugggaauuacaguuugacaugagauuuggguggggacacagagccaaacuauaucauucuacccccggccccucccauaucucaucaccucacauuucaaaacacaaucaugccuucccaacaguccuccaaagucuuaacucauuccugcauuaacucaaaaguccaaguccaaagucuaaucugagacaaagcaagucccuuccgccuaugagccuguaaaauaaaaaacaaguuagugacuucuaagacacaguggaacuacaggcauuagguaaaugcuuccauuccaaaagggagaaauuggccaaaacaaagggacuacaggccccaugcaagucugaaacccaggagggcagucauuaaaucuuaaagcuccaaaauaaucuccuuugacuccaugucucacauccagggcacacugaugcaaggaguaggcucccaaggccuugggcagcuccacccuuguggcucugcaagguacagccccuacagcugcuuucauggacugacauugcgugccugcggcuuuuccaggcacacagugcaagcuguugguggaucuaccguucugggaucuggagaacuauggccuucuucucacugcucugcuaggcagugccccaguggggacucugugggggcuccaaccccacauuucuccucugucuccccuaguagagguucuccaugagggcucugccccugcagcagacuuuugccuggacauccaggcauuuucauacauccucuaaaaucuagguagaggcucccaaaccucaauucuugccuucugcauacccacaggcccaacaccacauggaagcuaccaaggcuugggguuuacacccucugaaacaauggcccaagcuguacguuggccccuuuuagccauagcuggagcuggagcagcuaggaugcagggcaccauguaccaaggcugcagaaagcagcagggcccugggccuggcccacaaaaccauuuucccucuuaggccuccaggucugugaugggaggggcugccaagaaggucucugaaaugcccuggagacauuacuccauugucuuggcuauuaacauccggcuuuuaauuauuugugcaaauuucugcagccuugaauuccuucccaaaaauggguuuuucuuuucuccugccugguugggcugcaaauuuuccaaacuuuuacacucugcuuccuuuuuaaauauagguucuaguuucaggucauuuuuguguuuaugcaaaugaacagaggcuuuuagaagcagccaggccacaucuugaacacuuuacugcuuagaaauuucuuucaccagauacccuaaaucaucucucucaacuucaaaguuccacagaucuguagggcaggggcacagugcugccagucuguuugcuaaagcacaucaagagugaccuuuacuccaguucguuaucuucaucugagaccaccucauccuggacuucacuguccauaucacuauuagcauuuuggucacaacuauucaacaagucucuaggaaguuucaaacuuucuuucauuuuccugucuucugaucccuccaaauuguuccagccucuguccguuacccaguuccaaaguugcuuccacauuuucaggcaucuuuauugcaauaccccauuucugguaccaauuuucuauauuaguuaguucucacacugcuauaaagaacuaccugagacuggguaauuuauaaagaaaagagguuuaauugacucacaguucuacagacuauaccggaggccuggcuggggaggccucaggaaacuuacaaucauggcagaaaggcaaaggggaagcaaguaugucuucacaugguggcaaggcaagagagagagcgaagggggaagugcuacacacuucuaaacaaccaggucuuaugagaacucacucacuaucaugagaacagcaagggggaauuccacccccgugaucgaauuaccucccaccagguuccucaccgaacauuggaaauugcaauuugacauaagauuugggugaguacacagagccaaaccauaucagaugugcaaaagagauuaugucaccucugaacugaagcauggagguccagaggaguuuguuaggucgaguaggaggguuauagucaggagggccuguuugaagacuaagacauggauguaggcauggugugauuuccuauucgaaguggcugaaguggagaagagugggcaugaggagugguuggggagauucagagcaggaaggaugugcucacugggguauucccagccaaugccuugacuucacccuggugauacuggagucauugaaggaucuuuaagcagggaaguggcauagucauacuuauauuuuagacaggcuacuguaacuauggaauggagaauaauucagaaggaagugggauugaauagggcaugagcagaaacagaagaaucagaagucuucuggggcugucgagcaaaugcuagugcaauucagugaaauauuacccuagaaggagaugcucucuuugaaauauaacgaauucucuuuugaauacaugcaaauugcaggaauuauggaauauccaagcaaauauauccaucgagacuuuggauauaccagucuguuucagccagugauuuaggcagaaguuagauauuugagagauauugauuaguugcuugaagauaacuaaagaaaaguaagugaaaucaccagguaaaggauaaggacagaauccuaaggagcaucaacacuaagggaaggacagaagcuagagcugacaggagggagaccaggagagggugguggcauagaagauaagggagacuauuucaggaaggacauucuagccaaaggggccaugcugcaaagagauaacaggucacauaugaaaugaaagggcuccauuggauuauuugcuuauuauccacauuaaauguucuauuuuaaccuaaaagauauaaaauacacauuuacuugccaauguuuugauguaaaguuaagaccuuuccuucgagaaugggcucacuggauuuccauguuuuucuucuuaaauaaacuuuacacguaguuacagucugcaauauccaaaguuaguuacuuccaggaguacauuggaucuugugagcacaguugagugcagaguugagaauggaaaccagaucacagugggugaagaaguugaggaacaaacuggagagaaauaaggaucaaagggcauuucagaugggagagaucucucccagcagggccaguggagagaagaaccuugccuacacaguggaggagagcagaugauuggaugcgauccuucaggacguggggacgugagauuagggcccagguagaaugacuggucuuagcuagggaggagggcggcuuuaggggcuugaggcaggaaguagagcguguucccacugccgguuucucagggcaguggaaggaggccugcuuugaagcgggggacuuguugugaggaaugggggaaucugacuagggaaacagaacuccuaucaagaacaguagaaaagauggaugcgugagggguuacuuuuuccaauuaugguggcucacgccugcaaucccagcacuuugggaggccaaggcaggaggauugcuugagcccaggaguucaagaacagccugggcaacauagggagacuccugucucuacaaaaaaaaaaaaaauuuaauuuaucuagaugugguggugugcacccuguagucccagcuacucgagaagcugcagugagaguauugcuuaagccuaggaguuugaggcugcaguaagcuacgauugugccacugcacuccagcuugggugacagaguaagauugugucccuuaaaaaaauauauauauauguauauauacacacacacacacacacacuuaauaugugcccaaaaaaugauacuuagaaagugaaaaagaagaaaucaccaucucuagagauaaccaguguuaacacuauaggguguauuuuucuauuccuuuuuguauauuuauacauauauguguguaggggaguguguggaguauugcuuuuguaagaguaauaucacacuguccaucuguugagcauagggcaugagugcuuuuccgucaguuccugugugaguuguggcuucucaaugauuccuccuguggaugauguucuguagaugggcacccaguguccuguuucaguauauuuagaugguuucugauuuugucaaguguaaaaauacugugaugagaguugaaagaagugaaauuugggagggagaaaauaaagagggcaaggccugggaagccucagugucaccuagggacagguggaguggggggagugcaguggcagagcugcagggccaggaggagucaggaagugccaugaagaugcugcaugucagagcaguggcuguuccugcuggagaauguggccucgagcagcaaagcuaggguggcagugaaaaucgaagaauggaccaggcauggugacucaugcugguaaucccagcacuuugggagucugagguggguggaucaccugaggucgggaguuccagaccauccugaccaacauggugaaaccccaucucuacuaaauacaagaaauuagccagguuugguggcacaugccuguaaucccagcuccuugggaggcugaggcaggagaaucgcuugaaccuagaaggcggagguugcagugagccgagauugcaccauuuacacuccagccugggcgacaagagugaaacucugucucaaaaaaaaagaaagaaaaucgaagaauggaggagcuucacaauucaccaucuuagccaccacuuaccauauguuuaguuaaaacauugagguggauauaaaacuguguuaaaugugaaagacucgggagccaguacaucuccucuuaagccuaacaaggaaacccaauauagggagacaagccaauaggaugaaugucagaugcaguaggagggugaugcacacagcaaaaaugaagacauucaacauagggagaaagcccauccuuacggucaauuacagaaauacagcagacuuauaucaagguucucuucugcuuugcuuuaauagaaauuacaacauuuaauacuagaaagagcauaaggaucuaguguaauguuggugccaugggaaacugauacaauguuuuggaacucaguaaaauuauauuuagcaaaagugauuugcauauucuuuacccaguaugguuaaucuacacuaaagaaagaacucaacagaagaaaaaaaaaugucauuuccauaagauagcuuauuucagcauuaucuacaguagcaaaaauauuaaaggggaacaucugaguaaaucuuuuuuaaaacacaaguagagguaguggugugauuaaacauggugguuacaaaaacuucauccacacgggaagugcuugcacuguagggaaaggaaaacagaagccagcgugcacaccggguuccugcugcguaaagccugcguggagacacacacugagggaguaagguuuuguuguuaacagugauuagaauugggaguugagcuuuauuuuuuaaaugucugaaauuuuuaaaacccuucucuuuuuuuguuuuuuuuaaaccuccuguucaauggcuuaccuuuuuuauaaauaauuuuucauuauaaugguauuuuuagaagacuuauaaaaagaaacaauuaaaaccauccaugaauuuucuuccacccagagaaaaccucuguuaagauuugauuuauaccuuuuuagucuuaauuuguuucugucuacgcauauauuauguauuauuuuuacaucuuaauuauaaaauuuuguuuguggguguuagaaaccaaaugcaucccagcaccuccacuagauucaaguccaaaagaauugaaagcagggacuugaacagauguuugugcaccagugugucauagcagcauuauucacaagagccaaaaggcaaaagcaauccaagugcccaucagcagaugaacagauaaacaaaaugugguauauacacacaguggaauguguucagcaguuccacuuaucugagguaccuagcauaggcagauuccaagagacaaaguaagauaaagguuaccagggguuguggggaagggagagggaugaggaugcaggguuuuuguugggaaugaugagaaaguuuuggguauacauaguggugaugguuacacaacaucaugaauguauuuaaugacacugaaugaucaaaaaugguauguuaggaaugaucaaaaugguauguuacaucuacuuuuccaaaaccggaaaaaaguguaaaugcauuagcacaaagugagagaaauguaucuugucaucagcacaaguaaaaauuuugccauaggugucaccaauguguucuggcugccuggaauguuuccaccguuguuggguagucagauguuugggaugaggaaaacagucuguccccguugccagcagccagcccacaccugcugggcuacacugccaccuacaaaggggcuagaccaguggugugccccacagcagaggacccuaaaagcaaaagugauuugcucuugucgauaccaugucaagggcccagucagagggccagcgguugaauuuguugaagacaacauucagaauauacuagggaaaaaaaaaaaauuugggaaauacuaaaguccuguucuuugacccagcauaacaacucugagucagaaauaucuaaaagaagaaugauaugccuaggaggugcugaguucucugucauaggagauugugaagcgccgaggcccagcacuaggcaggaauacauauaguacaaggaauuaaucuggggauggaugacacccauuagacuuaaugauggcgguuggaggagcuucugucuguggaugugggccagggccgcagugagaagcccccguugcuggucuggugcuugaaagcaggggugugaguggacagccuuuccuucucaaggaaaggcuucugagccuuucaucccucagaaaacaucuugguaaaguggaucaucaaauuacaaaguaaaggagauuuaaagcguaaagacuagaugcaaauaaaugcagguauauuguuccuuuuaugguaguuuacggauuugguauuuuuacauugcaguacuaguagcuguccuuuugucacuggccauacauauuucaagugaaaaucucuggccuucuuaauauuucugagcauucaaaggaaauguccauuacaagucccagaagggaacugacagugugcugugcugcaggugucccgcgaugggggcgcugccuccccugccacugagggccggggggguagugaaguagaaggaggccggacagcucuggauaacaagaccucacuacucaacacccagccuccgcgcgccuucccggggccgcgggcgcgagacuacaacccguaccccuacucagaugccaucaacaccuacgacaagaccgcccugaaagaggcuguguucgaugacgacauggagcagcuucgagacgguuggugucucuuuucuuaacuguccccacccagaagugcuucccuugugcucccucccgucuggccagcaccaggcccacuggucagauguaaauggagacgcugggucuguucuuucugcuuagucauuuguucaggcacuacuuaacugaaucccuacugugcgcuugggcacggggaacauggcagugaacagaagcacaaguagcggggcagugaggaaauaaacagucacacgugauaugaaguagccacugccacagcugagcaugagggaaggccaacucuaccaucaggaagguuuugcuguagaacccagggcccagguaggccagggguguaggaacaaacaggauggcgagcgcgggcucagccuuugugaaggccuuggaccugcuucccagcuccccgagcuguggagugagauccugaagcacugcucugaggcuucccucuccuuucacaccugcuuuguaaccaggucucccuggagcuguguugaccuccgugcugcauuugggaggcagggguuugacauacacacugagcauuugcauuaccauguguggugccaagcuaaguauggggucagaaagauuugcccaaaauguaacguaagcauauaacauaggaaguagggagcagaagcagagcuagucugguuucuuucuggcuccuguguuaagaccaguguccauuacugaauaaacuagugagugaugaguauguauuuguacaaugguguuuuuuucgggaacugaauuauuuuuucaccucucauguuacaugauuugguuuauuucgauuugauagugcuuuuaaaaaaauauuguuuugaagccuguuuuauuucucaaguuugaaugaguaauuagaaccuacauuagaauucuaaauaguuaacauucacuaagggccuaccgugugucaugaaguguauggguugccagggaccgaggcacaugagacacagugccuggccucagagagcucaaggucugucaggggagcagacugauaguggucacacuaguaccagagaaggccugugcuggaggcagaugccagauccagucggggcacaaagaaaagaaagcugauccucuugcagggaucagacaguaggggaaugcuaagguagaagaggaguucucuguuugaaagcagaaauggcuguagggauuaaaagccuaaucacuuggcuauuaauugcuuauaugcugguggguagcaucucagacucugcccacacaucuguuuacuggacagugagcuauuaggguauaguguuuguaaggacuggcacuuccugggagaaguggacuauuuguuuucauugcuuauagaauuguuuaccuuauccuuuauagaucuugauuaggguagaaauuacaguguugguuauucaccaacuguguacuaaaaggcuuaaagaaaaggaggaaaagauaggaaggcaggaggaaaugacagaguucuuuaccauuucagacuuucuuguguguuugcuacccaaucuuagaagcuaaagaaguaugcaaauacacauuuaaguaguuccuaauaacuugucugauuuguuuguuuuuucauccucucuauuuaaaguugaauauucagaguucagguuucuuaaaagaacauggaggagaaaggaugugccuuucugccauagaaaccguguucacagcccugcagguaacuauguugagucaucuugggccaguuuuuagucuccacauagauaguccaccaguaguccaaacaccuugacugguauuuguucaccaugcugguuccuaagcuguagacauuugagaagggaauggaggauaaucagaugugauggugaggaggccuugaggaguauguguguaugagaguagauuugacccugguaagaggcuguccaguggugggucugacucaggaccauggcagugggagagaguuucagaaaauaaaaggguugaggaggggcuuuggcggauacaggcauuucuucucuuugucugaaguagaagggaaaagauagcaaggaagggugaagacauugacuguugguacuggacagcuggucucgcaccucugcuuucacagugaacuuggugagaagguugguggaggguguguaggcugaggccggacagcgaagcagggcggagggugggaggggaaccgugaaggaggcaucgccucugggagaggaggcaggaagggaaggaucacugcgcaccacugagcaagccccugugcugggcauuuccucacgaggugacguaugucugguguguuucaccagugcccaucgaccauucugaccugguggcugaccuucugaaagagcuguccaaccacaaugagcgaguggaggaacggaagggagcccugcuggagcugcucaagaucacgcgggaagacagccuuggugucugggaggagcacuucaagaccauucugcuccugcugcuggagacccuuggagacaaagacgugagaugcugguuuggccuuaucuugccccuuuccauguaauggggucacgauguccuuuucuuauugggcuuagcuucagcuuuacuuucuggguugugcuuacuguuuacaucaaaacauuuauuuguucauuuuucacauauuuucugagcacguuuaguaaggucauguuuuuaucagcaacaagcugcugcuuggcuuacgugcauggucugcaacuggguuuauaguaguugaggaaacuucauuccugcaucuaguugcuuuaacacagaauuucuuaaaacuuuauuagcauagaauguggucuuuuaggauguacuuuuuuacuugugaguuucauuuuuguuucauauguaauugagaaaaaguuucauuuuaaaagaccugauuaaaugcuacauuccaugaaauuccaucuuggucccccccuacauauguuaagaguuccaauaauuuuaaucagucaaguggcagguuccagaagcaugauucugauuuuuguauuauuaauuuaaaaauaaaaaaagcuucaucaugcugggacacuugaaugugacaaacuaggcauuucugacaugccuggucugugaucugcacaucgcacauagagaacucuuaaaggggggaguaaucuggucaaaguccugccuucucccaccuguggagcuggucccuuauauggaaacaggaauagaugcugagaauuaccagaauuaaaccucuacaagaaaaaguuucuccauccacauggagaagagaaaugagaagagagugcuguggggaggggcuggaggaaggggaugggaggauugccaggagguggcaggccaugcccagggccagcuagaggggacuugcauggcaacugagugacagggaggcugcugcaugccaugccguggugacucagauagcuuucugaugcuuuggauuaaugguuugguuuagggauaaguaaaaauagaagaaugguaauaaguaaucuguuuuacuuuuuuaaaaaaaacuuuuuaaaaauacuuuuaaaaaaaacaaaguauuggcucguaaggcaguuaugccuuguuggcucuguugggagauaaagugaugucauguagaagacagguaaaugguguauuagugugugaacuguacagaugaguggcaaagaaucaggauguacuuucuggcucuguuugguguaaacuacguucucuuuuauugagaucaggagucuguuuggaauggcuuuccuccagaugcgugacucuggccuuaaccaacucgaggccuguacacacccagugaucucaucacauggaaggucaggaauaaugacaggccuuccacuguccuuagguggaguucacucuuacaggcuguguugaugaaacauccaggugcuuuauacacauucuuucauacauuuuacagaagcauaauuuguagccugaagccucaggaaaucuggaaauccccagaaaacugauaaugaacuuagguauaucauccucauuuggucucaagugcauggcucguucaaguagcuuuucucagugccugucaggcgcuggguccugggaaugucacccuaaggcacagugccugccuucauggagcugaugucuagagagccagugucaaguaaagcugauuucaagugaacugugugaucuguuuagaggguucugcgagguuccagggaacccagaacugggugcuuggccuugccgacccugcugacugcugugugugaaagugcugugugguguuuggugaugucuuccuuucccuuuguauucuagcauucaauucgagcacuggcguuaagaguuuugagggaaauucugagaaaucaaccagcaagauuuaaaaacuacgccgagcugacgauuaugaagacucuggaagcccacaaagacucccauaaggaggugagucagucauguggccaggggugcugaacagacgggucaugaggagcaguuuggacauggagauagaggaaucagaaucagugcacagcuuaagagccccuuccuuggaacucagccaugucguaauacagaguggaguccccauugcugucguccuugcugagcaguggcauaguuccagggccaaugccauuuguucaguuccuagcuccugcucacuguuuccagcaggccugcccugccccugggauguguuccauguccgugcuuccagcugccuuuguggaagggaagggucugcugcugcuuucuggcauuuagccucugguagucuggugugggagguggagaccagcuuuggaaucacagacaugcaagucccagaaccaaugccuucuugcuccagauaaguggaccagucauuucaccuucugagccuccguuuccuuguguguaaaauaggaauggauauuuucacaaaguuucucaugagaauuaaaugagaugaccagggaugauuccagcccagcgccugccaacaguggguagcaggcugcuguacugaccuuccucccucccagccguucagugugcuucucucugcaagaugaggcugagugguggcagcccugcugugccucuuccacucacuuuugaguauuuaaaaugcuagcaagcuaucucugcaguuccuggcauugggaccucagcuaccugguagagaguggcaggacaugucucuguguccugcacacaugccacagagggugcacacucagcaaaaacucagccuguugcuuauuggauuguccagccccuaugccucaccaggcuuucaaguggcuagaagccuacagagaauggggagguggcaggagcuguccagauacaaaugauucagugacacccuucaguaaaaggaacugugggaaacaaacucauauauuggaacuucagaaaacuuagcaugccagguaauggguuugaccccagagugagacauaacaacuugcuuaguuugagcucuuggcucaugugugacugucgugugagcacacucguggaugaagggaauuauaguuaacacaauucuuccgucuacauagagagucagacccuagaucauaguucuguuuggcguuugugugacugcuugagcagugacugaugugaccucuucaaaucuccaccacaauuguagcucagcaagggcgagggucuuguccucagacugggccucucuucaccugcuaguccuagaacagcacacaguacacaggggauggauguguuuucagacuaauaacuggguuuccaaaaucuggcuugguugcaugauggugauaauaacucacauuugaacaaagcacuuuucauuuauaauaacucauuuaaaaaacgugaagaccagaugagcuaguacgaucaacauagugauucccaggugaggagggaagguccuagagcaggggugucccaucuuuuggcuucccugggcugcguuggaagaauugucuuaggccacacauaaaaugcacuaacaauagccaaugagccuaaaaaaaaaccacaaaaaauuuucauaauguuuuaagaaaguuuaugaauuaguguugggcugcauucaaaaccauccugggccacggguuggacaagcuuguccuagaggaacuguaugcauagcaguuacuggcagaacugagacauuagcuagguuuugugucuccguuaaggggcaaauggcaugugcuaacuuuuuuaaaccauaauugcuucuccuuaaugagaauacgugaucaaaaaaugaaauuaaaaugauguucuuuuuguugugcuuuguauuugagacagggucuugcuuugucacccaggcuggagugcaguggcacaaccugugcucacuguaaccuccaccucccagguucaagcaguccuccugccuuagcccccugaguagcugggacuacgggcaugagccacugcaccuuuacauagagaugauaucaguuguuuucauggggcaguacauacuuagacucgggcauuuaaaugaaaugccaagccguccauggugucuuggcacgcacuuaccgacucuccaguuggaagauaucugucuaaaguugaguccuaagaaguauaaguuaacaacauuaaguaauugguuuguuauuugcuuuuuucuugggagauuuuuuuuuuucugcaaaauuagaaauuuaggagagaaaauucucagguaugaggcccuuuaaauugcccaagggaaaagagcagaauauauauccugcuuaaaauaaacuuagcagcacucggguucaaggguccccaugcugcuguuacugacuugugguagagcugguggaggagauguguugggaacggugccugcauuggcaggccuuccugcuuugcauaguuugacucaccuugacucauugcccuuggaguuuccuuauaaaacuuuacucugucacuuugccaggagccacuauaauaacucaagaaccuguguauuuagguuugagguuggguuuucauuuuucguuccuuuuuuuuuuuuuuuucuuuucccuugaaguucuucuuaucuuccucuuauuuuaaccaaucuuuucccauuccuucuugccauuuuuuagggcagaaggcugagaugcacauaaaguuuguguuguaggcaucuuguuggcauauuaauauggcacguaauaguucucuaguccuuccauuuucuuaucauugcauucaauucuuaugacuccaaacauuuauugaaaaggaucugaaauguuucuagacuuacuuuauuagucauacaaagucauagucuauuuuccugucuuauuaauacuuccaaaguuuguuuaucccaaaguuagcucucuuggagcuucguucucaauaagaagcuaguugguuuuauauucccagacaaaaacugggcuucagcaggagaugaagagcguaagacucggcagguuaacauggggcugcuuuuagagauauuggcaccagcugcccuucucuugccagcgugacguuaccacaccagcaugugcacuguggcucugacuaugugacugcagcgaggaaggacagcuucuugaaauacaauuucuguaaauugaaauuugucacaaaagcuguuugggaagauggaugagauaggacugacgauaagauggcuuguuuucucauauaagcaagcgucugcuuugucaguuucuuucaaaagaagcuauaugugcagaauguguuucuuacacauugaaaaugugccaaguaccaaaucugucucagacaccauucauccaaagcuaacauacauguucuauaguaagcaagauagaugaaggauuuggacaccaauuuagaguuuuuauuuuaaaauuugguguuucugagcuuagacauaauguuuucauagucccuauuugaguaagucucuuucauuaucuaacuucuuuaucuuuuuaguaaauaaauuuugcuauugaguuucagugccucauuaaugaaguuaccgugguuugcaguagaguuggcauuuagcaaauaccuuaaagggcuaaggccuugagagugaccuuuuaaaauuuugagcccauuuucuguuuccaagagaacuccaugaauuugaacucuucuuauauuagaauuuguaaucuguuuguuagagcugguacagaaccucuccuuuggugauuaaaaagagaggauuaaauaagagaauugauacuacaaagagauucuggggucagugugagauaaaaaucuugaggcagaaaaccugguuuuuaguccugcgucugcuguuguccagcuguccccaguuucaucaucuuaguauaacccugaauaagcagcucugcugugagaaugaaagauauuaugauauagaaauaugcuuuuaaaauugucauaugcuauacaaauguugcuacauaaaacuguucucagacauccuuauucauuucaaaagugcccauuucucaggaaauaguugauauacuaauuauaaaucauuguaugcacacuuaaugcaagaauauuuguugcugccagucagugugaugugcauauaguacccauaauguugaaguucacaguaaauguuuuauuuaaacuugaaagaagcccaacuguuuuuugaagauauucuguaauugagguuuucugaucauuagacuuagcuuauucugaacuuugccacauuagugaauauccaguuacacuugucuguuaaaagaggaaaauauuagcaucauucaugucacugugcuggaucaccaaacauuucuugcuacacacacaaaggucgugguguuuaaggcaccagaauccagcuucaagugguuuggcuuguuuugggaaguuugauucuuagauaaauauaaaaccaccaguaguaugucuucagggguuuuauuuuuaaaucauuucuaguuaacuuuuuauuuuaugacuuuaaagaauuaaaauggcaaaaucagaccaaaguuauuuauaaaagaaagagaacuuccugggaacuugucugguuucugauucgcccagccagcaugguaucucaugcaguccuuuagacaaaugccauagucagagagaagcaccagugugccagagaagauaugugaucaaauaccaguuagaaucacuagcugaccucaucucagccagacccccugcgcucaggaauggcccuuaggugccucucagggcagcagucauuuguaucaaugggcacugggaaauaauauacugcaugaacucuggagaaaugccuuuaccccucuguacuuugguuuuuccuuaucucuuacccuaucaaguggacuaggugauuaucuguguuucauccagccucaagauaauacagguugcuguugaguagcaaaccaaaauccucaaauucuaaauuuucaguuuucccuaggcccaaccuugggauaugaccagaagccccauuuccuuuguagguuuuugcuuuuuaauaaaaagacaaaaccccaaaaccuguuuagcuucauugagagauuccaaguuacugagccagcagucauacuaacagcacaaacuccaauaaauguuugaugauugauggguagugguguacuguagucuucaagguccuuacgguuuaguugagguuaaagcagagucgugugguucaaagugaaauacaccaggaguuuaggagugggcuagaauagucaaggaagaguuccuuagggaguuagaaccugagaugggcugaaaaggagcacauagggagagaacuuuagcuaggagccaaggccauguggccaagggagggggcaugggcuuggaagacacuccuggguugaacccugcugagccaagauggcaggagacuuaccauuuugugagcccucauauucucugugucgaguggagaaacauagcccaccucacaggcuuguaaagugccaggcacagugucuauuucugaguggcagcugugguggcggcugcuccugcuguuauucauagguaggggaguaguucugccucgcugaugaacugacucucaaggagccagaugugacaccugcccuuuaguucuuguagcuucagaaagagccauaacuuaaugucaaaaccuuugaguuugggguuugaaggccuggguucacaugcugcuuuugccagcucgggggcugugauuguggacaagucauagacacucuggauaucuaaagcacuuguaugcugggugggagguggggggcagguguuuuauacccugcgcugagaggcuagcauuaaagucaagugagguaaggugguugacauuguugaaaauugaagauaguauccuuuuuauacucuuccauugaagaaaguagacugauuuugaauagaauuguugucaaguuuuuaaaauucuacauaaagcagauauaacugcauuucucuaaauacaccgaagaagcuauuaaaugcaauugaguaaacucuaaaacaccagucaaaaauacgacuuguauuuuuugacuacugcuuuguuuggaauccgucuauauuugugcugggguagccgguacauugucagcguuaggcuaggaaaugccauggguuuuuagagauggauaccggaauuagaaugccaaagagaagccuuaaacgugcugcccagcuucccaucugaugcugagcaccuccugagaggccagcccagccucugcagcaucuccaggacagcaggacacaccaccuccugggcucccagccccucuuuccacuccuucucaucauuugucccuguuggcccuaguucuaccccuuagaguagaacagaauaaaucucccaccuaagaaccugaccacauuugaagauauccauuguguugcccugaaucuccuuuuccaggcaaggaugugaugacugucuuguuagaggucauuucauacagacacuacuucucaagaucuucaaagcuuccuggaauuuugugcaugcacauuuuucaggggaaaagacucaucagguagaguuggaugauaagauuuuauaaucugaaauacuuuuaaaauaauugauucagauucucccuuucguuuuacugaugaggaaaaccgaggcauagaaagugaagaaauuuaccccaagcucgcuuggcuaguugaugccagaaccagagccaaaacucaggucuccagacuuauagccuggaacuuuucuucuccccucccucugguacugagccuagcuaagugaggacucucgucccagguucagggccaugcuggcacuccguuguaaaucccaggaccaugucagugccaaucuggggcauuggucguuuuuccccagucuacugguggauacuuaaacucagggucaauccaauuuuuuaaggucuuucuggccuuucccagaagguggcgcuaaacucuuccuuagcuuccacacgauugaguagcuaagcucaagacgcugcuaugaagaguucuuugauuccagccacuguuguuccuggaccuuugcuuuuuuuuuuugacucaaccaguuauucuggugugucugugacagagccagaucaaaccuugugaaccuaaaaaacaugcaauccaaauuuugaaaacuuugugcuaaaagaaaccuuuaagcaaacauucaccaguauucugaguaaugauccaauuuuaaaaagcuagaugugaaaauuacgcuuuucuuagcuagacacuauuacuucacugacuuugaaaggugaaggagugcuguguuucuaaugagacuguagcagaauuggaauaguuuuugaugacuucaaggcagauuauaacccagaagucuuuuugauccuguccucuuugaauagucccucaccccuuucuaaauccuugccacuucuggccaccuuguguacuaagugguguugucuuccuuuguuucugcugcccauguugacuuuugcucucuguuugcuuacauuuauaaucuuugcuucuuauguuacauagaacacaggggcaaaaccugaaguucacccugauucaggcagcuugccaaagccagggguuuggcauauagagggaaguugagaacaccuaccucccuugccaaaaccagcgucugucuugggaaacuuucucuaaccccagugaaaaagagggccucaaacuacccaucuuaaugugcagcuucugacauuuuauuuucagacauuuuagaaccaaagcccucauccacauuagauacauuugaucauccgggcgugguggcucacaccgguaaucccaacacuuugggaggccgaggugggcagaucacuugaggucaggaguuugagaccagccuggccaacuuggugaaacccugucucuacuaaaaauacaaaaaaauuagcuaggcgugguggugugcgccuguagucccagcuacucggaggcugaggcaggagaaucgcuugaacccaccaagauggcgccacugcacuccagccugggcaacagagcaagacucugucucaaaauaaaauaaaauaauagauacauuucaccaaaugcuucaugcaggccacauccagaauuccuggauuuuuguaagaugaagggcuccuuggguuuggguuucagcucagcagaucugaaacagccuuuuuucccagcagcucucuguaggauaauucacuuuaaccugaagggcaauagagugcaggagauggggaggagagaaggaaaaccacgaguucucaccacgaacccggcaaucaguuaccuggccucacuaauccucguugcaaccccgaagagcaccaggaggccuuagcuugcuccugucaagccuggaaagcaaugcugcugacucuugaauccugucuccagagccguguucuuuccacccacugagcugcuucccaccucccaggggaccucagauauugacuccugugcaucagugcuuucuaauuuugauacgcuacagaauccgguguuuucugaccuuuuguuucuuucuccagguuuugaaaacagaggccuaaaaguuccuuagcuuucaggcugguguguuaugauacuugggcaguaauuucuugcacuagaaagccagcaguuucugagcaugguuucauugcuaggccagauuagauaagagagggacugucuccuuccacuuuucaccauccacucagcuguguguaacucagccacauagguacacagccacgugcuuggcuuucccaaacacacacagacucugagaccugcacaaauggaggaggaagaaaagcgccccgucugagguaacccauuaccugacagagcucuuccaagaaacaugccgguccuccucagacaauuggugacuggaaaaaccugagcugaagucucuuuuccaaagaacuagucuguugcuuuuccagugugucaccuggaaugggacucucugggccugguacaguagauuuuucuacagcccaaguugaucauuuguagauaaccugccaugcuccuaguuuucugugcuagcuccuuaggaaaaauguaaauccaagucaauguggcaugcuccagaugugacuuugugagucaugagcauuaaaaauauguacgcuggccuggguguagugguucaugcuuguaaucccagcauuuugggaggcugaggugggcagaucauuugaaaccaguuuggguaacauagcgagaccccaucucacauacugagaccccuacaaaaaacuuaaaauauuaugugugccuguaaucccaccuacuugggaggcuaagguaggaggaucgcuugagcccaggagaucgaggcugcagugagccaugaucacaccaucgcacuccagccugggcaacagagcaagacccuaucugugugugugugugugugcgugcaugugcacacgcacacuauggggaaauuaguucaacagcuauuuauugagcaccuggcguauacuggacauugugccagucaugggaauagaaagauagcuaagaugggaucuugccuucaaggaacuuuuagucuagugggagggacaauuucagcaaaauauuuaccugcagugauaaaauaaagcauacacauggugaggcuuccugggaguuguguugcaguaaguccucaggaugacuuggccaggggcauagagauguggcugggcagggugugggcagggagaggaagcaccacacaggcaggaaggagcuaggccuugcugaggaaccucaggcaucuuagaggucauuggagagggcauacccaucaugauguuggcacuggaccccagggaaggagcuggcuuaccaguguuacccauucuuagaacauucagugugaugacugggccucuguggagucucggggucacaaagcucugcccccuucacccccgauccccagcaacuugggagcucccggcucagcugcugugccuucugguggugccucugcugcugagcuccacucuggugucauuccuccaccaacaccuagcuuguguuuuguuuuuguuugagaugggguuucuccauguugcccgggcuggucucaaauuccugggcucaagugauccacccagcacagccuuccaaguagcugggguuacaggugugagccuccauguauggcuuagccaucauguguuuuguagcuaaaauauaccaagcugguuuacaucuugucucaauucagauaacugugaaaguagauacuuuaaaauccucauuuuaggcuggucgcaguggcucuguaaucccagcacuuuggaggcugagguggguggaucacuugaggccaggaguuugagaccagccuggucaacguggugaaaccccgucucuacuaaaaauacaaaaauuagcugggugugguggcacgcaccuguaaucccagcuacuugggaggcugaggcaugagaaucgcuugaacccagaagcagagguugcagugagcccagaugacucuauugcacuccagccugaaugauagagugagacucugucucaaaaaauuaaaaauaaaauccucauuuuaggaguuuuuauuaaaaaauggaagcuuagaccaaggaaguuuuuugccagaggauucaacuaagguuugucuccugugcuucucucagaggcugagaauaugcucaucuaacucuggaggcugccuuugucgggguaaaaaagugaaaggccacacguacacaccagggucuaaacagcacucugcuuucaggugaccuguguggaaagagcuaccuuuggcaggaguuugaauuggcaagaaaaagaaaucacagugggcuuccuucaaauaggcuccuuccuguacauugguggcaugcauggagucaaugccguccauguugaguccgacgcuuuggcuggcaaggggaaggccugcucacugaggugcccggacgaggcagaggcagggcaggccggcugugcauggccgagggcccuugagcuggaggaaggcccgcagaacaccaaagaagccuucugcacauauccaugcuccuuccuccucccaucuaauccuggccacccacaagaagugcaucagguagcaggucccugccaucuggcuccuuccugggucuccacacccucaugcuggcccucugcacagacuacccucacucugcccucaaccaccagagcauggguggcccgguccuucucagcucuguggccugagcuuugagcucagucucugacacacaggaggcaccuggucagugcugggugaacaaacguacacacagagcacaaaugagaggaaagaaucuuacgaggugcuugagaguuggacaugacuuuuaaaauaaaauugccucucuacagugcuucguccucgagccugaccuucacauacauagugagcacaggcgaaucuuggguguucugaccuguacacaguacuuacccuuaagccaugcugauccggagcuccaccagggauucauccauaaucccaguguaggccccagagguggcugcaguguguucacuccagggugccggcuacguggugauggauguggugaucuuauuucaugaaacuccuagccuuuacucagggcugcaaggaguuagcggguccucccagggaaaguacaaaagaccuccaacaagaaagacuugagggagguagggcuucuuuaagugggacauauucucagacagcuaggagaauuaauucucagucccucaguaaguacuaagcuccugguaaaugcccagcuuaguggguacuuagguacaacagaaauguuucaguuccuggauguuugauaagaagaaacacacauggaaaugccaccagaaauacaaagccgucuacauauggugccaugugaaugucacagacagaggaacagaaguugggggaaaagugucacuggucugauagggaggccugggcaggggcugggacgugugugucagccacaucugagggacagugaguuuuguaguucagcagaagggcuuuauggagagugggaggucagcaggaacagucaugaugauggcgcuggcuguaccacggagcaccucccguaugcuggggugggguucccuucaggaagacgaaugaggugcggccugcuccucaagugcacugcccugccaccuuccacccugagccagggcugggcugccaguuuucccuggccucagacaguucaaguagauuuucuggaauacauuuuccuugcuacaaagguuauauuguaaugguaaaaacugcaacuaauuuugcaccagccuaauguucauugcaauuuuucuaucuaucuaaaaaguaugaagaggaaaacaaaguuauccauuaucuuaccgcccugagagaaagagcguuaacccuugaugcacuuucuuccagguguuuuguagugguaagugccagguagugggugugaguagccaaagcucauauggggcuucauagugaaaaacccacuaacagcagcacggcuggccccaaacguguccauuguuaaugagaugaacucagcugucuaguguuggaaaaauuucccuuuaccauuccacagagcagagcugacacauggacucaugcacacucccugaagugagcccuguucaugggacaguguagcccugggcugaaggugaagccgagcgucuucuggagccacagucucuucccagagccccaggagagccucagugagggccccaaagugaccccaagcaguuuauauggccucugagcccagcccugggccugucugcuacacagcucagguggccucucugugggccuccuguccauuucccacacucccugacuuguacagacuucuucacccacuucaugcccauaacuagaagcagcuuuccagaugauccauaugcuguuuccaugggccugucuugcuucacucacaagggcugggaugacugaagcugugggcugguagucuucaccuuuuuguuguaugaaguuagagcugaguuauuuugaguaacagaacauaaugcaaaaaggaaucuggauggaaugacuagcccagucagggcuggcaguaggcaaaaaguauucgaguucuguuguacuuuguaagaaaauccaugugcguauagccuggugccugucuuuaucugucauuuauauaauguguacucugugccauugguaguaguaagcauccuuuacugacuauaucuugaguacugcucaccauuuaucucugugacgucccuguuuuacagaugaggacauggaguuuuagcauuugggacuagcaugacugggaccugcucccugagcccaaggccgaggcucuuuccaccaggccuucugcuguccucuuucuugcucauuggguuuugcauuuugcuuccaucuuuauuacaaaagggucuuguggcccuccagaggucagaggcugcuccuuugaccaugagauggccauuucauguaccucccuaaaaauggaaggcaaaggggucaucgugagcacagaguccuagaaaagcaacuuuccagaagagauuccucaggaaaacccuuucaggggcuucucucugugccuucccaacugccucaacugccuggcaggugggccucuuccaggaagugccagcauugaagucacucugauuuccuccaggcuucuuugcagaugcuccaguuguaggugucccacaagccauugggaagcauuucuguauucagguccuagucuucuagggcggagguucuccaauuuuagugugucuagaaaucaccuggugcuuaccaacacagcucguugcacccccuccuccaguuggggcccaucucugagugagcaggucugggugggccugagaaguugcauuucuaacagguucccagcacugcugcuggggcugauagggggcugcacuuggaguaccacuuuucuuuucuuuucuuuucuuuuuuuuuuugagacagagucuugcacugucacccaggcuggagugcgguggcgcgaucuuggcucacugcaagcuccgccucccagguucaugccauucuccugccucagccucccgaguagcugggacuacaggugcccaccaacacguccggcuaauuuuuuguauuuuuaguagagauggguucucaccgugauagccaggauggucucgaucuccugaccucgugauccgcccaccucggccucccaaaguucugggauuacaggugugagccaccgcgcccggccgaguaccacuuuucuaagguuuuuccuagaauccccuagaccugccuuuccguggcccacgcuccccuuuaaaaucacccugcagaccacucuguguuuaacaauugagccaggcgaagcaauggcugccgucugacauugaggucauuguccuuuggccucugaaaucaaaagugauguuuggucuuucgcuucauguggcauguggagcucacucuuugggggaacuggguguuucagguggugagagcggcugaggaggcugcguccacacuggccaguuccauccacccggagcagugcaucaaggugcucugccccaucauccagacggccgacuaccccaucaaccuugcugccaucaagaugcagaccaaagucgucgagaggaucgcaaaggagucauugcugcagcuccuugucgacaucaucccaggcuugcugcagguaggcccucguguugguggggccugcccccggccugugugggguugccuaacuugaaguaauguaagggcuuugugcuccuccuucacuggcagggacggguaggaaaaaccaggcaggaccugugaggccguguggcagggacacuucacagccuccucugucggcuuccagcucacccccucuccugaaugcacuaagaaugcuuuccuggcagcucacagaaugaacuuucuguuuacuauaaacauacuuugaucauuuuuuuguccauucuuucaacaaacccuuauugcacaccugcuguagccccagcccugggcgagguggaccauggaguguaaaucaaaccaugguccuuggucucaugcagcacacaaauacuuacugaaacucuucuaagcaugagacaguaagugagacagacuggcauaaagcagcugcguuccacuguguggacugccucagaggauuuucagccuacucugcagccacacagacaaugacaggugucaccaugggcuacaugacaguagagaagggguuuccagguugggguggggggugggggagagaggguucauagaagaggugguuucaaguuggcccuuggcgagggaguuucacuggggaaagguagagaggaguuagcaucacauuuaaucaaugcugcuguuugcugggcacuuggcuuggggacuaaacacuuaauuguugaggacuagauuauuccaaacaaagggaaaggcacagagacugaagagucccaggcuguuuggagaacagcagcagguagccccagcugggugugggccaggaugaggccgacagauagauggaggcccagcucaaagggacacggacaucaggcugugggaccagacguuccccagcaaucucuggaggguagagggguuuugcucacaagagcgagugaugauguucucauuucuuuaaaggcauuuucacaaggaaauuugguuuaccuuugggagaaaugggaauaaaccaaguucucuuuccccuucauuuccuuuucucauucucucuccucuacaauguuucuuggguggcagcuuguuacacggugauaccugugcagacucagagaccagucugggacucuccacccuccugcuucugcaccccagaaaccaaguuucucuugaugcuaaguugugaccacuuuggggugaaagcugucuggauuccauugcggggcugaggucuauccugguuguuacugacaaguccaagguugaacucugagggcauuuguggaaacguugaugagauguuggcuauggaaugaaucuuugaucugguuuccuuuucguguucccuucuggcucucuaggguuaugacaacaccgaaaguagugugcguaaggccagcguguuuugcuuaguggcaauuuauuccguaaucggagaagaccugaaaccucaccuugcacagcucacagggagcaagguauguauaguguuaccugggcugauacgcacaccugggcucugccagcuugucauaaauccauuugacugcagcucuggauuccagacagguuuuguucauuguguuuuagcugggccuuauuucuccaagaggauuuuucuaaauauaaaaaugaacuauacagugaaaucaguuuaagguaagacugacauuacacaacauagucugccuuaacuccuguuuaugaaaugcugauuuugagcugcugguuuauuuccaaaagaaaaacaacuuuaauuagaaaccauccgauuuuucauggaaacacuaaagaaauuuaccugcuugcuuagcaguugcugaaucagagcugagucccucaugggcaucagugguggcaacagcuggcucucaccuugagccuacagggcagcccuacgcacuuugcaugcguugacucauguuuacggcaacaucccugugggcauggucaucccccuuaacgugccccacggcacagaccugacuccaggaggcagacuucuuacucacacugcugccucuaauguuccuuuaagggugucuggaaucaggggaagaaaauggaccaaaauggaugucacugaaaaugagaguggcuagacugcuuauugguuuuaauuaaaacaacaacaacaacaacaaacucaaaugugacaugcuaggcuggugagagcagauuaaaaacccggccuuaugcuguggcaggagaggcauggugaaggggugaggccuugguucccagagaggaggccagcugggccuggggccucaggaccugccuguggagaaagcgcaucucuguggaguuuaaaauccccaccuuuuuauacaaaccacucuaucaaacgaagccaguggaaaacaugaaaccagaagcgccugcucuuaugagaggaggaauuggcaaguggggcccauuucaucauuucagauugagcuguugcuuugauacagcuggugagcauuaacagccagagccuuguuucuccagaguucuggggaagcaaagcucuggcugggguguucagagcagaguuucucuaccuuggcucuguugacacucugggccaccuuguugaggugggcugcccugugugugguaggaaguuuaagcagcaucucugaccaccaccgucuauaccgacaugugccaauagcacccaucacugcugucucacaccuggccagaugcccucuggggggcagaaucaccccugguugagaaccggugguccagaggagacacuguccucuuuuuguaaacaggaaucagcagauaggcuggaagagguguaugaggcaggugugcagugcaugguuugggggugaccuuauucuguucuccaguuccuucuccuugcccuacugcugcacaggcuccucaucagauccccuuccuaauuaucugaaagauacagagcaaaaguccccccagcucuccuaccuccaucagggauuuguaggugauuccugcugaccaggaggaccuucaaugauacaauucacaaagggaauuacauuuauaaaauggaaaauucauccaaaaagaacaugagucacaccuugguuuugucuggcacuuuuuacuuuucuugaguaagagaguugucccaucaacucauuugaaccuuuggauaagggacagaaaauccagguguuuucuccuccccauuuggcaauugacccgcugcugccacucuuggugaagcuuuggguccagaacccacauuccugaccgggagccagcgccuucccucccccaguuacaaccuuaguuccucagggguuuggagagacuggccuucacaucuuucugcuuucguagcccaguucauccagccguuaaguuuuuuauuguuauuauuuuuauauggagccucgcucugucacccaggcuggagugcaguggcacagacaaccucugucucccagguucaagcuauucuccugccucagccucccgaguagcugggauuacaggcgugcgccaccacgccugguuaaguuuuuguauuuuuagucaacacgggguuuugccugguuggccaggcuggucucgaacuccugaccucaggugauccuccugccuuggcuucccaaagugcugggauugcaggugugagccaccgugucuggccuaaauuuuuuuucauguaauagcucugguauguucauaugaacuuuguagacucagguacacaucuccuaauacaaacucccucccuuccucaaccagaugguagcuggcaggcagaaccuggugcuaagucugucucaauuuccuugacuagaaacaaagagaaucaagucauggcucccuguguuccaguguuacaggccuaugggaacacgcucuccuuuugcuuaaaugaaguuaauaaaugaaggcugggcacggcucauaccuguaaucccagcacuuugggaggccgaggcgggcggaucaucugaggucaggaguucaagaccagccucaccaacauggugaaaccccaucucuacuacaaauacaaaauuaagugggugugguggcacaugucuguaaucccagcuacucaggaggccgaggcaggagaaucgcuugaaccugggagguggagguugcagugagccaagaacgcaccacugcacuccagccugggugacagagcgaaacucugucucaaaaaaaaagguuuuuuuuuaagaaaaaaaauaagugauaccaggaagagauaucuucuguacgaagaggucugaugaagggaaggaaccucuguaguacauuuggagagaugccauguugcuagggcagcaacacuagcuuuggggucagcuugccuucuggucucuguuccccacuuacgaguuuuaugaccuugaacaagcauucuuuucuuuuucccccccuccagucuuuuuauugugguauaauaaaauuuaccauuguaacuguuuuuuuuugagauagagucucacucugucacccaggcugaagugcggugacgugaucuuggcucacugcaaccuccgccuaccagguucaaacgauuguccugcuucagccuccugaguagcugggauuauaggcgccugccaccacgcccagcuaguuuuuguauuuuuaguugagaugggguuucaccauguuggucaggcuggucucgaacucucgaccucaagugauccacccaccucccaaaaugcugggauuacaggugugagccaccucauccgacccauuguaacuauuuuuaagugugugguucauauuguuguauaaccaucacuaccauccaucuucgaaacuuuuuucauuuugcaaaacugaaccuuugcacccauuaaacaauaauuuccuauuuccuucuuucccaaccccuggcauccaccuuucuacuuucugucuccaugaauuugacuaccccaggugucucauauaaguggaauuacaucguauguguccuuuguggcuggcuuauuucacuuagcauaauguccucagggcuuauccauguugcagcauuugucagaauuuccuuccuuuucaagacugaauguccauuguguguagauugcaugguuuguuuaucugcucaucuguugauagacccuggguugcuuccaccuucuggcucuugugaauaaugcugcuaugaacacuggugcaccuguucaaguccuuaauguuucagggaaccucccugcuguuuuccacagagauugcaccauuuuacguucugaccaacagugcacaaggguucuaauuuccccacauccucaccaacacuuguuauuuucuguuuuuauuuuucacuuuucuaauuuauuucucauuauuucuaauagccguccucuaugagaugaggauggguaucucauuuguugaaaauaaauaaccugauggcgauuucuuaucuguuaaaaagaugauccuuucccuauuaaacggucuuggcaugcuuguugaaaauuauuugacugguccaggaguggguggcucacgccuguaauucuagcacuuuggcagggucacuugaggccagaagcuccaaaccagccugggcaacagcaagaccaugucugugcaugcauaaauuaauuaauuaauuuuuggucacucaggcuggagugcgguggcacaaucaugacucacuggcacccuugaccuccuggacucaagccauccucccaucucagccccuccccaaguagcugggauuacaggcacacauaaucccagcuaauuuuuaaauuuuuuguagagauagggucucgcuauguugccagucuggucuugaacugguuucaaacgauucucccaccucagccuccuacauugcugagauuauaggcgugaccaugcccagccaauuuucucuauuuuucuguucucuauuuuguuuaucucugcucuaaucuuuauuguuuucuccugcuagcuuuagauguaguucuuuuuucuaguuccuuaagauaaaaguuuagguuguugauuagagagcuuucuuuuuuaauguaagcauuuauaacucuaaauuucccucuucagcacuguuuuugcugcauccccaaaaauugucuuaucauuuucauuugucucaagauguuuucuaaggcuaggugcgguggcucacgcuaguaaucccagcacuuugggaggccgaggcaggaggauugcuugagcccacgaguucaagacuagccuggucaacauggcaaagccccaucauacaaaauacaaaauuagcugggcaugguggugugcaccucuggucccagcuagucaggaagcuaaggugggaggaucaccugauccuggaaggucaaggcugcagugagcugagguugugccacugcacuccagccugggccuccgagugagacccugucucaaaaaaaaaaaaaauucuuuuuuuaaauaugucuucuaguuuaccuuaugaucucuucuuuacucauugguuguuuaagaauauguuaacucaauuuuuauaaauuuaugauuuuuuuucguuuuccuucuauuauugauuuauuucaucccauuaugguuggagaagaugcuuugguaucuuuuuaaaucuauuuaaacuuaauuugugauugaacauauggucuauguucaaucauauguuaaauccuaugauaaaccauauguuaaaucacaaauuaaauuucaauagauuugaaacuuaaugugucccuugagaagaauguguguucuguuguugaguuucauauacaucuguuagaucaaguugguuuaucagguuaaguccucuauuugcuugcuuaucaucugucugguucuuuuauccauuauugaggguggaguaucgaagucuuaucuccagaagcuuuuuugaugucaacucuguuuugucugauauuaguauagccagccuugcucccuuugauuacuguuucauggaauaucuuuuuauauccuuucauuuucaauccauuuaugucuuuggaucuaaagugaauuucuuauagacagcauauaauuggaucacauguuuauccauucugcccauuucugucuuuugauugaagaguuuaauccauuuacauuuaaaguacugucaggcguggugucacaugccuguagucccagcuacucaagaggcuaaaggugugaagguuagaggauuugcccucugaccuuggcccagccacuuccccccuguggagcgggguucucacccugcuuuuucccuggcucugauggagccuuugggcugcagucgugcuugagaugaauggcccugcccccguaucccuuccuccaugagcugcugcggcccaccuaguugugacaccuggugguggucuuguaauugcccacggcuuuucccucuccucuggacucuggccuccucccucccucuguggcccuagcaccuggcagaugcauuggaugggcagcaggcacucagaacauguuuuuauaaugaauuccucaaccaagggaacuaagggacuugcuguuuccuuacugucaccugggauucuuuuugcuguuuucuacuuucugauugcuuuucuuccugcuaauucaguuucaucuucucuuuucagaugaagcuacuaaacuuauacauaaagagggcccagaccaccaacagcaacagcagcuccuccuccgaugucuccacgcacagcuaauggcaguaccugucucuuguguagaccuagaagcaaucgguggugccucucagagaccuuuccccacccccuucaucggcugcccagucaguacaaggaggcccacaaauauuuauuacaaucaguauuuuggucccuuccagcuuuucuguagaaucuuacugguauugaauguaaaggaagcaaggccuguauugcagucuucauacaaaacaaaaggaauaagaacagaaaagagccauacugaaacaugucuuguacagccugcugagauggcgaaacccuguguguggggugcaguuuuuaaaaaucagagcgcucuagccacuacuugguagaaaguagcauuuuuuuuuucaguuaauaacauauuuggggguggggugggguguuacuuuguguucuuccuccuuagccuauuuucuugugcguauggucuguguggggccccuuucacagcugacaccacgaaaggugauauaucuuuaaguuguguucugagaccuacuaaaaaugggaaucaagucuuggcaagaacagucugaagauggccuuuuaacaaacgcugggaauuuugcuugucauauccagacuggaggccgacugcccuggcuuucagcguagaauugggagugcacccugacagucuccuuccagcucucccuaaucgacuccaccgacaaggucccuaccccagagcuuccaugcaaaggaauucuucaaguuuaaaucuggacacaaaaauaagauaaauguauggcaucauuuagggaugccugagauggcaguucaugaagcacagaagauaaagaagaagucuuucaucuuuacugcugagauccuugggaacacuguugucaugggggcucugccaagacccucaucucugggcuacacggugauucagauugagcaccaacuuguuuccuccccucaaaguucugccuaagccguucaguucuaacauggucucaguuaaucugguaaauggcaucuuuaccaucuuaguucugacuucucaguuuaaugugggauuaagagccaagaaaagccuagagagacuggauaucacaauuuuuuuuaauuuuauaaacugaaguaguuccuugaaugucuguugaugaaauagucacuguuuaaggaaaaaaguaauuaugagguguagcagauugcagaaaaacaggauuagaaacacacuuaaaaagaacacacauuuagagucucucuuccuccucagcgaaccacuaggcccccuuuuuaaaaacaccuuuagagccuaauuacuccaauaaaaguaacuagagguuuggagucugguuaaauaaauucugaguaaaauucuuaagccaaauggaaauucuuaaugcaaucaugaggacuucuauugucucuuacuguuguauuagauccuauaaauugaacugauuuuuccauaaggaaaaugcuucuuuugagauuaauucuaauaacguauuugcuauugcagugcagagcccacugcaacugcuaggacugaaagcagaggcugggugccagagcacgugauucuuaacaucauuuccacagaccccucugcccugacccucugcauuggaugcaggaagcugggaaagacugauguugauuuggaaacaugggcugaaaaugaaggccccauagugcauaggaacaguaaagccagggugcugacgugugugugugugugugugugugugugugugugugugugguguuguguguguuugugcgugcacccuacacaugugugguaccucacugcugcuguuuagggaacuugagggacgcguuucaagggguuggguauuacugacgagcuuuggcucaaaauauagcaggaccaggucuuuuguugauaaguacuguuuguuuauuaauaugucauuaaugguauuucuuuuuuacacucuacaagugaauuagggagucucuuguugaccccuuuguugcaggaaugugcgucgggcuagguuauccaugaguuucuuuauuccuaaugcaguuagaaagaccuuucuccuugagcucuuugacucccagaagguaccccaguccccaguguacuuagaaaggaucucgaacauugcuggacguccucauaguacucacaaagggcuagccuugaaugucacucgcccagucuucagucuccugacuuagagauacaaucacgucacaggucucuuggccucaaucugaaaacugcugccgccgcgccgaggagacucgcaugccgccaccaccucacugggagggcgccgagcccaccgucgcccccuagacccugacagcugcagcugccuugccuugccgccgccucccugcagggccccuguuccaaugaaaaacagaacacaaaagagcagagcaccuaagccugucucugccucccugucuaccggacuggccagggcccaagacccccgcugcuccacugcggggcugggcgggcugacucccugcuuccuccaagcugcugccuccccugcagccagggucugggcagggugcagccgguccucggggcacgcagcuuccuucaaguacacugugugugcuucccggaccugcggcgaugccacgggccugccuuuucuaugcgccucacuagcuuaccacccugugcagguaaugcaacugacuuugucucaucagucuuuuucuuucccugccacccuuuauuuaucaagcguaauguuacacuuuaaaggacagcaaauaagaacuuuguagaaucccaccaggacuuugcuaacaauaauguuuggaaauaaagaagugcucugaaaaaauaucagccaccaaaauaguuauguuggcacuguguucacacgcaugguccccacacccccagguuggguggguuuuuuuguuuuuuggguuuuuuugggggggggggcuuuuucauguuacauccauaucuguauuuauaucuuauuuguuucacuuucaaguguaucauggcaaauguacagauuuuuuuguuaauaaugugcuaggauuugcuaaaaaagaaaaaaaaaaaacccuuuugaguuugcccuagaauaaaugagacuuaauucaa

SEQ ID NO: 191137 - RNA, 68615 nt, Homo sapiens
uucuuacaaaugugaguuuuauuugcauucuaacccaagcacagaucccacauacagacuucucguccgcacuaugguacaguaacaagugcaaaauaugcuuuauuucagguacaaaaacauggcaguaggacaacuuugagcucaacgcccaccuccccaggaccucucacacccaccugacccauccaagggccacaccaccccgacagauacucccaccaccuuuagaaaagagucacccaaucuggagaaagguguggagguuacaucuuuagaaagaaaucauuuuaaauacaugaacauuagagaacacaguaaccgugcuuccacccagcacggggaggcugcagagaggcaccccaaacaguccccuucucuucugugguuaaccaagcaagccccgcaaagcuuuucccagcagagcacacccagccagcaaugaggccucaggacagagccagcacugugacaaaagaacuugucccaccuaucugagagcaugagaucugcaagugggauccggacuggacaccaggaagcucaaccuggcucgggccaucaguagcugugggacccuggcccccaucuaaccucccaguugacuuccugaaaacugggcuagugggggccuccccauugcuuuagggaggaucgagugagaagcugaccaaaugcgcagaacacaaagccuagccuguuagccccagcugcuaucacuacuguuacucacgaagaaaggaacugcaguggcugcugucugccccuggagugaagacaccaggggugcacagaggcuggacaagccacagggggcuggauggccacagccggaccucggacccaucucccgugggacuccuuccauuugaggcuguccauccuccaauggcagaugcagaauucucaggcccaggauacccuuauggagggccggggggcggccccucaaaaccaccaagcugaggccacugugagcaguccccuuuguagcaggaagagcagcuggacacaugggaagaggcuugcaggcuccagagaagccaaaagguccucaguccccaagguacuagguggaggugagaucaggcugccccucccaggacaagagugugagcuggccaggaggccacugcugcccaccacugcucaaaguccuucuccacgcaucaacccugagggaccuggccaggggaugcagaccaaaggcccagcggguccccaggaacaggaagcaggcggcaagaaggaaagcaaagggcucugcauucccaccacgaggcgggguggacucugcaggagccagcugaagcaccagaaccuuccaaggggggcucgccagccacacaggacacgagaugcgugauaggcaggguuaaugcagaaaccgcucaucugaaugcuuccccugcuuccaagcgcaaaccaagucauuuuauucuuuuaaaaaagcccuuacugucugaggcuuucuuuaaauaauccaacagggauggagguaauggaggucuggcucaguagucagcagacuuuuucuguaacgggcuagacgguaaauauuuugggcuuucagagccaagaggcaaaaucaauauuauguuggcguaagagcaaacaaauuuccacaauuuuuaaauugauaaaauccaaaauacaauaauugaguacauauuuuugguaaauacaugucuacuaaaaauaagaauuuuuuuuuuugugaugggggagaaaacacuucauuggguucaaagauaauauucccuaucauaaaucaguggcauaaacagccagugggccaggugggcccaccguaugcuagcugacaagggcagucacacaccgguaagugcugauacaggaugaggggugcggagcugaggauguuguucucuuugaugaaggccugaaaacuuccccuggccccugcugcccaccucagggcuccucaggacgaagggcaugaggacagguucccacucuggcccuucgcugggggacaugguuugguuuccccaucgccaggcuggccagcuggggcccaagcacugaccguccuuccccaccuuaucccaucagcugcccugcacaggagcagaaaacccaugccucagagcuacuuccuaaggacacugccucuagaaggcccuaaaguggcagagccggggauggcaggugcagcccuggccacuagcacagcaguugcccucagaucuguuagcugugacccauagauugggggagggaggaaagccaggaggagcuuuugcagaaaggucuggaagcuaaguggggguuucaggagcucucagggugccccugggcaggucccaaggaggccuggggugccugaccagcgccucacuggcccucaagcccugucccuaaggggcgaugggaaggagguggcaaucagaagaggguacaaacauuuccuaccugcaacccuggaccgguaagaugacacagagcaugcaacccgagcggaagugccugugugaagccagucaugugggagacccgcucuagagaccuugcccugcucugggggccuugcccagugccacuuacacugucuagaaaagcuaaggccaccagcuucauccacucuccaggaggucacacaagaucaaaagaggaucaucgagcuaccgagggagccuguuuuccccaaaugcgaagggaacagcagucaucuccacaccuugccaagcugaggcugcuucuggcugugcucauggcaaauucaugggcaagggaaggaacccagguacacauguaaacacgcacaugugcaccaaugacacagacugugccugcacugugucuggccccuggcuggcaaggaauaucugggagcccccauaaguuugcggaggaaguagucagcccaguuaggagcuagggcugauucccaaagacacgauggacacaaucugacccaugucaagaagcaugccgccuugcacugcaggagcacugguggcacuguguacaaccaggaugggcacacguaaaggucuccugccuguugugcaauuuucaaagauuuuuuauuuucaaaaagacagagauggagucucacuacgaugcccaggcuggucucgaacucuuggcgucaagugauucucccaccucggccucccaaaaugcuaggauuagaggcaugggccaccacguccagcuuuuuguacgauuuugauggagggaaaaaugggaaaaccccucagauucauuucauggcagguuggugccaucuucagagaucaccaagccuguauuuguaagaggaggagauagagacccagagaggcaaagagacucauacugagcgagggucugggaucuaggacccugacucuggguucucuguuccucuuccuacaccccaggcagugucaacaucuaaucccccacccccgcccaaucauccacugcuuucucacccccucugagcgccuagggacuuucucccucugcuccacugacaacagccuaagaggcuuuuccguuuauuucaucgacuuguuaaugauuuucagaucuucaguuacucaggccagccccugaagcaaugcuggacuuggaaacuugugacccuggcuggcuccaguccacugcugguaaagccuucccuagguuaauagcucuguguaaggggcucugggcugucugggcaagaggucacuagggcaacaccugaccuuuguuuaggaccccaagucaaagccucgaccuccccaccccauccuguccuuuccacaggcauaccaugccccuccuccagcaaaccuauuauuccuccauucaacagccucugucccuucauccagaaaggacaaccugguaaacaggaaaggguuuaucucaaccuugcagauaccccgcaaaaaccgugacgaccuaagaguaaggaacucagcuuugggcuuccaguucaagaugguggccugagcacaugugucugucuuauuucccucugggguucacuguaaaaagaagcuacaguucagaagccacagguuggugggaaugcccugggaagagcuguccugcucaauaggccagcaccuccggacucacaggaaagacccuggacagcugugggaagggcuauggcuuuucuguaugucaaucaaaugaaaaauaaaaccuggagcuuuagcucaucugaccccuguggaagggaugagcugcuaaauuaggcagcugagauauuuugguaccaaauuaccauguguacuuuuuuuugguauuuauuauuuucuauucuuucauaagcuauaagcuuuaacuacaaccacgagaagguaagaagagcagaugccaggggcaugccagaaaaauggaagacucuacuaauagcacacuuaagguaacagacuuuuauuacaucuucuuuuggaacuuagaagacaauauuagccuccuacacuuuugagaauuaaaauuuagcccaccaucauuuggccuugguagugacaucacuuggguacagugaugacagacagccuaaggggcuggaccucagaagacuaaaggucuaguccugguccuuccacuaaugggcuauggugacccugagcacauuauuccacuucuaggugauucaguuuccucaugacucauaacaggaaaucauuggucucaaccuuccuccaaggacuaguguguggagcuagaacaugcaccaaggaagacuggggaacaucagagagagauaggacucaguaccguugacucagguaaagagggagacagcaagaacagaguagaaaggcagcauaaaacugguggaaccaaacacagacuaaguaaaaaaaaaaaaaagguaagcuucccaacgacaccaugucccaggaaagaagauccaguaagaagcagaggccuuuagcaaggaugccaagacaauuccguggagaaaggauauuuuucucaauaaucagcagugggacaaguggagauccacaagcaaaagaaugaagcuggaccccuacaucacaucauauauaaaaauauacucgaaauggaucaaagaccauugugagaacuaaaaguauaguucuuagaagaaaacacaggcauuaaucuucuugaccuuggauuaggcaaugguuuucuagauauggcaccaaaagcacaagugacaauagaaaaaaaauacguaucuuggaaaucaucaaaguuaaaaaguuuugugucucaaaggacaccaacaagaaacugaaaacaauccacagaaggggagaacauuuuuaccagucauauaccugauaaaagacuggcgucuagaauauacaaauagcucacccaacucaauaauaaaaagaaggcucaucccugguagucuagugguuaggaaaacagaaaacuuaaaaaaaaaaagacaacucaauuaaaaauaggcaaaggaccuggauagaccuuucuccaaagaaauacgcauggcccguaagcacaggaaaagacacucagcaucaguugccaucaggggaaugcaaaucaaaaccacaagauagcauuucauacucauuaggaugcuaaaagcaaaaagacagauaauagcaaguguugaugaggauguagacaaauugaaaccuggauacauugcuggugggaauguaaaaugguacagcugcuauagaaaacagucuggcaguuucucaaaaaguuaaaacacggaguuacuguaagaccuagcaauuccacuccuauguauauugcuaaaagaaaugaaaacauauguccacacaaaaucuuguagaaauauguucauagcagcaucauucagaguagccaaaaaguaaaaacacacaaauguccaucaacugaugaaucaauaaacaaauguggucuaucuauacaaugaaguauuauucagcaauacaaaagaaugaaguacugauacauccucaacuuggacggcccuagaaaacauucaguggaagaagccagucacaaaagagauaucacaugauuccagauauaugaaauguccagaguagguuaaucuuacauagaaaguagauucauggcugccuuggacugcaggaguuaggaaagcaggagugacagaccaaggguacgggguuuuacugggggugaugaaaauguaccaacguugacuguaauucugugaauugauggugguucugugaauacaauuggacacuagcaauggguaaacugaauggcaugugaaugacaucucaauaaagcuguuaguuaacccacuccccgcuucuccucuaaagaaggaagaggaaucaggagccuguccucacucuguucuguaggaaugccacggcuauuacccaacauaaugacuaacagagccccuuuuauuccgagauguccugguuuauaugauaaauuuauaucgcuacccuaucacuaugugcuaccaugcaggugacuuugccccucugagccuugguuuccucaucuauaaaacaaguucuccccauuguagacccuguuuuauucugguaguccuucagucuagcacuucauuccacagaagcuccauuuagaagcuaugacaucccauucagguggucagaggguuccccaugaaccuaaauuaaccaagagcugaagcccugggccaguagagaucacuggaucccaggaaccagaggcaagacaaagacgaauuucugagucuaccacaguuacugacacucaaauuucccgauaguuaggccauuaagaaagaugaugcacccauucugaugcaggcaaaauauccuaaacauagccucuacaaacaaagauaaacauguaagugaggggcacucagagaaaacacaucgcuccuguggcaaguuuagcagcgguucaacaaggucuucucuaacuuucuauaaguccauccaagagggccugguauugugguggucaaggucaucugaugacaccuaggaauggaauacucauuccuaauccuccuuacccgugauugccaggaaauaaaauagucuuuuucuauuaccaucccccuaaccuccccacaaagggccucagaacuaaugucucugagaaaggccgugcacauacauuguggcaucuaccaugccaaugcgccagugcagagacaggagcacaucuuuggguuccgcagcagcagauccuuagaaacaacguagagaagaaagagguagaaggcacagaauagccccacucccaucaauucauccaagaacaggaaaggcggaugcucaccagggucacugagaagggaagcaaaccugaaacaggagaaugagggcaaacugcucccaucaagucggcagugcuggccaugcagccaacucccagaggaggagguaaagguaccagcuuccagggugaagcagagcuuucucuggaggcaggagaguggucagaagggaccaauacaggcagcaccaagauacccaaucagcuuccaacuaagggaugagggauuucagagcagacgucuccacuguuugcccuuuuagaacgucaggguuggaccaauagaaaagaacaaggaaccauucaaaaucuggaggccaagaggaagggagaaaggagccacuggcuuucuguacaccguacuugguguccacaggcuucugcugguuggugcucuguagcuuucacagacugggcagggucccuccuggccucagcuugccuggugaggccacagcuuacaguggggcaaugucuacauccacggggauccacagggcugggagcuggagacagguaugagguccacugcugcucagaguccacauuucaggaugaugugguagccaucauugcucucagcugcaagagagaaacacuggguguauuucacaggaaaaaaggugcagugccacaguauuggggagucccaaaaggcacgcuguuaggguaucagcaaagaccaccaaaauagggcugcauacagcaaagcgugcuggcagaagcagggaucucacaugcccugacaucugccucguuuagugucuuuuuaacaauaggucuuucuaccauagccccaggcccaaggaugaaaaccuacguuccaaggaggauuuggacaacugugguucucagggauauuauggcccccaaggccccaaagacacuuggugguggcugggcgugguggcucacgccuguaaucccagcacuuugggaggccaaggcaggcggaucucgaggucaggagaucaagaccauccuggcuaacacagugaaaccccgucucuacuaaaaaaauacaaaaaaauuagccgggccugguggcgggcgccuguagucccagcuacucgggaggcugaggcaggagaauggugugaacccgggaggcggagcuugcagugagcugagaucgcgccauugcccuccagccugggugacagagcaagacuccaucaaaaaaaaaaaaaaaaagacacucgguggcuagauccacgggacaaggugggaaguggccucaucaugguccagggucuaugagucggucagagggcuuuuguucugacauauccuauacaugcaccccaacccuuaggaaggccacagcagaucuuucucuaccuuuuaugaauaaauacauguucuuggcccacaggcucuuccucggcagagcacaggcacacugucaggugggcccccucaucccccaucccgacccacgcuaccugcagacucaguggcuguauuccaggcuugaucuucccggaggaccccaggaaacccacaaugcuucuacucaacacugaguucauagaaaacaaguugccuggcccaggauuucccuuucagaagugacccugggggccaaucucacuaguucugccauuucuagggcuagcuuucacggagaguuugugcuuucuuuuucucaaaggcuuuucccaggucagcacucucuggaagggcccauccugcaggcaggccccacccucucaccugcccccacaacuacccuagggggagggggaggcuucaccuuuaauugugcugaggacaaaacaggauucaucuuggaaguucugcaccaucugagagacaaaagagagaacauguuccuucaaccacgaguucaucauuuggaaagccucgguggcagagccuagccaugcgcagcugcagaaacaccacugccaagccacugccacggugcccacacacacaggaacgcgguaaacaccacugccacggugcccacacacacgggaacacgguaaacaccacugccacggugcccacacacacgggaacacgguaaacaccacugccacggugcccacacacaagggaacacgguaaacaccacugccacgguguccacacacacgggaacgugguaaacaccacugccacggugucuacacacacgggaacacgguaaacaccacugccacggugcccacacacacgggaacacgguaaacaccacugccacgguguccauacacacgggaacgugguaaacaccacugccacggugucuacacacacgggaacacgguaaacaccacugccacggugucuacacacacgggaacacgguaaacaccacugccacggugucuacacacacgggaaugcgguaaacaccacugccacagugucuacgaaugcagcaggaacaugguucugcuacaacauucacugaaaaauaaggacacagaaucaaggugugacaugauugcaauuuaaguaacagaaaccugaacauaaccccaaccaucuaguaugaauaugaaggauggaaagaggcccaaacgggaaucaagauguuaccauuuaauacuggaccacugauuuauguuuguuugcacuauuuuugcuuuuuccuaguuacugauucuuccagucucuauaacggaugcauuacaggaauguguaugugacuaauggcaacagagaaaaacaacuaaauaaaauguuuuuaaaaauagaaaccuugguacuuaguaggaucugcacaucagcguccuacaaagacaaaauauaaaggaggguuccacuaccugugucuauaaauguggcaggaaacuaacaacucugcucaggagccuccucucuggaguucuaauuucgaugaacuacccagugaccuuggacaagccaaccuuuuuaacuuccugucuccauggcccuaucuguaaaacagggcugauuuaaugauaaaaauauaaccagaauguagagcaacaggaacugguguccacuacugauggggauguaaaucuuccuaacacuguucaugggacccaguaagaaugaccaugcauuuccaacaaggaaauuuuccuacauucuccuacaagucaugagcccuggacaaaguucuacaucacaaagacgggcaugaggcugguuagcgcagcaccgucugcaguaacaccaaacuccuaccagccccgucagucaacagcagaagcaugaaccagaugugauggaaucaugcuccucggcagugccaaugagcgccagcuguauacuucaacaugcaugaccuuccaaacaaaaugugaaaugaaagaaaucacagaagaauacacuaugauuucacucauggaaaguuuuuaaauagcaaaauuaaacaauauauugaggaggaacaagggaauguuuaauagaaaauucauacuagccaguuggcuguuaugaaaucaguccacaaaggggcuucuaauguaacauucugguaaccugagugcagguacauggguacuucaaugguucuuuaacuguauaaguaaguuuuacaaauuuuuuccauauuuauacugcauuucacaauuuacauuuaaagaauauuuuuaaaauauauaaacaggccgggcgcgguggcucacgccuguaaucccaggacugugggaggccaaggcagguggaucaccugaggucaggaguuccagaacaaccuggccaacauggugaaaccccaucucuacuaaaaauacaaaauuagccgggcacgguggcaggugccuguaaucccagcuacucagaaggcuaaggcaggagaaucgcuugaaugcaggaggcggagguugcagugagcugagaucacaucacugcacuucagccugggugacagagugagacucugucuccaaauaaaauaaaauaaaauaaaauauauaaacauacaauacacacacacacacacacacacacacacacacuagcuaacacaauagcaaaaccccuuuucaaauugaaaaaaugccauccacauuuuauggccugcucuggauuacugccucgaaucuugcaaauccauccaccugucgcccccgccccucccacagggccuaaugaugcgugaaguacauuuacucuauucugcuggccugcuccaucuagcacucuuggcagcccagccacuugggcaugcgaagcccuacgcagagcccacaugggcuuaaucaguaacucucuuguuuaaugaagugcccuugcaccccaggggccggcuccgcggcuggccaggcugccuccagcacucugggcaauuaagaaccaaagguuuccaauagauucgggguuaagaggcaaggagacuuuggggaaugagaaucgccuacuuaggcgagguggcauuuggguucugcucucugcuucacuugcuucacugccuacucuugagcacacaggacaagcugaggaaggaacugccuucagggacccgugauauugcaagcguuccccacauuuuuggcuuuugucuucacaaaaggaaauucauuuuggaaugcaaagugacaagccuucggugacacuacagcuguccacugcucacagcauguccaccuuccuggcuauucuaaagucagcucucagguuaggaaccucaggcuucauuuuccuccuccguaaaauaggaguuaaaaaaaaaaaaaaauagcuaggccgagcacaguggcucacaccuguaaucccagcaccuugagaggccaaggcaggugaacugcuugagcccaggaguucaagaccagccugggcaacauggcgaaauguugucucuacaaaaaauuaaaaaaaaaaaauuagccaggcaugguggaacaugccuguggucccagcuacucagaaggcugagguaggaggauccccugagcccaggaggucgaggcugcaauaagucuagcugugacugggccacugcacuccagccuggguuacagagugaaaccgugacucacaaaaaaaaaaaaaaaaaaaaaaaagcucgcuuagauuugaauguaauaauauaaacguaauucuuaacuggugaacuggugacaaaaauagcaaguugcagauaagauaaauguauggcugcguguuugcugcauguuuuaauuuuuuuuuauuuuuauauuuuugagauggagucucgcucuguugccccggcuggagugcaguggcacaaucucagcucacugaaaccucugccuccaggguucaagcaauucuccuggcucagccucccgaauagcugggauuacaggcacccaccaugcccaacuaauuuuuguguuuuuaguagagacaggguuucgucauguuggccaggcaggucucgaacuccugaccucaggugauccaccugccucagccucccaaagugcugggauuacagacaugagccaccaugcccggacugcauguuuuaaaaacccacaccuacauacacuagggcacacacagagacaagagcacaaaaaauugccuugcagaaucacaucaaacuuaacagaaacuauuccaggagaaaagaagggggagguaagcuuuuuucacaucuaccuucugcuguucuauguugcuuaacuucuuauacuaauuacaaauuacuuuuuuaaugugaaagacagggaacauccaucuugcuggccuccaggacugagaggaagugcucgugaacauucaagggcucuggcaguuuaaugacaaguggcaagaggauuauuacuaguaaugucaaccugugaaauacacaaacccugaaaagccugacauuuuuauacauccccaaaacuaaaaagaucucuccaccacuagcucccccaaauaacaagugcccugcagaaucacagucaaugacaccacccacgacuuguuuagugucuccuggcaccugccacuguucucccaccuuaucuguacuacagucugacagguauaugcaucccuguuuugcagauguggaaacuguggcacagagagguucaguaaauuucccccaaagucauucagcaacuaggagguaguuucagguggggacaccaguccaauuccaaacccugcauuuucucuacuucucccagccacuguuucuguacucaguaucaccaggucaggaacacucuuggcagcaucaccagcaaaggcaaggaccagggaugggaagaaacaaaucggagucuuaauccacaaauacuggccuuguguccuaccacuccuuugcuaguccagggucagguggggcucuauaauccucuauacagaggccuucagaauucccagaagggcucggggucugcugggggcugaacugggggcacacgaucccaucccgcucccaccagcacaguccuauguuuuuguuuguuuguuugcuuuguuuuguuuuugagauggaguuucgcuuuuguugcccaggcuggagugcaauggcaugaucucagcucacugcaaccucugccucccagguucaagcgauucuccugccucagccucccgaguaccugggauuacaggcaugcaccaccaugcccggcuaauuuuguauuuuuaguagagacagggguuucuccauguuggccaggcugaucucaaacuucugaccucaggugauccgcccaccucggccucccaaagugcugggauuacaggugugagccaccgcacccagccacagcucuauguuuaaaggcuucacuucagcuggugcaggggcucaugccuguaaucccagcacuuuggaaggccaagguggguggaucacuugagcccaggaguuucagaccagccugggcaacauggcaaaacccugucucuacaaaaaauuaggcaggcgugguggugagugccuguaguuccagcuacuuaggagccugaggugggaggauggccugagccugggagguggagguugcaguaagcugagaucacaccagccugagugauagagcaagaucuugucucacaacaacaacaacaaccaacaacaacaaaaggcugggcaugguggcucacaccuauaaucucagcacuuugggaggcugaggcaggaggaucacuugagcccaagaguucaagaccagccugggcaaugcagcgagacccugucucaauucuuuuuaauauaaaaauuuuaaaauaaauaaauaaaggcuucacuucagcaggggcuggguaccuuacaggcucagagcuugggcccugcagcuccaaucccuggguucccaccauagcuccaccccuuacccacuguucaaccuggggcaauuacucagccucugugccucaggcccgcaucugugaaaugggauaauaauaacacccacaucauauagaggcagacaggauuaaauaagucgcuaugcauacacuuaaaacaaguacacacuccuguuauuagguggaagggguccaggauagaacaaacuuaaaagccucuguucuacaucaugcaaggaaugccuaacccuuuggcaggcauauucaacacccgcuucuuagccaugagcgggucagaucccuggagaccacaguaccugagcccucugccaguagcugcuugugcucuacacugcccugugccaccugggaaggcuguggcaccuucaccacuuggcagaggccucugcucuccucucccacaagccacagccucgccaacaccugccccggaguccacuucaccucucccuggggacugucgcccacccugggggaacgccccucuccugaccuccacagcccugacuauaagcaccuugggccagaguggagucuguccuccuggcucccaccgggcacccagcccaggagggguaaggagugccuacuuggcauggcagccauuuggacccagacggggccucagcacucuccaucgcagccccggacagccacagcugcagguggugugcagaugaaccugucugucacucccaaacccaaguguguuucuggggcagggguucugacacuccucccguggcccagagcccguugucggggcaggccaggcagcagcccucaccucguugcucaccaccacauggaugcccguggggcccugccgguagacucgguggaugugcuggggggagaugcuguacagguuggcgaucuucucaaucagcuccaagguggucagcucuuccaggaagauggcgugguacacugggggaaggaggagcaagugcugcuuuccaaguggccauucugucagugugagccucccacccgcccugagaaagcaguaaguccuuugucaaaaugccacacccagggcggcggggcaggaccacacugccacucuuuuuguuuuguuuuguuuuguuuuguuuuguuuuguuuuguuuuguuuugugauggagucucgcucugucgccuaagcuggagugcagcagcgugaucucggcucacugcaaccuccaucuccuagauucaagugauucuccugccucagccuccccaguagcugggauuacaggugugcaccaccacaccuggcuaauuuuuguauuuuuaguagaaaugggguuucaccauguuggccaggcuggucucaaacuccugaccucaggugauccgcucgccucagccucccaaagugcugggauuacagggaugagccacugcacccagccaggcugccacucuugauuccucucggucucucuuggggugcuuaugugaaaugcagagaucccuagacccauccccagcccagugacacccagaugggcugaagggaguaucaggcaauucugacaugcagccagaugugaacccacaucagaaggaagcaacaaauucugucccuuuucagcucuuuuugcuguuuaaaggguucuuggauagcuggagggcaaugagugaaaguuaaaaggaacuauuacuugacaacagaaaggagaaggccuggucuuuccccugcccgcaacacaaaccauacucagccucaacacaguaacccuaaggagagaagagagcaccaggagggcaccauggugucagcaagugggaagaaaacagugacacugacacagagacggccugcaccagccaggcaggagcaaaugccaccggcaacccaggguggguuacucaacuucaagggaccucaaguuccucaaaagcaaaugcaauuggauuaaauucaagauucuuaagccuuucccucaccugagaaacccuugguucaacaaaccucaucagaggcccaauauuuuaaaagcacacacagguggguguggcagcucaugccuauaaucccagcacucugcguggccaaggcaggcggauuucuggaguccaggaguuucagaccagccugggcaacagaaugagacuccaucucuacaaaaacauacaagaauuagccaggugugggggugugcacuuuucuuuuuuuuuccugagacagagucucacuuugucacccaggcuggagugcaguggcaugaucucggcucacugcaaccuccaccucccuccgccucccggguucaaaugauucuccugccucagcugggauuacaggugugaccaugcauggcuaauuuuuguauguuuucuuuaguagagaugggguuacuccugaccucaagugaucugcccgccuuggccucccaaagugcugggauuacaggcaugagccacggcgcccagccuacuuuuucaauauuuagagauuuggucuugguauauuccccaggcuggccuugaacuccugggcacaagcaauccucccaccuccccaggugcuggaauuacagguaugaaccaccacacccagccacaauuuugcuccuaaaacaaaccaagcugccagcaaaaagaauuagcaggaucccaggcugacgccuuucaccauggccacugggagugcucggugggagcaggaaggcugacagccacgccucugagguccucgagagucuccucucaucaggagcugcaucaggagcaguuugaggaaacaaaaagcuccagggugggcauuccugccuccaauccugacugccacugacuggaagcaagaucugggacaaucccaacaccuucccaagccucggggugugcacuaaggcagcacccacacugcggggccgccacgaggucagaccaugcaccaugcaaggagcaugcacuaggcugcccuuuccacgugugggcaugugggagcccaggacuguccugcacauucacuggaaaugaacagaggccagacugcgggcuugaaagccaggcugcgggacccaaugugugggucccagcucugcuccccacaacucaccagacagguugcugucuccacugccgucccgcuucugcugcaggggcacucgauucugcuccagcuccugacagacauaaauggucaucuuuggccucacauuccuggcaggagaagagaaaauaaauaauaggugugguggaccaggcgcaguuguuucagaauauuccaggauggaaacaauagugggcagaacucagggaggaagaaagacagcgguggugacguggagugccugucauggggugguggaugacccucccaggucccgcagccugccaaggggcacucugccccagaccaugaagcucaacauacaagacguuuucaggcaacaauuagagcaaacacugucuguggcuugcuguguaucagguauuguucucagaacaugcguaacucauuucauccucacaaaacuugcaagggagcuaggacuaucgcucucauuccacaguugagcaaacugaggcucggagggcaaagggcuuucccuucacugcacagcaccuaagaggcagaucugggacucaaacccaggcucucacucuaaaaccaugcuguccauguguggcuauuaaaacuuaaauucacuaaaguuaaauaaaaauuucguccaucacaucagccucgguccaagugcuccacagccacauguggccagcacggcugcagaacgucucugccauggcaggaaggugugcaggacggcgcugcucuggagucuccccugaaacugcugcaugauaccaucugaccagccccaaguccacagcuccccucagcgggggagcagcuccgagcccaggaccacacaagcaucugagaacaugggcaaguggcucagaggccgagauccagaggccaaggcucucguccaaccaagaagagggaggggccuccaggcagggucugcggcagcuggccacaucucccacugcagugucucacuccccugcuguggcccgugccccucuugccacauuuccuccuacacuugaccccacacugcaggaguccuguccccccagccagaccacccaccauccaaaaggcugagguagggguuucccaccacaugccacgggacaugagccucuggcuggcuucacagagaaaccaacaccuaccggccuuugauggcguugaagagccggaucccaucugcgggaccacagaucuggaccaaaucaucucgggacaucuucagcaagucagcaccuaggcaggaaaaaaacggggaugccuguuacauggaacccagagaaagggcucgguccccaaccagcugcagaccccauagcacugggggugggggguggggaagagccagcugcacuaucucacagagagaaaauggcaaaaugcucaacaacaucaaaagauugcagcccaggaagugccagugcucacaacagugaguacaacagaagccaauagguccccacugccucauugccugcccugcuugcuuucuuucuuucuuuuuuuuuuuuuuuuuuuuuuuaagagacaaggucucaauauauugccuagccuggcuggucuugaacuccugggcucaagcaauccaccuaccucagccucucaaaguacugggauuacagacaugagucacugcaucuggccucuucucuuuuuuuuuugacauauaaucuguaugcauagaugucaucagcacagggcacuggccaugugugcaucugucuguauguggaaguauacagcucgcuggaugcugacaaucugaauacaccccaggacccagcacucagagccagcagugaaacauugccagccuccuguaggccccucguaccagccaccaccccuacucccacccaggggagccacuauccugacuugcuacagugcagacacguuuugcauguucucugaaguuucuguacauggaauugaacgguaggcacucuuccuggucuggcuucccuccccgcaagucauguuucacggugcauuuguguggaauguagucagaguguucaugcccguuauuaccuaucauugugugacuacaccacaauucacauacccacuuuauguggaugggcgcugggggggcuucaggucugggcuguuaugaauaggcucucugaacguucucauacaugucuuuguucauuacacaaggugcgugucugccgggucuagccccggagagggcugcgggaucacaggguguguuuggcucuagcagauacugccagcaguuucccagaguguugcaucuauguauggucccaccagcagcaugugaggacgggcccacaguuaaaggaacauaggaaggugaccgucucauggggacagaagugagcacagcgugagggcugccccuuccucaaagcccaagggguccccgagagccuggucccacacacucuccaagguacuaguauaucagccucaggugaaagccugcccaaggccacaauucccacuccucuccucucaucacaauaagauacgguuuuagguacaauucuauagacacaauggcuuccuuuccacugggaguaaaagccgaaguccuuccacuguucuuccagggcccccauccuguccgugucccuuggugccucucugaccucuccuccccgggccacuccacuccacuccaccuggguccccugcucugugaccacauaaggcaggugcccacaugguggcugacugcccuacuuaagacacagccggcacuccucccccaccuccacccaguccagugcaggguccucucugaacccccacuccaaucacacaagucacgcugcaccgaaaugagugguuuaugcaucuguacugacuuacagcuacaagcucccaaggacagggacccucccccaacaggcucucagcaaugccgagcugaggaugugcgggcgucguuucucuuccacugccacaggugucuguggcauccgcuccucuaguuguggccaagccuuuacucugucacuguggaugaacucuacuuggugacaaggcucacugcucaguucaccuuugcacuccacaauaccuagcuugggacuucugucugagggcccaucaggaagggcucugacacuuucuaaagaaggaagagcccccuuucugucucaccuguggccucaccuccagcucccaggucguggcucuggagccaaugugaggagcaguauuuggguaggaaaagcauaaggggcccugcaucacccugccgggcuaaggggacucuuccuggacagaccagagcccaccaaccccccgcaggugaggagaucuugaccaagucacccagauggucccccucaagucacacucacuugggaccuucugggggcagcaucaccuauguccagcacuuggcccaggguuggggcacgugagcgagcgaacccacacuaucucgggucucccagcugaaacgacagcgcugccaguguugacagcaaggccuggaagguggccagccuugaagugucuccaagauacucaugggcuuuaaacacaguucggagaugcucaccugagaagcuggcaaagagccggcagaacugcgagaaccuguugcggugaagccacugcugggcauccuggaucgaagcugaugggagcaggugcugugagcagaggggagaggccuugagaugguggcucagggcccacgagggaccaccagccagaaagcccugcucagacacuuacgucacugcccacgggcagggccuccaccgggugggucggagaggcguugcugcaaggaaaaggaaccagugaugaggacagagggggcucccagggcaauggccacggucccggcacccagccuggcacuuuuacuuccuaucagaugcaggauuuguucuaagugaaaugaguccucaagaauuuccugagucacagaaacacagcaggagccaauguccaaucccucaaaaucccuaacugagccuucauuguagacagcaaguucugauaggcuacacugccccagucaaugacacuccucuacccugagucaccggcaacacaucccaggccccugcuggcugaccccugcuggucuugaacuuggagauucaaagccccagccccagggaaaggcacgcugaccaagggcacccagagccuuggcaccugaaggcuaccaccaaacucaaggguccuccaccaaacccuuugucagguggugaggggagagggcauaagaaucccacggggaguuauuuugcagugaacaagcacccgcagcuugacauccauccacgaggaaaagcacuguucuguucucucccgagagggggugcacaagcuuccucgggggccagguuggggaugaggcacagaccugagcgcucuccagguggacggcggugaacgcugcacaacagugugaauguacuuaaugccaccagacugcacacuuaaaaaugguaaauuuuguguuauguauauuucuccauaaugggaaaaagagacccucgcagggcugauccccagaccggucaucagugaagacagccgccacuucucgccaagugucuacagggugcaagcaucguacacuuguuccucccgacccuguguagaauucuuaacccccuuuuguaguagagaaacugagucucagggagguuaagggaguuacccccaaaaagguacagauugaagacuaggucugccugaaucuaaacaugacaccauuucugugucuacccccgcuucccuggggacuccuugguaaaaucaaguucacagacaaucucgcuuucuuauuagaaaaguucugucugccaagcaugggcucugacgaaccugcaagcagaaaacaggcagccucccacccacucuccugccuccaccccugcugccagcacagggcaugcagagccaucacggugacccauggccccgugcugugcagcccacaacacucaggagagugacuguccugucacagcauccucaggguccauguggccugugugucugcagagcugugugggacagcaaugaagccaguuucuguguuguaaggccugaaacccaaggcagagaggacccuagccagacccucucacccccacacucagugaccaugcuggacaaagaaccaggaaaggccccccagacagcugcucccuaaggcaccacugucaggagggccauucugccccagagggcaccagaggcugucuuggguggcugaccgcaugcacccucaagccaguccugguuucaccagguaaguucugggccgcugucccacccgacaacguuuacagggguguuucugagcacuaaaaguuguguaaaugcugaagacaguugugacugcaacacgaguuagcuacccugaaacccaaacagaaaggagaggagacccagaaaggaagacuaagaaaggaaaguacaccugccuucauuucagggaacccgaagaaagagaggugggacguacccuucgccgaggccaaagcuguuuggagaaccauuguagcuuggggacggggcgcuguucaccugguaggccacgucgggccauggagagcacugcaggagagagcacagggcgagcugggaucuggagaggcgcugagccgugcuccccagguccucccaagcaggcaugcacugacaccaaugcaugagacccccaccugugaaacgcagccugcguuuacccagugcccacagugagccacggcaaggcagguuacgagggccacaugaaggaaaccagcagaaauguucaguaagucaccccuggagcaagugaaguacccaaggggucucucugggcuuccuagcaguaaaaccagaggggaaacaucacagucaugugauucuuggguccacgagagagaaaaaacgaaaccagccaguuguucacaaacagcuuuuccugggagagacaaauucguguaaaugucuguuauagggaguacuggaccacaggcaacuuccaaacaaaaaaauaagcaguaagagucaguauuaaaaccugugcuauuugaaaaaagaaucugcugacaggggcggaggcucuugcacaaucaccaaaagcagcuccucucggugaaauuugaugguguucauuccauuucaggcauucugcugggggcuaagggagauccacaaacaugaaagaugugauccuugcccucgaaaacauucuacuauggaagccaaacacaaaugcauguggagucucccaaaggaagcaaggguuuacagguuuugucugcuggagaaagucuauccagcugaaaaaguucaucucuucccuucccugcgaugaugccucuucagagagggccaauuugaagcauucccgaagauuuacuaucacccaccaaacuauaguguugguaaauauuuaaguauugugagugugggcucgaauuuguuggugcuaaauccuacagcccaaggaggaaagcugaacagcugauagaaguggcagccggugccucccagggugggcuuucaacuacgcugcacuguggcaagggcuuggacagaccuggcauguggcucaccaggaccucucuucccaggggcagucagcagaggagcagagagguugaggcuguuagggagagaaugguaucaggagguggggaacacucugggcaguggcaccagcacaggcaugaaccagguacgggaagaaacuggucuggccucuaauccauaaaugcagugcuugcauccugccacuccuuugcgggccgugggggaggcaggugacugaccuucagucagauaaaaugccagugcacaucuaucugaccacaaaauuagcuuuuacacugucuucuugcaaauacccuccugcauguccacacacauacacacauacagcugcucgucagccaagaccgggccacuguucucuuagacgccucaagccucaccccuaacagccuuaaucccaccacggccggcaggggccuuaccacauggagggccuucugaggaaguccaauuauucaaugaacaaacaccaccaccaaucagucagccugacugcagaacacagugggaaagaguugcacaaaaauucccuguaaaaaaggaggcacuagcugcaacucguaaagggaagaggagguuaggugcaguggcucacgccuguaaucccagcacuuugggaggccgaggugggcagaucacuugaggucaggaguucaagaccagccuggccaacauggugaaaccccgucucuacuaaaaauacaaaaaaaugugcugggcaugauggcacaugccuguaaucccagguacugggggaggccgaggcaggagaaucccuugaacccaggagaugaagguugcagugagccaagacugcaccacugcacuccagccuaggcaacagagcgagacucagucucaaaaaacaaacaaaaaaaaaagggaagaggaagagcgagcuccucaggaguucccauggacauauggaggguuggagcaggcuggcauugcugucaggguuaacagaaaaugcaaccagacagcaaaauaacaagugcugacacccuccaaccccagagaucccacugagaauggaaaccugccaauugcuucccaugugcagaccuucacaugcacaguuauucacugcaccacugucugaaacuccaagagcccagaaacaaccccgcauccaccaacaggccaucacacaugaugccaugcagcuggguaaggaacuagaaagcuguaggcaucaggcaccaagauaagcuaauaauggaaaaaagcaaguugugucuauguacacuguugguauauaaaugcaggcauggggcaaacgugucuacacuggcuucaccugcagacaaaguugggccagauacagaagguuucugcccuggaggggagaaaccaugaagcugggauggcacugggagggauauuuucuguuguacacucucuuguaccuuuugaauucaaaaccaugugaauacauuaccuacucaaaaaaaaaaaaaaaaaaaaaaaaagggaaccuaauuugggaaagcacaaaugcauucaaagggagcagagcuggaaguuauuucugaaauaccucccgggccacugggucuuaucagaugaacacgagcuccagacacuggaacccaccacaacagaauaagcacucucagaaguagucacccgagaugggcgauuuuccaagaaucuaaaccagcagcccugcuccugguggaagacccuuggaggcucuguccccgcacccagccggcucaccucugugaggauggugguuucauaggacggcugguauuucuccuucucuugggcaguucuuuucuccaucuucucccggucagucuucuguuuccgaucggcucccuucggcugcgagcagaguacagaguccaaucagcccaaaaccaacacaggcagcagcccccaagcccucuccugcuucccaccucacccagggccccagggcgcagggaggaacucaggggcaggacagcaccuaucuccccucccauucugccugaaugcuuccccaccugaggaacucggaaccugccacgggucaugcacucugcugcucaaggggaaaagauuguuucccauggccacucgcuuaugaaaaggaagcuuggggacccacaaggaaucccagugcauuccuuggguuacccagggagagcagaggaaaguggaagaaguacaggcugcuggucuggauuuagucugugcuugcaaccugagaaauccuggccauaagcugaaggccuccuuacccccaacucucaggacucccgcuaagccccagcuuacacucugucugcaggggaacgucuccauccagagagagagccugacaaucaugggugcuuugcaaaccggggcaacuuucaaaggguguacaggcuucacagcuauuauuauucccuucauuuacagagugggaaacugaggcucaagggguucaucaggaugggagaggauccaagugagaguggccaagugugcugcaucgcaggcuggcccugcagguaccaccauggggcgccuucucgaccuugcuauguagucuccugagcaugugcaucuuaugaccucaugccuacuuggcgaagucagauguaaagacuccgagcagcgcuagaaccgagcaguuuuacuacccacacagcaggcuacauguggugggcagguaaugaaaacaguaguucaagcucaacggcaccuugagggauuuucauuccagggggcaccuuucucaggcuacagcuuucggcucccagaucaaggguuuuuagggagcaucucuuacagcagugguccucaaccucugggccacagaccgguaccggucccaugcccuguuaggaacugggccccacaacagaaggugagcagcaggugagugagcgaagcuucaucuucaucuuacugugaaguaaauacuucacaguauuuacagcugcucccuacugcucacauuaccgucuaagcucugccucccgugucagaccaguggcggauuuagauccucauaagagggcaaaaccuuuugugaauugcacaugcaagggauccaggcugcgugcuccuuauaagaaucuaaugccugaugaugggugacuguccuccccccgccaccucuauaugagaccaucuaguugcaggaaaacaagcucagggcucccauugacucugcauuaugaugaguuguauaauuauuucauuauauauuacgauauaauaauaacagaaauaaagugcacaacaaauguaaugcacugaaucaucccgaaaccaucccccucucuuccguggaaaaacggucuuccacagaaccagucccuggugccaaaaagguuggggccccgcugccuuggagugaugccugcccuggaugaagcaggguggcagaggucacacagggaugugcgcaacagauccagcgucccggguaagagugugguguguggcagccauacccccacgaccuggcuucccugcuccaccuccagcuccugucucucaggagacuccuccucccugcacagaggguacaagcaaggugggguuacagccagaccauggccgagccugcaugcagggcacgcacugggccuugaugaggccuggagggagcugguugcucagacaggagcccugccuuucccuucagagacccugacaccccacacacagucccagggagcggcuccaacaagccaggcuucccaguaacuggggugaccggcgaacggaggggugacaggcagcuuggcucggcucagccuggcuucugcacaucagcugcaucucuucugugagugggggcaggcagguggaaggacacaccucaggcauucugaggagccaguuuugggugacuaggggcccugccaccccuacucccugcaggagaugccaaggccuuccucagggcacugagaccacgcagcuuccagcccaacuccccaagcaacgccuggcauggguugaggagccugguagacagagcccccacuccuaagcuucugacccaagguguagaagcucccacccauggggguggagaugccuaccucaauucucuccuacugcccagcacagcgucucccccagggcacacaccuugagagcagcagaacuaacaugacaucccuggugagggagugaaccgcugccugacgggggccaaggcuggcagagcagagacgcggucuguacaugaggggaggugguggccagagcgacagugaaccacagacuaggagaagaccacagcacacagccaugcagguguccaggaccggcagaucccagagcaggcagaaauaccacagggccgccacgcccacugcuugguggacguggucggcagaauaaugguucccaaagauggcuguuugcuaauccccagaaccugugaauaugucaccuaacauggcaaauggggaauggagguuucagauggaauuaagauugcuacgcaacugaugcaauaggaagacuaucugggauuaacugcuuggccccguguaaucacagcauccuuacaaaaggaagagggagguagacgaggagguuggggccgccaugugagaaggacucagccugcuccugcuggcuuugaagacaaaggaagaaccaugaaccuaggaauggcuuuggaagcuggaauaggcaagagccccgcccagagccucgggaaaggaacacaggcccgcugacaccuuuagcccagugaggaccauuucagacuucugacugccagcacuggaagauaauaaaugcacagaguuuuuagucauaaaauuuguggccauuugugacagcagcaauaggaagcaagcagaguagaggagcacagcuccccuuggaggccacugcucugccaggaaagacaaacacacaucccuccagccacuucucccucccacuuggggcccacaucacugacuaaccaaggcgucccaaaccacggagcugggccagggccucagaacccugugcccacaacggucaggcagcccggcuguguggucuccugagugcagacuccaucagcucauccucggcuuccucuacugcagcugugauggugcguccccagaucacugcccagugcucacugugggccaggcucugugagaaauggcaccaucccugucucccaggguugccaccagguuuaugguucuaccugugggcauuuauucccacauccguuccaagcaugggucuuccacaggcccgugccuucggucugggggaagaucagcacacacccagcuuucuaaagggcccugucuaaagcaacucccucuugggucuccagccccagaagauggaacuuucucagcaggcuccaaauucacuugaaugugaaacaagaggaagauggaaugagcaccagggcugguuacucaaggcaauuccugcccaggagguggguccacuccuucucugcaaacaccugcuagagcggccccggcagacagggccuacaggggcuggggacuguggggcuggggccugcuuggacauggauugcccucaugcccugagaaugaugcaagcucaugcaacccuccacaucucccugaggccacacaggacacugagcucuaucguuggcuacuaucuucaggaaauaaucaguccagauugaagagauggaaaauagugacaggcgacuguagggaaugaagcaggggaagaaaagggaggugaaaugaaaauguuucucuaacaggaagccauugcaaagagaaaaauggcuucaagcccucaacaggaagauccgaggccaggccuccagcagggagagacucuugcuuugauuuuuaaggagaauccagacgugagcaccugugggcaacuguaaugugcuugggagaaaaaaaagcuaaaaugugcaaaucccaaucauucuuauagaguagcgccgaggaccgacagccaggacggacauccaugccgaugcuucugccagaagcugagcgggugccgcaggugaaaagaugcccccagcagggcagcagcagccuguggugccuggacuugaagcucgugugcauuagaagcccagguagaagccaugugcuaaagggaugcugcguuccucgcugggccuguaagaggaaacuccagggucucugugggcgaaugugaccacaggccaggccagcagcagggcacggcagagccugcgaagccauccuaccuugaacaccuugaucuggcagcuggcugagugcaggugcuccguguacuccccauucucguucugcuuaaacgugucaaucuggacucgaaagggcacucccuucucgcccccgugcuuccugggggugaauucugugcugaugcaguguaccugggaggagaaacguugggcagguggcaaggaggcaccaagcagggugccccuggaucccccaagcgcccccucuauuggagguguccuucccugcuuggucagugcaggccugccucgaccucccugcuuucccugacacucuguccacuccaucaggccgguggccucccuguuccccugccugcaaaagacauacacacccccaccuuugucucuuuacuguggaggcccugccugaccagcuaaguccccaccacuccccaggccacugaccccaauaaccucaaccuaacuccucacccagauuccucucccuuggcaaauccuagacugagggcagggaccacagcacagcccuaaccccucucuaauguccugguguccaggcuacucaggccaggcuuaaaggacaaccagaaggcuggaaccauuucuguacuucugguagguuccuacuacauaaauggcacucgauaucaauguauuguuauaauacugcaauauuauaagaauccauacauaacuguaauaauaacaauguaauaauuuuuaaacauauuaagaguauuguaauuguaaaaaaaaaaaaagagaaagaaaagaucgcuuuuauugagugauuccuagggaccagacagugcuaauggcucuguauucauuaucugauuuguaagaugggagguuagaaaacuaagaggcucagaaaggggaggagacuugcucaaggacacacagcaagcgagagagccaggaucaagccagaaccgcaaccacaaugccacagucacauccuucaccaccuugaucucacauggcauauaacacaaggcuggauccacaccagugcuugauaacaaaauaauucauucaacaauagaaacuauaauagaaaaaauguuuacuuucaaaugauuucuguugggaaauacucauuuauaaaaagcuuauauauucuacgggcaaaacccagauagaauucuaaaacccuccccacuccuuucccuaaauauggaccaaugagcucugugacucuuugcaacacucauucucucucuccugcaguuuccuucccagugacagggagcagaagcucauccagacccucccagauggguuaguuuugagaaacugcacgcaggccaccccaaagacuaggucuuccccuggagggcaagcucccuguggcccaccugaaugaaugcagaagcucucuucgcagggucccacaaaaacucgacugcauucagcugggucgggcuggcccugggguccaagauaccaacagacaguggaauaucugcauacacacacacacauacagaaagugcaauugucagccucucccaaauauuuagggaaagaccccuguuacaggucccaauuccuucgccccaauuugcaaugccaaaagcucugaaaaaguuuugcauaacuuacuggacggaaagccugaccugaaccacaagcgcuguguugucuucaccccguuuuguaugaaccgucauuuuauuuugcuacagaaauaugaccgugcuuggcugccuguuggagauguucccugaugcucuggguacacacaucguauugucauucuagcuucugaauuccaaaacccaccuggccacaaggauuauggguaaaggacugugggccagucccugaggccccagaauuccauuuccauugcccaucuaucucugugaugcucacgguugucuucaacacuuaucaaaauccuuuaaggcaccauccuuccgcaaagccuucccugaacucccugugagcaggucucucaauuccacagaccuuucuuuuccacugaaaaaggggacuccucgagggcaggacccaguguauggucagcucugcaagcucccgcgggguuuuacacagagcaggugcaagcuaaaacgccuucucggcauagguccggguggcauccaggaagaacccaauguggccugggugccucgagccuugccuggccucuccuggccaggagacucaccgauguccaggauccgguccccuggccgacuccaccgccagcccuccagcugcuggugcuccguauacugcagccggcggucauggaagaccacacggaugaugcucuggggagggaggccagcagggaaacaagugaccgcggggggccaagaggaacccaccucuuuucccugagccacaguaaacccucccaccuuugaggccccucccccuggggcuuccuuucccaguucucaagcuuugcccacuguccccuccucagauuccaguaacacuaacaacagcaacaacagugaugacuaccauuugucccaguauuacuaagugcuuuacguuauuaacccuuuugugcagaugagcaaacugcagcucagaaaaguucaacgcugccagcccaucuaauccccaccugggcaacaggcuccagagaagccaaacaggggcugcgucucaccguugagggcugagcugaacccggccucucccuaaccuuccagcuacccgugcccaaccccagcaagcccaggugcccagacccuaaucaagccccucuccccgaggcaaugagaacagccugugaggcuuaccuugacauauuuuguguucagaucuugaaagucucccagcuuccgauucuccaguagucggauuucauaagacugaccuggauggggguuaaaaggacauuuuccauuucugaguauuucuaaauuugggguucauucagcuagcagccuucucaacacccucagugcccauccaggccucaaggcccuggggagcaaagcagagaagaaaacccacgaccagcucagcucacucucuggacugacaucagucuguccaccccgccaggucgggccuaggauaccccagacaacacaccgugugacccuacuagagauagcaccucuacaauguucaaauaaacagaauccaggaaaauacaguuagcauuaaaaucacugaacacaaacucauacaucuuuacaaaccccccaauacaacgggauggagaacacagcuacuuaaguucacauuacaggguaaauaaccaaccacacccuuccugagagcagguuugaaggaacgaagaagccuguuaaacauugucucuaauggcagaaugcaaagcauguuccccaguuaaaagaauuccauguauuugaaaggguauggaaauuauauucagggacauauaacuagcacaggcuggucaaagaauauaaauggaaaaaacauccauccauaacaacagaacauuuaaaagcaucuaugaaaccugaaggaaaugacacgcauuuuauugaaauauaaaauauaccaugaauaaauaggauacaccauguucccagaagacuguuauauauauauauauauacacacacacacauacauauauguauguguauauauauauaaucucaaaugaugauaucucaaaugaugccaauuuucccaaaauguaucucaaaaaauauauauauauaacucaaaugaugccaauuuucccaaaauuaaauacugaacuacaauuuuacaagacuguagcauauaucgcaauuuaauaaaggguguuuuacaaauaauaaaauaaaucauuuaauaauugguauuggcauaucuuuuuuuuuuuuuuuugagacggagucucacucuguugcccaggcuggagugcaguggcacgaucuuggcucacugcaaccuccgccuuguggguucaagugauucuccugccucagccuccugaguagcugagauuacaggcgccugccaccacgcccagcuaauuuuuguauuuuuaguagagacaggguuucaccauguuagccaggcuggucucaaacuccugaccucgugauucauccaccuuggccucccaaagugcugggauuacaggcgugagccaccaugccuggccaguauugguauaucuaauuagcuuuuuaauuuuuuuauuuuuaauaauuauagacucuuaagaaguuacaaaaauauggccaggcacgguggcucacaccuguaaucccagcacccagcugaggcaggugggaucacuuguggucaggaguucgagaccagccugaccaguauagugaaaccccaucucuacuaaaaauacaaaaauuagcuuuggugguaugugauugucaucccagcuacucaggagacugagacaggagaaucacuugaacccgggaggcagagguugcagugggccaagauugugccacugcacuccagccugggcgagagagugagacuuggucucaaaagaaaaaaaaaaaaaguacauuaaaguccuguguaccuugugccagcaucccccacgguggcaucugauggaaccaugguacauuaucaaaacuacagaccuuacuucgauuucucuggguuuugcauguucccucucucuuuuucuguaggcuuguauguguauaaucuaugaaauauaaucacauuuggagacuagcuauuuauuucagagugcagauccucacagcaaauaucaaaacaaguuaucauuggauuaaaaagucaauuucuuguggaggaacagggaagauguugaucaaaggauacaaauuuccauuagacaggaggaauaacuucaagagaucuauuguacaacauggugacuauuguuaguaacaauucauuguauucuagaaaauugcugacaggcuauuucaagugcucccucuacaaaaaaauaauaaaugagguaaugccuauguuacuuagcuagauucaaccaauguacaauggauacguauaucaaaacaucauguugcacaugauaaauacaauucucauuagucaauguuuuuaaaagucacuuucuuaagguuuuauuuuaacaugaaugacuaucagauacucaauaaggaagaacuuucugaaccuaaaaccaauggaaaggacaucuggcuauauaaaauuuaaaauuacuucuauguaugaauguaaaaacacuuaauacaaacugcagacuaggaagagcaaacccaguggcuacgggcauucuauucuauuguauucuauuguauucuauuccauucuauucuauucuauucuauuuuugagacagggucuugcucugucacccagguuagagugcaguggcacaaucaagacucacugcagccucaaccuuccaacucaagcuaucuucccaccucagccucccaaguagcuaagacuacaggcacacgccagcaugccuggcuaauuuuuuauuuuuguagagaccaagucucacuauguugccaaggcuggucucaaacuccugggcucaagugaucccccagccuuggccucccaaaguacugagauuauaggcacgagccaccacgcccagacaagagcuauuauauagcucaaaaagcaauugauuaguaccaagacacuccuguaguggguugaauggugguccccaaaaagauaugucacauccuaauccccggaaccuggaaaugugaccuuauauuuggaauaguagucuuagcagacacaauuaagauucugagacgaggaagucacccuguauuaucuggguuggcccucaauccaagugugcuuaugagaaacacaagagacagaaaagagaggaggcaccaugugaccacagaggcagagacugcugugacagggucacgagucaaggaagccuggggccaccaaagcucaaaggugugaagucuccccaagaucccccaggagcauaacccugccgaauuuccgacugcuaaucuccagaaccgugagagaaucauuuuuuguuuuaaguuaaugcaucuauaauuaacacguuuguagcaacuuguuacagcagccacagaaaacaaauacacucccacccucaccaaagaauaauggaauggacaaagaauaugaaauuaaaucauucauuccaaauguuuguucacaccuaucauccccgugcuuugggaggcugaggaaggcuggucuccaacuccaaccugggcaacacagcgagcugcugucucuauaaaaauaacaauaaaaaguuugcugagcaacaauuugaugccaaaugcggugggugggaauccuaggaacagagaggccagcagagccacacggcaccauguuccuggaguugucaccacagcuccccaccggccaugacacuggccgagcacagccaugcccacugggucagacuccgucucagccauuaggaaggucucuggucacaugccagugaacacuucuugaccaugccaaaccccagugcugcucauggugacgcgcuggacgccuuucccaucagagggaagaggagcaaaccccaaacucucauccugcccacuugccuguucaggagaugugacgccuaaaaaggucuugcuucccuauucaacauggcugacuuucugaaaaagccagauugcauacauuuccaggcuccugaaccaagaguccaacacucccuugauaucaacauaaaacaugccucacacacccuaacugguuuuuccaauguccucugccuucacagauaaagaaugcugacagcggcccuagcaugaggcccaauguccagguggucauuaagugaguuuacgggugccacagggcccaguuauagcacugaccccaggcucugcagggcaaccucagcucacgccaaacagcaagcaccuccuguccuguagagagcaacuuccaggccugaacauaaggggcagcccuugaacaaaggguaaagccauugagugaggcguuaggcccaggaucacagcuucuccugggccagggaucacggcugcaggagccuucuccaucagcagcaggguccugauccacacacuucaccaccaaauccuccuuucuagccaugcagauggacauccagccacccucugcaugccuacccccgugccaacacagugggcccaaggugaccucccacccaacucacacagcagcacaacagcaccaucccaaaagccacgcagaaggccaccacccacagucacauacaggcugacgagcgaggucacacaggcugaacugaccuagggcacaagggcauuucucugccuggccgacaucacugcugggcguggguggaagccaggacagcgggcuaugagaaggcgcgggucgugucuguucugcucaucacugcgcugucugcacacaguagguacucagcaaaugcauccaugggauuucaccuucuuuacagugcuauagugcuguucucuguuagaauuacaggguuugccaaaguuaagacacauucuugcccucaaaggguugacaauccucuggaguacaucaaacaguccuggaagagccguacuauaauguuuaaaauuucuguaagagacaaaggaggcccaaaagugagcaauagguauccaggacgaggcggggagugugagacagguucgaaccaggggaugagaaaacaugugacaugggcuuugaagagugggcaggauuucuguaauucaggggaagaaugauaaagaaaucccaaagccagccaggugugguggcuuacaccuguaaucccagcaagggauuuuuggccuuugggaggccaaggcagauggauugccugaggucaggaguucgagaccagcauggccaacauggcgaaacccugucucuacuaaaaacacaaaaauuagccgggcgugguggcgcaugcuuguaaucgcagcuauucuacucaggaggcuggggcaagagaguugcuuguaucugcaaggcagagguugaagugagccaagaucaugccacugcgcuccagccugggggagagagcgagacuccguuucaaaaaaaaaaaaaaggaagaaaucccccaaagcaaagcacagccaggcagagggggaggagugccucuagggaacagcugcaaacagcuccauucacagggugcuuaucuguggcaaagcccacucaaguagucacucaccuggcucuccagaugaguggcacuagcaguuaggaucaccugcccuccuggaugggggaagcagaggcucagagagguuaccugacaggggcaagcucacauagcucauaaguggcagagcccauggcagaaucucagucaguuuccagaacccaccacacuugccacaucccacccagugggugucacgugcugggcacaagacagcuguaguuguccaugauccucucucaaccucuccuuucuggaaggcaucugcuuccauucugcacacagauuaaagugugccgaauguuguacagcguaacuccccaaguuaaggcuucuguuuguuuccuacguucuuaacaaugauccaggagggaaaacaaaucauuauagaagguggugguaaagccuguucuaauuuaggaauuguaaaaugugggggggagggggugagagggagcuggucuuagaaucaaggaaauaggcuaaaaauaaccaaaacugaauugucacguagccaugugccaguacacugcaagcccuguauguacgucauuucacuuaguccacucgauaauccuguaagaaaagucuauuguuucccuauguuauaaacgaggaaauuaaguuccagagaggugaaguguccuguuaaagaucaaaccuggucugucugacgccgaagguggaacacguggccacugggccaccccuccacaccugcuggacuacugcacccaauguuucguucuugcaaaggucccaucuggcuccaauauucaaggaguguaucuauuacauuuccccugaacuuauuuuuuuuuuuuuuugagacggaaucucgcucugucgcccaggcuggaguacagcggcacgaucucggcucacugcaagcucugccucccggguucacgccauucuccugccucaggcucccgaguagcugggacugcaggcgcccgccaccucgcccggcuaauuuuuuguauuuuuaguagagacaggguuucaccauguuagccaggauggucucgaucuccuaccucgugauccacccaccucggccacccaaagugcugggauuacaggcgugagccaccgugcccggccccccugaacuucuugauacucauuuuauuucaggaccuucuucuacacaucuaaacccucccgcuucuccuaagguucaaaucccuacugccccaugcccucagcucucugaaccaagauggaccuagaacucucaugaauguguaaccaugccguggcauaaaauuugauauucguuuccuugcgauacacuagucccccugaaacacauguugccauacucugaacauacuguaaagucauggcacacuaaagccaugugguuuuggcacggggagaaacagaacaauaggaaagaacgaggagcccagacgagacuuuuauuuggaaacuugauacacgacacuauaaaugacgauggguccaucuuuucucaauagugugggauaacugguuauccauauggaaaaauuaauccugaccacuuaauaaauauaaucaauucuaggugggcaggccgggcacagugguucacaccuauaaucccagcacuuugggaggccgaggugggagaucaccugaagccaggaguucgaaaccauccuggccaacauggugacaccccgucucuacuaaaaauacaaaaauuagccgggcaugguggugggcgccuguagucccagguacucgggaagcugaggcaggagaauugcuugaaccaggaggcggagguugcagugaggcaagauggcgucauugcacuccagcuggggcgacaagagcgaaacuccaucucaaaaacaaaaacaaacaaaaauacaaaaaauuacccgggcgugguggugggugccuguaaucccagcuacucaggaggccgaggcaggagaaccgcuugaacccgggaggcagagcauagguuguuggaggguugaaggugcacccagcagagacuggcauacaggagguccugcaacggccccaggaaaccucuggguccaguaagagcuucagcaggagguagaaccauaccgggcaggagugccuggaaaggcuucaaggcaacucccuccaaaguccuggcccaacccuacacugucaggcuguuaaaggccauuuaaaagcuagcagggaaggagcccagauuacuuugugaugaaaacuugugagcaaguagcugccagcccagcccagaggagccaaggugaccuugggaguggcaggggcuggggaggcacagugacaggcuccacucaccacccacccccaccucaggcugagcugaggcccccuccugccuccccuacagcuauagcccgaggguauccaggcaguacugucccucccgggggagggguggggcuccucagcuggauuuaggcugccacaccccaccacccuacaagaaggauggccugguuccugcccaagggcccugagccacacaaacggguguggaaacuucuuaccccaaucuuaacagcugugcuuaggcucugcccccuugccccuccugcccuccacccaccugaagagcagcagggggcaggggggaggccagauaaaauacacaagugcucaacuaaacuuugugcucucccucuucccaccugcaccccacauguccaacaccuccagcccaagcaucagcaaaccuucccugugaagggcugcauagcaaguaucuucagcuuuguaggacauaagaccgcccacacuauucaacucugccacugcagccaggaagcggucacacaccacacaggaaugaaugggcagcgcuguaauucauucaaacacugaacuuggaauuuucauauaauuuuucuucuuccuguggacuuccuuccuuccucccaacugcuuucggcgcuuugcaacuuugcccaccccucccuccuugaaugaggggcuaagucacagccccucaauggacaacggaaagcucugagaaccggcccgccaccaguucacccgaaccaggucaccccuacccccagcaccauggacaauacugguaugucgucgguuuuuaauuaacaguggcagaauuugguguuaaauucuuuacagcaaauaacagagcuggaacuugucagccaaacccugaagaacacgaaaagaugcuccaccucacucauguaaagaaaugccaaaugaaaacaaugcagccacugccugaucaccugucagauggcaaaaaacuaacagauugcuggcaucccacaaggacagcgauguggggaaaugggcccucgccucacacaugcuggagcugggagauaacaagccacagccuauggggcacuuugguaauacccaucaauauuaauaagcgcccagccaccccaucaccaggacuccagucuauagagcugccagcuuaggcgcuaaaaaaucugcccaaggcuggcuauucaaagcagcaguacugcuacagccccaaacuggaaaugaacaaaauggucagcaaucacguuacuacuaaaccuuggggccaccacagaggaagaggcgcacagcuucacccaguggugcuguuagcauguccaccuccugcguggaccacugaggacgcugcaucaccuacuucuugucccugcccaaaaggcaccaccugaaucucaacaugaggaaacacaagcaaacccaaacagagagaccaucuacaaccuccuggccugcaccuucagaagcaucgacaucaugaaaaaugaggggagacugaagaucuguccagauucaagcggggucaggagugggacaacugaacacaacguccaguccugaacugggucuggaucaaggcaaaaaccugcuacgggacaucagaacaauuggcccuauuuuaauaggaauagaugauaggugaggguauuauauugauguuaaauuccccaauuugauaauguacuugugguuauauaaaagaauguccuuguucuuaggaaauacaugcuaaaguaugacuaagagaucauguugucugcucgggcgcgguggcucacaccuauaaucccagcacuuugggaggccaaggcagguggaucacuugaggucaggaguucgagaccagccugaccaauauggugaaacccugucucuaguaaaaauacaaaauuagccggaugcgguggcuaaucccagcuauuugggaagcuugggaggcugggaguagguggguaaucccagcuacuugggaggcugagguaggacaaucacuugaauccaggaggcggaggcugcagugagcugagauugcaucacugcacuccagccugggcaauaagagugaaacucugucucaaaaaaaaaaaaagaucauguugucugcaacuaacucucaaaauauucagcgaggaaaaaauauauauaauagagauauccauaucgauagcuaucccuaucuauacaucccuuuauagagcuauagauauauauacaucuauagauaguuacacauaaaugcacauaggugcaucuauauagauaaagcaaguguggcaaaacauuuaaaaacuggugaaucugauggaggauauacauacuaaccauaauaacuuuuuaauucuuccauaguuugaaauugaaaauuacuuugaauuagaaguuaaaaaauaauuuuaaaauuaagauuacaaaaaggcuuaggcagaccuagaucuguuauagauguaaaaagccauccaccauacacacacaugaaaaagcaaguugcugaguauguacacagugugacugcacuuuuguuuuaaaauaaguuauacucaaacccacauauuuguaagucuaauauauacaucuaacaaugggcagagaaggacuuuucccuguuaaauuagauauaucuucaguauuggccugaaaaaaaacaacuagggauauauugcaucugaauuugaaaaauacaaaacaaagaaaagaggggaaaguccuccacacuguuccaaguacauaauggaugcucacaauacagcgauugguauuuauuuucccagugucaggcugguacccaaaggccaaucagacaggugguauuuggggaagggaguccaguucauagagcaggaaacacaugcagaccauguaagacaggcagaagccccaucaacccagggucucauugagagaucacccugaagaacccacaguacacuaggaccgugcccauuucagagaugaagaaacuaaggcccagagaggugcugaccugcccaaggucacagugcaaguuaauggcaaagacuaaguagccuacagccuggcccaggagaagaggggaaagggagcuggggucaggucagauacaccaccgggguugacucagaccccuugacacuccaggaccacagcugaguucuuaaaucucucagcauuucacucucaacaucugcaaaauguucuuugcagaagucuugugaggauuaaaugagauaauguacuucccgcccacacguauuaauaguaaguacucagcaagggccagccaaauaacagguaucguaugcgcccuccuacggagcccuacccaugcacaggucacuguauuccgugcugcacacagaaacuguccuccagcccucacacagcuccacacaccaagugaccuaacugccaaggucacagagccaggagaaagcccagcugggauacacccccaggcagggauaacuccaccaggccauccacugucuuccaggaucugcugcugcaaccacagcacugcccagagcaggcugccccucucccagugggccuccccugggucgugcccaccaggugcuccugcagagcagcauggaaagccagaguggcugugccccagugagcagaacccagcacagggccuccugccuggaucacaguguucccaagagcaggaggcaauugcccgagcuagccaagauuuacagguuguuuacuuuccuacaguuacugguuuggguaauuaaugccacauaaaacauaauggaggccaucauuaccagugagaaaggagggcuggaugccaacugucugguaauaacgguagaugcagaaagcacaauccugaacucaucgugcccagcacacacggcugaccuugucucuugcacaugugcaauacuaggcaagugucuguugacacagagcgcucacacagaagaagaugguaugcuucagggaaaaggcuuugccagcaacacacccuaauccugagccugauggacuaucaccugcaugaccuugggcagggcauuugaccuucuuuuugcagcugcuuaugaaugccacaggcuaggcaucaugucuggcguaagaugaauccaaguaaacacuuggaagauaguuacugggggcuccuuagagaaaggacuguuuacagagcuggggcaggcagaauacaagaugagacuuaagcaucuguagugccaaaaggugaggaaaugcucaaaaaagaaugaagccaugucagagcaacacaagcaccaacccaaaggagcucucgauggccacagcugaacaauguaaacaacacaauaaacagcaaaaugauuucaguuuuacccacagaauaaaauaacuauccaugagucuauacugauauaguaagugaauaaauaaguuaaugguagagaaggaaaaacucuuuuauaguagcauuccaauuacagaagaaaaucaacagaaaaucaccauuaggcaaccauuacaauaauaacugguguggacacaguccaacaacggaugcuaaaauaagugggcaaagauugagagggaaaaagcaaaggguaaacagucuccaagucauauccuccaccccaagauuauuuaucaauuacaaaggaggagagguaauuuuacaguggagaaaccuggcagacacuacccuaacuaaaucagcaaggugaacagcaccagcaaaagacguaucagcaccaugauccccaaugcacugcuggggauacgaugucacuucaguaguagucuugccaaaaauguauaagcccaaucucaucauuuaaaaaacaucaagcagacucaaauugaggagcauucuacaaaaucaagcuuuuggccaggcaugguggcucaugccugcaaucccaacacuuuggaaggccaaggcaggaggacuguuugagcucuggaauugagagcagccugagcaacacagagagaccucgucucuuauuuauuaaaaaugauaauaacaaaauaauaauaggccagccacaguggcucuugccuguaaucccagcacuuugggaggccgaagcagguggaucacgaggucaggaguuugagaccaaccugcccaacauggugaaacccugucucuacuaaaaauacuaaaauuagccgggcgugguggcgggcgccuguaacccuagcuacucgggaggcugaggcaggagaauggcuugaacccgggaggcgaggcugcagugagccaagauugcaccacugcacuccagccugggugacagagugagacuccgucucaaaaaaauaaaacaaaauaaaauaauaauaaagcucuuuaagucugagggucccggaagacaaggaaagacaaaaggacugucacagaucgaugaagacucaggagacauggcaacuccccugcagcgugggauccgggaacaacggacaguagugggagaacugguaaaaugcacacaaagacuguagcagacaacagaauucuaucagugucaguuccugguuucaguaauuguaccacuguuauguaauagguuaacauuaugggaaacugaggacaggguacccagaagucucacuacuaucuuugacaccuuuaugucuaaauuuauuuccuccuccacaaaauacacugggucuccauaugaacaucgacaugcucauaaguaccuggacacuuaauaaccauuuuuuaaauuguuugauuugcucucauacugggaauauuaucucuuuuuucuauauuuuguuuguuuguuuguuuguuuugugauggaguuucacucuuguugcccaggcuggagugcaauggcacaaucucagcucaccgcaacccccaucuccgggguucaagcaauucuucugccucagccucccaaguagcugggauuacaggcaugcgccaccacguccagcuaauuuuguauuuuuaguagagaugggguuucuccacguugaucaggcuggucucgaacuuuccgaccucaggugaucugccugccucggccucccaaagugcugggauuacaggcaugagccaccaugucuggcccuuuucuauuuuauuuuauacuuuguuauugcugguacauaggaauucaccaguuuugcuaguugaauuuguauccauaguagaugaacaauaugaaacuguagauaacugacugauuuugauuuacaaaauggcaagugcauaugguuuaaccuaauauaacgguucuugaagacgcacaagcaaaaagccgaaagaaaaaugagcaauggauaucaacugucuguuuuuggcaaaaaaaaaaaaaaaaaaaaaaaagggcauacaaacacaugaagaugcuuaauuucacuuguaacaguuacgagaaaucagacaaauacaaaucaaaauaaggugcugcuauucuccaugcaaauuagaaaggauucaaaauguugacaaugccaaguguggagacagguguccucuuguacaagagguagggauauaaacagguacuaucucuuuggaaggugauuugacaaggccuacagaaauccuaaacacauauaucacugccauuuguguguguguguuuacgacaaggccagauaagcaucuuugcuuguuuaugcaugaaaauauacuggagccagggauaacaucagcugccucugaggaggggcacugggugccuggggcagaggugggugacuuaccauaaucccuuuuaccacuuaaauucugaaccaaguaaaugcauuaacuugccaaaaaauaaauuuugaaaacaugaagaaaaaagaaaaaaagccugcccuguaaguuaguaggauaaaggacaguaaagaguagaaaaaccaaaucuccaaagauaagggcagaaucaugacucacucaggcaccucugcuccaagcccugccaccuacauaggcuuggggcucaggagggggaacccgugugccgggcugagaguggucgcauggccacaucaauugaccccaggucucgaaggcagggcccagcccacccagccacuggcuuuccacuugcucauauccaacccccaccaccuaccugcuccaggcagucccauuuugugucccagccucuggugagaaggccuuucuggagcagucucuacuaaggcaacacagccugcuucucucucauacccaggguaucuaaggacccucucugagacugcuccucuauucccagccucuggcugcagaguggaaauggggaaggcggggacagccagggucaguuacaccaggcccaccucuugggccacgggccaccuugguccaagugagcaggugaccaagccagacucgcaguccccuccugggagugcagaaucaggaggggaaugagagcaccugucucucuaggcagcugaggccgugugcucucaggaggcuuugguggccuugcugucugcuaucuggccaccagggcagggaugcuggugggcagagcuugcagaaggcagaugcccagagaggaaccgacugaagagucaaagaaugcuccccaacauuugagccccugguucccgugcgcuucgggggcccagcuuugggacacucugcuuuaugaggcuggcagauggcugccagucuguuacccauacccucuccaucauaaagacagacacuaaacaauaaauaacaacaaauaacaagugcuggccggggagaagcuggaucccuccuguauugcugguaacaauguaaaauaguauagcugcuuuggaaaaccgucuggcaguuccagagucaccauuugacccagcaauuccccuccuacaaauauaaccaagagaaaugcaaacauagguccacacaaaaauguuuacacaaaggcucacaacagcauuauucacaauagccaaaaaguagaaacaguccaaauguccaucaacuuuuaauuuaaauaaaacgugguacaucccacaguggaauauuauuuagcaauaaaaaaggaaugaaauacugauauaugcucaacaugaagacccuuaaaaacaugauggacagaaaaaugccgccacaaaagaccaccacuugugugauaccauuuaugugaaaagucuagaauaggcaaguggguagagauaaaguagauuacugguugccugagggcgggggaaacgagaauggggaaugagugcuagggguacaggauuucucuaagaagggacaaaaauguucuaaaauuaguugugauggcuaaguauauuuaguugaauaauaaaaaacauugaauuuuauacaguaaaugggugaauuguaggguaugugaaucauaucacaauaaagcuuuuuuuuuuucuuugagacagggucucacucugucacccaggcuggagugcagcggugcaaucucggcucaucacaaccuccaccucccagguuugagugauucuccugcugcagcuucccaaguaucugggauuacaggcaugagccaucacgccuggcuaauuuuuguauuuuuaguagagucgggguuucaccauguuagccaggcuggucucgaacuccugaccucagaagauccgccugccucggccucccaaagugcuaggauuacaggcgugagccaccgugccuggccaagaguggcuccuuuaaaacaaaacacaaaacaccuuccucauucagagcagacucuguacacauucuuccaaguaguaaucuuuuuuuuuuuuuuuuuugagacagggucucacucuguggcccaggcugaagugcagugauguagucucggcucagugcagccucgaccuccgggguugaagcgauuuucccaccucagucuccugaguagcuaggaccacagauuugugccaccacaccuggcuaauuuuuauauuuuugguagagaugguguuuccuuauguugcccaggcugguccugaacuccugggcucaagugaucugcccaccuuggccucccgaagugcugggauuuaaucuuuuuuuuuuuuuaauaguuuuuuuuucccccaaguaguaauucuaaccauagcacaguggccccugaaacccgacucaggaucccauuucacuaacagcaaagugagucuucccaucucugaccuuccuuccuucccucucuccuccuccaaauauccacaaaaaauugccaaaguuaguggcagaaggaaaguaacacuuacugagacccuaugauguaccuggcccguuaaugugauuuuuccauaauguaccauauaaaucauaacccuauuucugcaguuaccagagcaaggugagaguguaaaguuuauuaaaccaggguccucuccuccagccccacugauggucuguccugacugccaggcaccugcuugguuuagaggcagacaacagcaggguuccaggcaggcaguugcagucaccugggacuagcaagguuuugaugcuucagugagugacugugugucuguuuuuccagaugggucaucaagucacgaaaugaaauuuuagggacuugcuuuaauccguucucaaucgaggaagucuaucacauccccagugaaagggugaccugcccuggucuguacuaagugcugcugagugacucaccagggcuuccaaugcuuccgugcuuuaugacacacuucaacuucaacagaaaaucuuuuggcuggcucuuuuuccuucaaaguauuuccaaaauacagaugauuuuaauauaauuauuuuuuucauuauuuauuuauuuauuuauuuauuuauuuauuuauuuauuuauuuuugagauggagucucacccuguugcucagacuggagugcaguggcaugagcuuugcucacggcaaucucugccucccaggugcaagugauucuccugccucagccuccugaguagaguuagcugggacuacagugccugccaccacgcccagcuaauuuuuguauuuuuaguagagaugagguuucaccauguuggccaggcuggucuugaacuccuggccucaaucaauccaccagccuccaccucccaaaguccugggauuacaagcaugagccaccgcaccuggccacaauauuuauuauuuuacagauagggucuugcaauguugcccaggcugcucuugaacucugggcugaaggcauccuccuaucucagccuuccaaguagcuaguacuauaagcaugaaccaccacauccagcaaugugauuauuaagaacauauuauucuggaauuggacugucuggaauucaaucacauaaguaugauguuuuaauuaacuggcccauuacuacuuaaaacauaauuaaaguuugacacgaccauguagacaccuaugaacauuaaaaaucuuuuuuuuuuuugggacggagucucgcucugucacucaggcuggagugcaguggcgcgaucucgacucacugcaaucuccgccucccggauacaagcgauucuccugccucagccucccgaguagcugggacuacaggcaugugccaccaugcccggcuaauuuuuuauauuuuuaguagagaugggguuucaccguguuagccaggauggucucgaauuccugaucucaagugaugcgccugccuuggccucccaaagugcugggauuacagacaaugagccacaacgcccagcccuaaaaaucaugucuaugugcuauaagcugugauaagcaaucuguacaaguaaccucguauuuauuucaauacauucugauugguuuucaaaacaacaaagaaguccaggcaugguggcgcacaucuguaaucccagcacuguggaaggccaaagcaggaguucaacaccaaccugggcaacacagggagacccugucucuauaaaauauauguuagccaggcuaaagauugcuugagcccaggaauucaagacugcagugagcuacgaucacagcacuguacuccagccugggugacacagaaagagucugucucucuaaaacaaacaaaaaaacaauaacaaaacacacccccuauuaauuuauugguauuuuuauuaguuuagccugagauucacaaauuacggaauucacaaauuucacauuuuggaaagcguuuguucuuuguuguuuuuuucuuuuaaaccuuugaacgugguuuaccacauucuuugcugauuaaacauuuuuauaaauauuuacauuuuuuuuaaguuuuggccuauaguaucuuucccauuuauuuauuuauuuauuuaguaacagggucucacuguuacccaggcuggagugcaguggcacgaucucggcucacuacagccucaaccuccugggcucaagcgauccuccugccucagccuccagaguggcugggaccacaggcgugcaccaccuugccccagcuaacauuucuaaauuuuauauggccaaaauaaaguaucccuauauggcaaaaaaauacaacaaaaauauuauaucauucuccaggcuauacugagguaaguguuaugccuauuuuacagaaaaugcaguugacagguucaggggagaagagaagaaccagacugggagcuggguacauccaacuccaacauucaccacuuucaaugugccacucaguuguuaggaaaggcuaauuaauagugucauucaggcuggcauuugagggaaugagggaaagguguuuacuuuaauaacacauacuagauaccuuucacggccauacagaaggaccugcuucauucuugucacagcugcauauuauuccacuauaucaaguuucuacauucagucaguuauugugggacaaugugaugauggccauauggaaauuaacagaguuggagcccuaauguauuccuuaugcaccauaauaaaugucaaaguaucaaagauuagggaaaggcuuuuuuuuuuauuaaaaaaaagauggauaucaauaaaaucuuaaagugaagaaggcauuuccuaaaugggacaugaaauacaaaaauaauuaaggugaaguccaauaaaccggauaauaaaaauuuaucuuaaaaacuuuuauggcugggcgcaguggcuuacaccuguaauccuagcacuuugggaggcugaggcggggguggauggcuugaguccaagaguucgagaccagccugggcaacauggcagaaucccaacucuacaaaaauacaaaaauuagucaggcuugguggcggccauuuguaguaccagcuacuagggaggcuaaggcaggaggaucaccugagccaaggagguugaggcugcagugagcuguaaucgcaccacugcacucuagccugggugacagaggugagacccugucaaaacaacaacaacaaaaaaacuuuuauuaugggcugggugcaguggcucaugcguauaaucccagcacuuagggaggcuggggcaggaagacugcuugaggccaacaguugucgaccacgcuggccaacauagagacccuuucucuauaaauuaaaaacaaacagcaaaaauuauguaaaagaggccgggccugguggcucaugccuguaaucccagcacucugggaggcugcagcggaucacuugaguucaggaguucgagaccagccuggccaacagggcaaaacccugacucuacuaaaaauacaaaaauuagccaggcgugguaguggacaccuguaaucccagcuacucaggagguugaaacaggagaaucacuugaaccugggagacagagguugcagugagcagagauugcgccacugcacaccagccugggugacagagcaagacuccaucuaaaaaaaaaaaauauauauauauauauaugcaaaagaaauaaacuaauuuaaaaaggaaugaaaugaaugaaaaagugggaaaauauuuccaguacauauuauaauaucccaaauauacaagcagcucuuacaaauaaauaaggaugaaaaucucacuagaaaaauggguaaucacaugaaaggcaaaaagaguaaaaugaaaaaauauuucacaucauugaggaaaggagaauuaaaagaagacccuauauuuuccccaccaguuaccaaaggguaaacaguguuggcaaaggcaaagaaaaacagaccuucuucagucauuuaaagaagugauguaugcuagacacugggcuaggccucgcagugaacaagaugaccaagucucugcccucaaguuuauauuucauguguggcagagacuggaaaaagauaagggaggagaaaauaaacaaguauucagauaguuauuguucacaaaguacaaacuggcacaacuucacuggaaggcaauccggcaguaccuaccaaaaugucaugcuggcaauucuauuucuagguguguauccuacagcuauuuucacucccgcuuaaacacaaagauauacauagauguucacggauuacuagagcacgagguuauaacuaugaaaacaauggaaacaagccuaauguuccucaacagaacaagcuauacaacagccauacaaugauuguaguguaaccaguaaagaucagauuuugcuuauuauauuuuuaaauguacucauguggaaagacauugaagauauuuuguuugggggaaaaaaaaaagcagcaggacacaguggcucaugccuauaaucccaacacuuuaggaggcugaggaggggaaaauugcuugagcccaagagcucuaggcugcagugagcuaugauugugucacugcacuccagccugggcaacagagcuagacuccaucucuaaacacacuuuuuuuuuuuuuuuuuaaagcaaguuguuggccgggagugguggcucacaccuguaaucccaacacuuugggaggccaaggcagguagauuacuugaagucaggaguucgaaaccacccuggccaacauggugaaaccccgucucuauuaaaaauacaaaaauuggcugggcaugauggcaggugccuguaaucccagcuacuugagaggcugaggcaggagaaucgcuugaaccugggaggaaaagauugcagugagccgagaucgcaccacugcacuccagccugggcgacagggcaagacuccgucucaaaauaaaaauaaaaaaaaaaaaacaaaaaagcaaggugucaaacagcaaauauaaauaugaucccauuugucuuaaaaagcaaaagguacacguggcgaacauauauaagguuauaugcauguuugucuauggaagcagauauauauggguuaaaguaugacuacgaaaaaucuggaagguagaacuauggcacauuuucuagaguauauaugguuuggcuguucuauuuuauaaaagaauguacuacuuuauacucaggaaaaaacaaggggaaaacauuuuuuuaaguaauacguuuuaaagucauuugguuuauucaguuuauauucccaaacuucaggcuaaaaauuaaucuggaaagaaaacuucagcuauggaaaaaagacaauaaacaaaauaacuaauccuuugccucauuccuuaaauucaaagucacugauauaauugguaagaaggaaaaauauaacuggguacuuauuguuugccagguauuuguuguucacguaacccacaaagugaaacuguccugguuucauaaaugaggaaacucgggcuccaaagaaucaagugauuucccuggagcagaagcuggucaaaaagacagaacugcaaaucuguuugguucuaggagcagggaagacaggacuuuccccugaagcucuuaucucccucccugagguugcugugaguggaaaacaggaggguuggggguaggguaggagcaacugauaauggacguuuuuuuccucuccaaggaggcauuuucuccccacuccauuccuuccccccacaaagcuucauccacccucccucagagcugcaucaggaguaccaagugacagagcuccugcaccgaagugccuggccuagaauccugccuucaggaacuccaagaaaaagcagccagagaaagaaagggugcuuccccuuccagaacucccuuuauuauugcaccccacuucaaucacucuccuggcuuucaaacuuacaugauauaagagggaagccugauuucacccucucagcuggucaucuguaagaugggaacgacgcaucuugggagaacaacccagaagagaguaucagaaagugcuuuccaaauuuucaagugcuaacaaagaaguaccacccuaaaggcugagguucucgccuaccagguaauacaaacccuccuuaacaugauaguuuacggcauuuaggaguucagugcuuuuugugaucuuuauuucuaaaaugcuauuucaacaccuugcauaggaaauucuccgcaggguuaugucccucgugugguuguacagcgagugaagaaugaacggaaaagugaagcaagccuucccaaagcuaccaccguuuaacucuaagagaugcaguucuuagcuuuagagccaacccuguguuaaucuuugaauugggaaaagagaggauaaaaaucagcaaaaguuaucaaagucucaacucgaugaccuuguuaacuuccaaaacaggauuggcgagaugcuuccucuuuauuaauaacaauggcugacaugugagugcuugcuaugugcccggcauuucaguguucuacaugcauuagcucauuuuacccauauggcagcaccuacuuuguagggaguuuacuucccccaucucacagguaaggaauuggaggcaaagaaagguucagugacuugcccaggugguugccagaugguuuagccucagcaaggcagguggaguucuaggucagauaucuggucuaccucuccagccauaucacucauauuuccccuuguguuugaaacccucaucauccugaacugcuuaggauuccugggauagacaguguguucagcugcacccccaugcuugccuuugcauguggcuuuucuuucuucucaccaagccaccauccucuuccaaccaauaggaaauuuuacuccaugaaugaaugaaaguaagcauauuaugaaaauucauuacuauacuuaagacucaagaguuguuuugacagaaaauaucaaagcauuccccaccgcaagucauuuuugcaauguuguuucuuaucucaagccagaaauccccaugcagauugccugggguucucucuucucugcucucccggacuccuccuccuccacaucccuugucaucccuccacacccuccucaucccuucccucaggcuccagccuucgggaagauaugucuacaaugaccuuuggccacugacaaagaggaaguuaucuggaaguuugcaaaccucuguucaacucucuauccaccccuuggaaggaccuuuucagaggaagagaacagaguuuguuuuucaaaucauuuucaccauaucuaaaacuagccacucggcuuggugauaggacaucccuaugaaacacacauguccaagccacagguccucaaggcauuuguuugacacggcacugagaaaugggcauccagugguuuaagugacuuuuugauuuaugccuacagcaucuuuuccauguuuucagagaacuuuaaacacaucauuacaaggaaggggagaggaccugugauggcuucacaagaauaaugcaguaacuaccauagaggcuuauaaacacuuaauagcaggcuuuucaauuaacgaaaaaugucuugaaugaugugucaaaacuacuuuuuaagaacuguaucuuggcaggccaaggcggguggaucaccugaggucaggagcucaagaccagccuggccaacauggcuaaacccggucucuauuuaaaaauacaaaaauuagccuggcgugguagugggcgccuguaaccccagcuacucgggaggcugaggcaggagaaucgcuugaacccgggaggcagagguugcagugagccgaggucacaccacugcaauccagccugggcagcagagcgagacucugucuccaaaaaaaaaaaaaaagaaaaaaaaaaccaauuguaucaaugccuuuggucauaugaugaagaauaagcuacuuaaaugagguacacugaaaaagauaucuagugcagcauuacugauugguggggggauaaaaucaugccuauuuuuagauuuucuaaauauuuacagagcaccuacuauacucucaaggcacucagcuuaauacugaggauacagguugagcaucccuaauccaaaaauccaaaaccugaaacuuuuugaguccugacgugaccccacauauuguccacaugggcggcugagaucaucuuuucugaugacucgauguacacaagcuuuguuuuauaaacaaaauuauuuaaaauauugcauaaaauuaccuucaucuuaugugccuaagguguauaugaaacauaagugaauuuuguguuuagaugugggucagagccucaaaacaucucauuauggauaugcaaauauccaaaaauccaagaaaauucaaaauccaaaauacuuccaaucccaagcauuuaggaaaagggguauucuucagccuauacuuuaaaauuuuaggggccaggcaguggcucaugccuguaaucccaacacuuugggaggccaaggaggauugcuugagcucagaaguuugagaccagccugggcaacauagugggaucuuguaucuacgaaaaauagaaaaauuagcugagugugguagcacauguuuaucccagcuacuugagaggcugaggcaagaggacuaauuauuccaggagguggaggcugcaggagccaugauuaugccacugcauucagccugggugaaagagcaagaagacccugucucaaaaaaaaaaaaaaauuauuuaauacauggcucagcccuauagaacuuccauucuauuaugggaggcagacacuaaaacaauuacacuguauauuuuuuccagcaguuaugacaauauucugcccuaaauaacaaaaggaaauagugaaauaacauguagaggcugggcgcgguggcucacaccuguaaucccagcacuuugggaggccaaggcagguggaucaucaguucaggagaucgagaccauccuggcuaacacggugaaaccccaucucuacuaaaaauacaaacuguuagccaggcauggcggcgggcgccuguagucgcggcgccuguagucccagcuacuugggaggcugaggcaggagaauggcgugaacccaggaggcgaagcuggcagugagccgagaucgcgccacugcacucuagccugggcgacagcacgagacuccaucucaaaaaaaaaaaaaaaaagaaauaacauguagacauuuuacauguuuaggauacuuuuaauaauaauggaaaauguuauuacaagaacaguauuuaauaaaagcaagaaacaaccacauaaagcauaaucucauccauuuguuuuuuuaagaaaaaguauagaaguaagucuuuuuuuuuuuuuuuuuuuugagacagggucucguucuaucacccaagcuagagugcaguggcucaaucuuggcucacugcaaccucugccuucuggguucaagcaauuauccugccucagccucccaaguagcucggaucacaggugcccgccaucacgcccagcugauuuuuguauuuuuaguaaagaugggguuucaccccguuggccaggcuggucuagaacuccugaccucagaugauccaccugccucagccucccaaagugcugggauuacaggcgugagccaccgcgcccaguugagaaggaagucuuaacgguuauaacccucuguaagaauaaauuauugggaacggcuaaaaagaauacugagaggaaccucucugacaaaggaaaacauauuucuaagcuacaaaaauuaguucaaugaggaauucggcaagaacaucagcagcacaggacaagucuguauauugcuugccuuacaauuuaggauaugguuuguuuuuaaguuauacuuaaguucugagauacaugugcagaacgugcagguuugugacauagguauacaugugccauggugguuugcugcacccaucaacccguaaccuacguuagguauuuauccuaaugcuaucccuccccuugucccccaccccccgacaggccccagugugugaucuccccucccugugcccauauauucucauuguucaacucccacuuaugagugagaauaugcggaguuugguuuucuguuccuguguuaguuugcugagaaugauggguuuuuuaauguuucacaagugucccagcauuuugagaggccgagguggaaggacugcuugaacccaggaguucaagagcagcuugggaaacaugacaaaaccccaucucuaccaaaauuacaaaaauuagccgggugugguggcgcacaacuguagucccagcuacucaggaggcugagguaggaggauccccugagcccgcgaggcagaggcugcagugagcugagauggagcuacugcacuccagucggggugauggagcaagacccugucucagaaaaaaaaaaaaaaagaaagccaacaaaaaaaguuucagaauugacuuucuaaauuugugagauaaagguaggaaaagucaggcaauaacuagaaaauaaacaaacucagaucuucauaucacaucauaaauuccaaaugcauuucaguaaguguuaaaauuuagacaccucuaaaugaaauucagaaaacuacucagcuaauugauuuugagaugagcagccauuuucuuuuaagcauaaaagaaaaguuuauuucaaagaaugaaagauuugauuugaccauagacauuuaaaauagaucucuacagaaaaaaaaaaaaaucacaacauauaccuuacaccauaaauauaguuaucacccaacgaaaguuaaauggccugcaaccaucagagaaaaauacuugcaaaaaaugggagcuaaaagguugguauucuucauaaauaguaugcccuuauccauaaaacauaaacaccccaacaaaaacgugcaaaggacaggaauauaauaaacaaauuaaaaagaucaauaaauguauuuuaaaauauccaacugcauuaacaaucacagaaaugcuaauuuaaggccagggguggugguacacaccuauagucacagcuacucaggaagcugaggagggaggaucacuugagcucagaaauuuggguccagccugggcaacccaagccagaccccagcucaaaaaagaaaagaaauguuaguuuaggauuaaauuccauguuucacuaaucagaugacaaaaaacaauaaccaauauuggaaaagagacaaaauguauacugcuggcuggcacguaaauuggugcauucuucugagaaagcaauuuggugauaugcaucaaaagccucaauguucaaauccuuugauccagaaauucuacuucuuagguauuuauuuuuaaaauacauaaauaaucaacauuucacaggaagauuuauaugcaaggauguuguucaucauaauaguauuuaauuucuaacuggaaacuaaguggccauaauaugaaacaguuaaagucauagaaauauacaauguaauacuaugcagccauuaacagaaaugcaaguccucaaaucauuuucaaugacaugagacggcugacaaauauaguaaaugaaaaaaaggauauaugucuguaacauaaucacagaaagauauauauacaaacauguagaaauaagguuagcagugguuucuggugaaaucggaggggauuuuaauuuuguuuuaauugucuuccuuuugcuuuucuaaauuauucaaacuuucuauaaaguagauuauuuuaauaaccuacaaaauauaauuuuaaaaauauaaauauaccaaauuaacaugagaugaugagaccauagagguaacuccuuuuucucucuuuuuuuuuuuuuuuuuugagacggagucucgcucugucgcccaggucggacugcggacugcaguggcgcaaucucggcucacugcaagcuccgcuucccggguucacgccauucuccugccucagccucccgaguagcugggacuacaggcgcccgccaccgcgcccggcuaauuuuuuguauuuuuaguagagacgggguuucaccuuguuagccaggauggucucgaucuccugaccucaugauccacccgccucggccucccaaagugcugggauuacaggcgugagccacugcgcccggcccuuuuucucucuuuuaacugaucuaugagaggaucaacuuuuaaaacucuuuuuaaaaaaaccuaguaggcugggcacaguggcucacgccuguaaucccagcacuuugggaggcugaggcagguggaucaccugagaucaggaguuugagaccagccuggccaacauggugaaaccccgucucuacuaaaaauacaaaaauuaggugggcgugguggcacaugacuguaaucccagcuacuugggaggcugaagcaggacaaucgcuugaacccaggaggcagagguugcagugagccgagccugcaccacugcacuccagccugggugacagagcaagacugucucaaaaagaagaaagaaaaaaaaaaaaacaccuaggggguggccaggccugguggcucacaccuguaaucccagcacuuuggaagcccaagguagguggaucacuugaggccaggaguucaagaccagccuggccaacauggagaaacaccaucucuacuaaaaauacaaaaauuagcugggugugguagcacacgccugaaaaaccagcuacuuaggaggcugaggcaggagaauugcuugaacccaggaggcagagguugcagugaaccgagaucgugucauugcacuccagccugggagacagagcaagacucugucucaaaaaaaaaaggaguuggaagggguagaggaaagguaaggaacucagcuaauggccuuaccaacaggagcaggggccagggcagggacagacacacaauaucuuggucuaggagcaagaccucagaccuuggacccacucuucagcaccacaggacuuagccaacaagaagaaccacaucaaagcucaauggaugcuauaaacaucucauuuuugccugcuaaauuuaagcaaaaaagcagaggcccaaagaggaaagaaagugcucaaaggugcauaaccaguugguagcacuugaccuuccaugaaagugaaaggcaaauggcaaaaaccauuccacacagcggcacagaugcacacuuggccacaucacccaccaaccauggccaccguccgcugcagauggugcacaggucuccgggccugagcaggaagcucuaaagcugagggagcucggcugagcaagaacaacugaggccagcagagcugcccuuggggauaaagcaucaccuuccacugcggccccuccacaaugagaggggguugcuucuacccagagggaggcagacagagccagcugcuacuucugagcuaguuucuuggcccagaagcuggcaaauucagcaguaagcagagagccugaugaccaaguuggacuuccacccuggcuggcucuccaaauugaggaaucaaaguucgcggagaggaagcuacacauguaagacaaauugcuacgacaccgcagcuccccugcaauucccugugaccccacagaaaccagcguuccucugcccgucugcucugcccauugaaaguagagggguaucauaccagucagggguagagcagacacacaguccuuugcucauccuugcuggaugccuggguggguggccagaacuguuucaugucuggggcacacaaacaauaaaagauaaagcagaaggugacaaauccacaugaugccaggguggucaugagacgacccagaagaaagugcaaaaaacgcauacucauaaucaugauagaaccacaaaaacaccauccaucaggacacuugcccacguguucuggaaaagggaaccagcaacugaacaaccacuaucauaccaggcaccucacagaccuucauucuuuuaaacuccacaaaauuauacuucuuguuuuacacaugaaaacacugagguucagagaaaaaaaaaaaaggcagcuccaagucacagagcuaggaagugccagaguuggaauucaaacuccaaagccuguuucccucaggacauggugagggaacuuguccccaucaccacagaggacuuuugucuagcauggauggaacccugcuccggugcugcgcaggacacaggccagccaucccaucacugccaggugcagcuccaggaccugggaugcugacgguacucaguguaugucuucaaaggacacaaucauggucacaauaaauaaucaccauguguccaggcacaguggcuuaggccuauaaucccagcacuuugggaggcgcaggcagguggaucacuugagcccaggaguuugagaccagccugggcaacauagugagacccccccagcucuacaaaaaauuuaaaaauuagccgggcauggcggucuacaccugugaucccagcuacuugggagguuaaggugggagggucacuucuuggguugaggaggucaagggugcagugagccaugaucaugccacugcaugccagccugggcaacagaacaagacccccucaaaaaaggaaaaaaaaaaaaaaagaaagaaagaaagaaggaagggagggagggagggagggaaaaacagaaauaaugcuagcaucugcuccauggaggggcuauaggaggaaugcagaguguuacccuguuacccgcgugagguaucugauguuuccauuuuucagaugaagacacugaggcuggagggggucacacagcuggaaaauggaaucugaaccugcaccuguucucuuucccgagcccgaccucgcccgaccucacccaccguaacaaagucacaaggcccaaaugggccuuucgcaucagcuccccacuacuucuggguuccgcccuggcccggggccucuggccacuaccuugguugagguaggucagcgucucuucaugcagcuucacggcuggggacguggcagcacacaacacauauugcagggguggcaggcgggccucguucucgggggacagcugggguuccuccugcuugaagaugggcagagcgagcacaucacugcaacacacgggaagcagaggucaggagcagagccccagggggcuccugcacagagccagggcgaagcuagagagacgacgcagaccaccggggcccagggugacacggcacgcgcaucgcagggugcuggcugcacuccugcaacccucgaauacuccagaugcuuuaaaacagaggaaaccgcuccuucgugacucuaguuucacucaaugaccccccaaaacacugauucaaucagcccaucaaggagguaaaagggcaaaguuagcuaacaucuacagaaauccucuccaugccagagacaggcuagcagcaaagggaccucuaagacauuuauuugguuucuauccacaagcgaucacucauaaaguuucacuuuuagaauaaaaaucuaaacaaacauuuuuauuuuuuaaucaacaauuccauuuaccggccacuucucauagcaauacaacucuguccuccaggcucuguaaacuaugcaaaugaacaaaccacuuccuucccucccugaguacccagguugagacauuccuccaucccuucuaaagagaggacaacuggacacuguuuucagggucauucuaaucuguccaaaaggcaaacaggaaggaaggaccuuggcuucaagucuguguuugugugguuguuuuuuuugggcgggggcgggggggacggaguuucacucuuguuguccaggcuggagugcaaguggcgugaucucggcucacuacaaccuccaccucccggguucaagcaauucuugugccucagcuuccugaguagcugggauuauaggaaugagccaccacaccuggcuaauuuuuguauuuuuaguagagacaggguuccaccauguuggucaggcuggucacuaacuccugaccucaggugauccacccuccucggccucccaaagugcugggauuacaggugugagccaccgcgcccagcccagucuauuuucuuauccaagugggaaaucuugaaauccuugcuccaaguuucuuuuccuccaccucuuaacaaaacucuccacauuaaaaaaaaaaaaaaaaaaaaaaaaaugaagucaucauccugcgacuuagggaggaacuuguuucuggacguauuuuuuaagccaggaacaguggcucaugccugaaaucccaguacuuugggaggcugaggugagaagacugcuugaagccagggguuugagaucagccugggcaccauagugagaccccaccaucucuaaaaaaaaaaaaaaggaaaaagaaagaaacaaaaaacccagcauuuuaaaaaugcccuuacaagggacaaagaauuccuugagaacaugaaugaccuacaggcaggcaaggcuuguguaaggucucuaaauuaugagcagcacauaaacaagugccaaauaagugccagugcucuuaucuugauaacccucuucccuucgugggucccugacuaggaauccaauuagcugaccccacuugucuguauaaacagagucacugguacaaucuguuccucgcacaucauaaacaagcgucucuacaacacaaacccggcacacaccccaucaacaucucaucaauuuugagaagaaaaagccuggcauugagcacacaccuggaaaaccugcccugugugggccucccccgucaccauccacugccgaaaaauaagggugcaaggccgucucgacuuucccccacagggcgucuuccuuuugucagagcagggcacacucccagcccgggugguucucuaggaacacugaggauugcauaauuucauguuugcccagaccaugucaaguuaauaauccacggacugcugccuuuaaauuuuuuaaacaggggcgggugggcagaggaaguuaagaaccaucccucaacaguaacuuguuucaagccuggcaucuuuauuugccaaggaauaaaagucacgagaacaucaaacagaaagggggaagggaguaaaggccucuacccuggugaggucagacagcuugcagaaguucugccaagugaggagacgaccaaaaauaaaauacaaaaaacgcaaggaaaaggaccagacccucccucuagagucaggggaccaggggcauaugcacaaaccgccaccuuggcccucacugagggcaaaacucccagcuuccaagaagugaaauaaaaaagggcaaggacuucuuuauccauggucccccgaugaccccagaagccaauauggcuuuacagcaccacccacucccaacgcucacccuccuccuuucaccaaauccuaaaagguaccugagcuacuccagacaaacuuccaucucgguagcagaugucagaacuguaccucccaggcaagggagaauuguucccuaacggggugaggacauuguagguaucuaggaaguuucaaguacacucaccuucaacucagggucaccuucaaacucauuguuaagauauggcaacauacuuaauggcagcaaacuaaaacuuagccaaagcuacaacuaaaacuucaguacaguaaaaauguauuccauuguagcauuucuugcaagugaauggacacuuaaucucugggugauuaacaucuccuccugggcuucccucuggugacaucaccguggucugccggguggcugucagccuuuaaggcucuagaccuuugccaucuccgacuacuuuggcccaugaauaaaaacagcagauacauccacuaaacccaaucauucccccgccuccaggaaaaggggaugucuucagggaggacaaauaccuaccagcagccaggaauuacaaauaacguuuuaagaucuaagugggaacuucuuggggccaaaacuagcacuuaaagguagcucuaguaugggggcugucaaugccugugacuccuucggccucaucauucauuuuccuugagcccauaucaaaugcccuuuggguuaaauuaggcacauuucauaaacugugacuaagauggaaauaaggacaggcuaaagcugguucaggcgaguucacaaagugaaaugacugcccauuagucccggccagcagcagaacagggaaaaacaauccuccgggagcgagagcacacgggguccuacugcuaagaggggccuguggggaacugugcaaaacacgcaggacuuacuuuccccucugaagggcacuacucaaaucccuccagcagaagaaagauuuccaucaagggcaauaaccacgcgggccucgggcgaacacgcgcaagaccaucgcgggaaguggggcggccugccccuccgagcccgccgcccgccccucguccaaggaagggcacugcagagggcgcgaggcugggagaggggccccggcggagacgggcaaagagcaggggacgaacuuccccgggccgggcaccaggcugcuggcaggaaguuuccucugcuucuccgauacgcgggggagaggagggccgcagggggcggacgggccaggggaggcggcgggccggcaggugcgcgcccugcacccucucugccgccugggaggagcccucgcagacauagggcucugcgcgcucgccuccccagcgggcccccaacuccgcacgucgggucccgccggcguccaucugucagucccuaggcgggacgcugggcgggucucucaguccccagagggcggacagcggggaggccagggcccagcaggggcgcccccucuccgccccuggacguccaacggcgcccggcccgccggcccggcccgagacccgcggggaccgcgcgcggcccuuaccgcagguagcugccggaguugugcugguuguagugcucgggcugcgugugccagaagagcauggcuggaacucccagcgcgccgaccggggcgcggcagcaagcgcagacgcggggcgcgccgaggacccagcggcggcuucgcgcuccgaaccc

SEQ ID NO: 191138 - RNA, 41873 nt, Homo sapiens
cgcucggggggugggaaagcgagcccggcagcucaaugacaaaucgguggaggacggcugggguccggccccgggagggggcggggcgcguuuaagagcugcgggccgggugcggacggcggaggcggcgggacuggucccugguaagggcgcggcgcccgcgggccccgggcgggguggggcgcgggcuggggagugggguacgccgcacgcccgcagccucuugcucccuccgugccgggcuguggccgggcggcggcaggacaugucgcgccccgaggccggcggagggcgacgccccggcagcggccccgcuccgcuccgggaggacucccugggggagucucggcuuccugggcugccuggggcugaggaagugggggcggccuccgccucucccuuguagccgcgguuccuucccuaucccgcagauggcucugcuuccacuuccugccgcgggccucccgcucgggaccguccacuuccucaguccuccggccgcggcuugggcagggucagggcugggaaguguugcaaaaacuuaacugcccucggaacuugcacgcgccgugaacugggcgguguuccuaaagggcuucgguuugcugguuuuguuuugguccugucuugcaaaugagcauaaaguuguuucucccccagccuccuccccuuuccuuucugauaggggccagcggcgaaggggcuucuaaggggaagcgccuggacugggcaucgccgucccgguucuugccgccugugggagugugagguuaaccgugcucggugcaggguugcggggcgcggagcuugcugcguccacacugcuugugugagcaguguccucucugugcucauuuccaacgagaaacguuggaacuuugguguucuuaucaggugagucuucgggagagaagugcuugugccuggcggacugaaugaauuggccguggaagagacuuggcugauugcucaucuggguuaccugugacucaucuucagcccuuguagaacagugcacuuucugcucuguccugguuuccuaaccucauuucuucugaaguuuuggggauggauggugggcauggaguaucagaggggauagugaaucuuuuagaggugucaaugacugauguuccaagcagagccauaagauuguuggaugucaaagcucagaaccggucaaggcucagaaugcuccuuaaaccuggagcaauagaagcacaguaucgaaguucccagaaaugggccgaccaugaaagguagcacugcauauugggaaaaacaggaggggugaguuugaagaccuggguuugaugcagguucugagaguuuaccgguguugugauguggagcacgaucuuucccccucugagcuccagagucagcaacuguagaagggugaugauaguuauccuaauuguuaggauuaaacgaaauaggagcgggggagaagaaggccagggagacauauccuuugugcguggcuuuaguugucagccggucugcuuuauucugaccacaucuggggcuuuccuuccuugcccauucacauugcuucccauuggaaacagcacucuuaucggagaucucagccagauuucccucugcccgaggaauagaacauuuucccaggauuguguguggaaaauaguguaaguuauuagauaucuuuugggaacuugggaccuagaccauaaggauaaacaggauuuagagucuuccacggcauaugaagagauuuugguagaagaugaggguagaaaaguucuaaauucuugccuugacugaagauggcuugagauuccaugaaaaauuuuaagccugagaauugagauaauccuuuuuuuguuuguuuuugggggcagagucuugcgcuauuucccaggcuggaguggaguggugugaucaccgcucacugcagcccccaccucccaggcucaggugagucucccaccucagccucccgaguagcuugguacagucuugcaccaccaugccaagcuaauuuuuguauuuuuuguagagaugggguuucaccauguugcccaggcuggucucgaacugcugggcucaagccauccuaccaccuuggccucucaaagugcuggggaucacaggugugagccaccccgucuggcagggauaauucuuucuuccaaaucacguaauccuacuaugccucuuugcauuuaguugcuaaauucuuaccccccucauguaacuuauggaaguuagaaacaucauuagagaccuuucuugaaagcuaaauuuggagacaauguaagacuagagugcgaagagaucuaggugaacucuguaguuuuccaguguaacuugucuccagaugguauacaggagucccacuuuuccuuggcuccaguuacugcuaaacagccccugcucuagacaugcaagacgcuugguuuuuuuuucguuuuguuuuuuuaaaugaauguauguucugaauguuaucgcaaagagagccgagcacagaggaaaaggaacucuuccuucaucacauggcggaguaguuaaggaggagaaaaacuaacaguuacugagcaucagcugucugcuuggcacagaccacugauccaagccauaccaguuaaauauguggccuuggagauuugaccaugggcugucuccuuuagcuccucaguucuuuugguaccuaggaauauaaauauugguguauguguacauauauucuuagauauuccaaaaagcagaggggccaguaggcaagaggguugaugagucuuggauaggugacaguggaaagaaagaugaagaggauguggaagugagugucaaagagggacgguauaugugcuuacuagaagcaauugcaaaauucuagccaggucucaauuucaaguuugucacuuuaaaaaaaguagcugcuuauaauuuuccuuaguguucuccuggcuguuuuuguuuuuggugaugguggcuaguuguuuuuuaguugaaaucuaaaugcagaaaagaaaaaugccauuaauugauaauuaccaauauauuguuuucauuguugcuuuugucagugcuuugugggcauuuuuuauauauagcauuguuccaagcuauacggcaugagaugaaggaaauauaguaguuugguccugcgugccuggcugccuguaaaguuugccuaccuuuugaaugaguuuucuguugcugcauaacaaauuuccccaaacuuagcagcuuaaaacaacagacauuuaugaucucacacaguuucugaaguugaaaucuggggacagcuuggcugggugcuucuggcucauggucucuccugagguugcagucaucugaagcucgacugggaccagaggaucuguuuccaaaauggcacguucacauggcuguuggcuggaggccucaguucuacaccaugugggccuaugcacagggcuuuucacaacauagcuuuucuccccagagcaagugaucugacggggguggggagagagggagagaaugaauaugauaaugaucaagauggaagcagcaguauauucguggcugauaugguuuggcugugucccuacccaaaucucaccuugaauuguaauccccauaauccccauacguugugggagggacucggugggagguaauugaaucaugagggcaguuucucccauacuguucuccugauagugaguucucacgugaucugaugguuuuacaagcgucuggcauuuccccugcuggcacucauucucucuccugcugcccugugaagugguuccuucugccaugauuguaaguuuccugaggccuccccagcccugcggaacugugagucaauuaaaccccuuuccuuuauaaauuacccagucucggauauuucuucauagcagcaugagaacagacuaauccagugucuaaucuuggagauggcauaccaucccuucuaccagcauucagaccagaccuggcacaaugugggaaaggacuacaagaggggaggucagggcacaucaguauucuuggaggcuagccaccacaacuuuuuuaagguuuaguccagacaucauugagaaaaucuuucuuucagauguuuacugaaguauacuguaggagauggaaagacagcugaggucuuuaguauuguagaagcuuuaauacuauaugugaaacuuuuauguucuuucuuccgguucuuuguuagaugcuggaauuagccaaguaugcaguagcuuuggaaauagaaauucagaucuugcuggucccuaaaccaaaaggaacaucugaauuuuuuucuuuaaccccaaaacaaguugguaaaaaaauauugccaaaguaaucuccuuugaugaauggcuuaaaauuagucauucauuaucuguguguucuuaaaaauaaaacucauuggcaaaguagcugaaaaauuuuggggaaccuaaacccucuuacuccuccccauuauuuuaaaacuuuggauacugcuuguuugccuagcaguucuucaguucacuuuugagacccucauacauuuuaauuauugaccuggauagaagggcgcuauucuuuuagcuccagaugaaaucuuccugaagugccuauagguggagagaagaguuucuggauccugagccugagccuggcuaaaugaccucuaagucccuuccaucucugaaaauucuaugauccuuauuuuuuuuuuauaacgaauauccuuugaguugugcauauuuauaacaaaauauuucauugaucauguuaaauugcaaccucagaagacaagcuuuucugagaauagcuuuuguucuucccaauccaguugaagguuguuagagucacuguuaggcagaguugaaaagucagcacuauuugcacuuccucugcuuccuauuuuuggccccuugcccauccucugcccuaauuuaugagcuaguaucuuucuuuucuuucauucuacuuuccuuguaaucccccuccuuccucccacaggaaggauugguggccaguccuuuacugcugauagcugaugcuauuguuaggaaugaauuuuagccaauguguuaccucuaguaauacuugcauggcaaaccuuuuaaaaaucucaaauuauauguguucauguaguaaacacugccauuuuuuaacauccuaaguagcccuaaaauuuagucacuuuccucaugugcauuguugucuccuuaguccccaccguguugccggccuggccuggugcauacccacaucugcucuugaccccucuguuuuucuacucuguagccagaauuaccuuuucaacauucaagccuaauuauguuacccauugacuugaaacacuucaguggcuuuccagugcuuucagucaaaggucccaaaucccucaacuuggccuacacuggggucuugaaugaucccgcccuuccuuaccuccucagugucaucuuguacugggcucugccucuuucucucugcugcagauagcugugaaggucuuucucgaguuucuugaguggacuuugcuuccucuugcuucaggccuuccugaaugcagugugugugugugcaggcacgcgugauugggggugggggaguguggaggaguccuagguaggaaagcgcuuggcacauucacagggcuggaagaaggcaaggaaaaggccacggaggccacggccaguggaggguuuagcugccgcucauggugagccuuuaaggagcguuaagcacaguuucaugugcaguguuagaagccccauuggaagggcuguguggagaacagauugaagaggggcuggagugguaaugaggggucacuuaggaagcuggggcuguugaaugaaugguggcagagaagauggaagaagugcauggcuuugaaauguauguuggagauggaauagcuagaaauggucaugaauugagcuggggagaggcaaugggagucaaaaaugacuuccaggucccuggcuuugguaacgauacggauacuagcguguccggaauugguggguucuugggcucacugacuucaagaaugaagccgcggacccucgcggugaguguuacagcucuuaagguggcacgucuggagucugucccuucugauguucagauguguucggaguuucuuccuucugguggguucguggucucgcuggcucaggagugaagcugcagaccuucgcggugaguguuacagcucuuaagguagcgcgucuggaguuguucguuccucccggugggcucguggucuugcugggcucgggagugaagcugcagaucuucgcggugaguguuacagcucauaaaagcagcguggacccaaagagugagcaguagcaagauuuauugcaaagagugaaagaacaaagcuuccacagcguagaaagggaccccagcgaguugccaaugcuggcucgggcagccugcuuuuauucucuuaucuggccccacccacauccugcugauugguagagccgaauggccuguuuugucagggcgcugauuggugcguuuacaaucccugagcuagauacaaagguucuccacguccccaucagauuaguuagauacagaguuuccacacacagguucuccagggccccaccagagcagcuagauacagagugucaauuggugcauucacaaaccuugagcuaaacacagggugcugauugguguauuuacaaucccugagcuagacguaaagacucuccacguccucaccagagcagcuagauacagagugucgauuggugcacucacaaaccuugagcuaaacacagggugcugauugguguauuuacaauccacgagcuagauauaaagacucuccacguccccaccagacucaggagcccagcuggcuucaccuaguggaucccgcaccggggcugcagguggagcugccugccaguccugcgccaugcacuugcauuccucagcccuuggguggucgaugggacugggcgccguggagcaggggguggcgcucgucggggaggcucgggccgcacaggagcccauggagugggugggaggcucaggcauggugggcugcaggucccaagcccugccccgugggaaggcagccaaggcccggcgagaaaucgagcgcagugccggugggccagcacugcugggggacucaguacacccuccgcagccacuggccuggcugcuaagucccucauugcccggggccagcagggcuggcuggcugcuccgagugcggggcccaccaagcccacgcccacccggaacuccagcuggcccgcaagugccgcacacagccccgguuccugcucgugccucucccuccacaccucccugcaagccgagggagugggcuccggccuuggccagcccagaaagggguucccgcagugcaguggggggacugaagggcuccucaaaugccaccaaagugggagcccaggcaggggaggugccuagagcaagcgagggcucugaggauuuccagcaugcugucaccucucacuaguagugacuucaguagcuaauaaaugggggauagugaaggagcagauuuuaagagggaagaaucaagaauucuauuuugggaauaaguugagaaucuuguggcagcccagugggcaggggcagcagcaaggcugugagccuggggccaggagagcggucagggcugcauccucagguucguaaguugucuguacagccacugggcuguauguggugcagaugaggagggagcaagacugagcuccgagaagugcugacaucuagauggggaggaggaaugccuggcaaguggcgccgagaaagggcccagagagccacccgggaagcacucagccugugggagaaugugggcuguggaagccaggagggauggccucaggagggggacgcuggaaggggcccuauacaggccugcugcgggccuucccuuuccaggcagcguuuugucacucuugcuacuugcucauuuuaaagaggaggagggcaugggaaggaagaaagaagaguuuuuauuggagcuagcuacguggaguuugugggugaucuugaucucacaaauuucugugagcuuauauugggaggaaguuggauuggaaugguuuccguaaauagugagggaaggaaacaaaggcuuuugcuacacaguguggggucugugggucaggaacaugauuagagacuagguuaguggugccaaaucuugggcuccacuccagaccuacugaaucagaauaugcguuuucacaagauucccagguaaacuaugcauuaaaguuugagaagcauuagcacagauaauuccuauagaggaauugugucauuagcuagaaggauauaugggggucaaaggcacacacgcaugugugaaucuuuagggugaagauucaauagaacgugucuacaugcuguuggggaugauccuguagcaaaguaaagacugauugaugcugcaggaagaaggguagugguaggaauuaaguucuugggcaugguggugguggagggcuuggccuuugcuaagagcaggaauguguacuccaugaggcuggagacaaggagaagaagggcguggaagguuuguagauuuguugaaggagcucugagggaguuaggguuugauggcuugguguucucugggacaaaugagguuagguuaucugucaagaguaagcagagggagggcacaggggagagucacagcgagauuacuaggaagugugggggaaugcccauucgugguuugugaucauaagugcauugagaguggagugcugggaggcugcuuucuugaguuucuuucccucgacagcagcauuugcaugcugggugcaggugcugaaaacagugagugagauggaggggaagggagcagggagaugagguaucugcaagagggcuuuucucaugucaggcuuugggaucuaagcuggugaagggaggcagugcagcccagagggucuuguuaugcagagagagagugcuggaggccaaugcuugcaggugucaagagggcagagaauugugugugggggugguauuugaacaagugagcaagaaggauggaggcugaggcuagaggguuagaggagauaacuguuucuggugacggugaaguucagguaaugaccaugauaauguuagauagaaggaaagaaaggguuuucggagaagagaggaucaaggacuugagaggggccgagcuuggcugggacauccacaugcacagaugucauuggggaggacgacaggaguuggguagaauggaagucugcagaccagaagcagauguccucaauaaaugagggaagugaccaggaagucuguagcugauaguaacaaggugaaggacaggcuauuauggcuggaaaggccaggccucaaagguaugggggcuuuuguaagacggauggggcuaacagagguacugaagugcaggugacauuggggagggaggaaggacacauaucuggucugucuggcccugaagcacauggcaugggaggagaaauagcaucugcuugaugugguguccccagggcacacccaggucucagagcuagaagguagaggaacauucuuagaagagguggaggcucucgaaggguuugcuggugugccugagguugcagggaccagguggguuagccauuucaggagauggaugcaguucuguuggguugagagcccuagucauaggaaagaguggggacaccugcacuucugguggugacuguucaggacagauguucagcagugugcuccccuuaagaggagggugguccuguucuagcaccguaguucccaaacguggcuggggagguggcagcuuccuugugugauccucucagccuucacauacugacacagcagggaagagaaggcaagacuguuucuguuagagccguuucgggaguugcuggggagauuuaggacagggacauccugaaaugcccauugguuaugccucuaaggcaaauuacgcuguguuuugggugaugaagaaagaagggugugaagggcuucuguugaugaaaaucugccugugcuuguuuccagguggaguaugccuuugguacgcguuuuccacgugucccucuccacugcccugagacguaggcagggcagauauugucagugagugggagugacuugccuaauccucuagugagucaguggcugaaggaggacucaaagccaggccccuucauuccucaggacaagggggacugcgucugagcaaaaaguaucuugccuuaucucuuucuuauggacuggcagcuuuuccuacuuuaccauauauuuggcucugaggccaguuucuuucucaagacuuucuagaguauuagagugauauuuauuuauuuauuuugagguaaguucucacugucgcccaggcuggagugcagcggugagaucacagcucacuggagccuugaccucccugggcucagugguccucccaccucagccuccugaguagcugggacuacagacacaugccacuacacccagcuaauuuuuguagagauggguuuugccacguugcccaggcuggucuuaaacuccugggcucaagcgaucugcuucuuuggccucccaaaauguugggauuacaggcauaagccacugugcccaggcuagaaugauauuuaaaaagcagcuaagugcuuacugagaacuucuuuuaauagguauuccuucguuuaaucuucauaacaguccuaaggauauagcccuccuguauuucauuuuauuuuugagacgaagucucgcucugucacccaggcuggagugcaguggcgugaucuuggcucacugcagccucugccucccaggcucaagcaauccucccaccucagccuccaaacccagcuaauuuuuuguauuuuugguagagaugggguuucaccauguugcccaggauggucucgaacuccugagcucaagcauuccgcccgccucagccuccuaaagugcugggauuauaggcaugagccacugcgccuggccuguccuauauuuuauuuuauuauuuauuuauuuuuugauacagagucuugcucugucgcccaggcuggagugcaauggugcgaucucggcucacugcaaccucugccuccaggguucuagcgauucucccugccuaagccucccugggagcugggauuacagaugcacgccaccacgcccggcuaauuuuuguauuuuuaguagagaugggguuuuaccauguuggccagguugggcucgaacuccugaccucaggugauccaccugccucagccucccaaagugcugagauuacaagugugagccacugcgcuagccuauuuauuuauuuauuuauuugagauagagucucacucuguugcucaggcuggaguguaguggugugaucucggcucacugcaagcucugccuucuggguucaagcaauucucccugccucagccucuugaauagcuuggauuacaggcacccaccaucacacccagcuaauuuuuguguuuuuaguagagacgggguuucaccauguuggccaggcuggucuggaacuccugaccucaagugauccauccaccuccgccccucaaagugcugggauuacaggcgugagccaccacaccuggccuuguccuguauuuuguagaucagacugaggacaagaaauguuaacuaaagcuguuagcuucuuaauggcagaauucaagucaaggguuuguuuuccugucccacaacuguaguugguauauaacuacuuuuuaaaaauucugguaaaauguacauaagauaaaauucaacauuuuaccuauuuucagggguacaguucagugacauuaagcauguuuacuuuguugugcagccaucaccaccauccaucuccagaacuuccucaucccaaacugaaccucugcacccauuaaacacugacuccccacuccccucuucccccacccccuggcagccgccauucuauccugcuuucugucucccauugugauuguuuuggguaccucauaucaguggaaucauaguauuugugcuuuugugucuugcuuauuucacuuaguauaacgucuuuaagggugauccauguuauagcaugugucagcuuccuuccuuuguaaggcugaauauucuacauuuacaccacaucugauuuaucuguuuaucuauugauggacauuuggguuguuuccgccucuugguuauugugaauaaugcugaugugaacauggguguauaaauaucuguucaaguccuugcuuucaguucuuuuguauauacagccacgcaucacuuaaugacaccuauguucugagaaaugcuuuuaagcaaugucaguguuuugcaaacgucgggguauacuuacacaagccuagaugguguagcuuacuacucaccuagcccguacgguacagccuuuugcucaugggcugcaaaucugcacgucauguuacuguaccgaauaccgugggcaguuguaacacaauggggaaguauuuguguaaacauaucgaaacguaggaaaggcccaguaacaguacaguacuauaaucuuaugggaccaccguuguauuauguggucugucauugacugaaacuucuuuauuuggugcaugacuguauaacaacuauuuuuguuguauauuuucucucaggucuuuguuuuagagcuugugcucuguguugccugccuaugcauuuuucucccucuuuagugagcuuucugacccauagaucuguguccuugaaauaaguuucaacauuucacaucauacuugaagcucuuccccaccccacucuaauccacucauagagcacagaccauguaguggcucagaguauggacugcuagggcuccagucccagcccugccauccgcuaguuaagugacccuggacaaaucauacaaacucuguuugaguguaugcaauauacuagagaugcuauagaaguagaaguagaaguaguaguagaaucuguuuaagucucuaaauagguuuuauuugaauaaauaauucaggauagggacauguaugcuaauuccaaauuugccuucagcuguuaggaguccaguagcucuaaugucuccacggcugccucuucagguagcaggaacuucagagugaaucuguauaaauguguaaccaucuguaaggcuagcagaaucccagauuccauggguggguggaggaggacuuuauuucagaaauauauuaaaauaagcuuccaauuuccucccaccauuuauuguugcuuuauaguucaggaaaguuaucagauaaaugaauuaauguuucagagcuuacucgucugcacaguggcucaugccuguaaucccaacacuuugggaggcugaggcaggagagucacuugaggcuaggaguuugagaccagccuggacaacauagucucuacaaaauuuuuauuuuauuuuuugagauggagucuugcucugucgccugggcuggagugcaguggcgcgaucucggcucacugcaaccuccaccucccggguucaagcgauuauccugccucagccucccaaguagcugggacuacaggugugugccacuacgcccagcuaauuuuuauauuuuuaguagagacgcaguuucacuauguugguuggccaggauggucucaaucucuugaccucgugaucugcccaccuuggccucccaaagugcugggauuacaggcgugagccacugugcccugccaaaauuuuuuuuaaauuaggugggcgugguggugugugccuguagucccaguuacuugggaagcugaggugggaggguugcucgagucccaaagguugaggcuguagugagucaugaucacgccacuguacuccagucugggcgacagaaugagaccuugucuuaaaaaagaaaauaaauaaauaaaaagcuuaccaguuaccauuuauccuuuugaggccucacaacccagguggagaacaccagcucugguguuuuaucuaccaaauauugagcguccaccaaguaccaggcacacugggcacacaaagaugaaugggcuugaaguuuggugggacaaacagaccucaucuugggggaaaucacgacuuucccuaagugaaaugguagacaauauugacaggcaugggggcccccugagacugggaggaugggcuggccgggggauaucuaggaaggugaggaggaaauauugcagcugagucuuaaauuauaggugauccuccuccaucaggaggaagggcaguccuggcaguaggaauagcaugugcacagagguacagaccagaagcagccuccugcuuacaggaagggacuccaaagccuucuaguuuuuguuuuaguuaacuucauuuguuuuuguuaauuuaguuuuucuuuuuuuggagggggcgcgugggaagggacagguaaagagguauccauuagggaauagaaauaucuaaaacaaauuuccuuaggcauacaggagggcuaauuagaguuguuuugcauaucuaaugucagaaaaaagucaaaaauugaaagauaauuuagaucacuuaauucaacuuucugguuuuuauagacauggaaaguugagucauaacgcguaugagcauaugaacauuuuccauucccuggugcuaauuagaauagcagcuacacaagggaaggggaacuugaccaaggaggucgcuugacucaggccagggucuggguaugagaucgggagggcugggccuaucauguccgaagcagggucagggagccaggcaaaugagugaggcagguggaaguaagacugcagcaggcuuacgcuggcuuucacauaguguaugucccuuccagaagcggcagcugcuccacagcaccagcugagugggacuuaggaaugucagacuucuugauuuuuuuaagcgaugccaaaaauuuggacuuuuaugugaaaucguucuuuaaaaaauguaaguaacuaaaugaauauauauauauauuuuuuuccagauggagucucgcugaguuugccagguuggagugcaguggcgugaucuggggucacugcaacuucugccuccuggguucaagcgauucuccugccucagccucccaaguagcugggauuacaggcacgagccaccaugcccagcuaauuuuuguauuuuuaguagagacgggguuucaccaugugggccgggauggucuugagcuccugaccucgugaucugcccgccuuagccucccaaagugcugggauuacaggcaugagccacugcaccuggccuaaaugaauuuuuaaaagcacuauaugagcaaacaaagcaugucugcaggccaccaaauuuuacaaauuggcaucucugcuuuugccacauggugaaagcugguccacagcaaggaagagagacagagccagcauguggcgagaaucacagggauggucuggcagcuuucagggcccuguguccaguugcuccugagucccagcccuauccucggccuccuuccuguagcauaguuuuucguuucgagucagugacauacauuaguagucugcuaguaaaucccccuuugugguauaaauuaauuuaccuuacguuuguuuuuaguggaaauuuucaaacauauacgaagguauagagaauaguacauaaugcgcuaccuugucaccaucagucaaugaauggcuaauccgaccagaugccauggcuuacaccuguaaucccagcuacucuggaguugggggcagagggcccaggacgggagugugugugggggguguugcuugagcccaagauguugagacuguagugagccaugaucguaccacugcacugcagccuaggugacagagcaagaaccuauccuaaaauaaauaauuaagauccacucaguguucagauuuccucaauuuacuuuguucaaauuaggcaaaauaaggaguauguguuuaaaaaacuuuuuuuaaagcggaagaagaggccgaggcaaguuucagagcaggagugaaaguuuaucagaaugcuuuagaacaggaaggaaaggaaagaaaagaaggaaaguccaacuucauuguugccaguauuaacucuguauccuacaauaauucuuuguuuauauauaaacaaacaauuuuuuuaaacaaaugacauuguauuauauguuuucugcacguuucugauagaauuuggaucauugccauuuuguaccuccuccuaaauggauacaucuggacauuguuccuggucaguacauauagcacuucuccauucuuuucaauagcuggauaaucuaaaauuugguuguaauuugguuuguuccuuccguggguucaucgucuugcugacuuacagaaugaaccugcagaccuuuguggugaguguuacagcucuuaaacguggugugucuggaguuuguucccaagauguauccggaguuuguuccuuccgguggguucauggucucacugacuucaagaaugaagccgcaaaccuucgcagugaguguuauagcucucaaagguggcacaggcugaaagagugaacagcaguaagauuuauugugaagagugaaagaacaaagcuuccacagcguggaaggugaccugagcagguugcugcugcuggcugggguggccaguuuuuauucccuuauuuggccacacccauguccugcugauugguccauuuuacagagugcugauugguccauuuuagagagcacugauuggugcauuuuacagugugcugauuggcacauuuuacaaaccucuagccagccacagagcgcugauuggugcguuuuacaauccuagcuacagaggacugauuggugcauuuuacaauccucuuguaagacagaaaaguucuccaagucuccacucgacccaggaaguccagcuggcuucaccucucacuaucauaauuuaugcaagaauuccccauugauggaaauuuuaaagauuauuauagcauucuuuuuagugacaaaaaauuauucuuguaauuauauccuuauacuuuuguagaauaaauuccuggaagagguuuacauucauauaauucuuuuaguaguugcuuauuuuuucccaaaaggcuguggcaguuaauaauaucaguaguauucauuuccccaaacucuugaugaacccaaucuaauguuuuauuuacauuuccuugacuacuagagaaauuggguuuagcuucauauguuuguuaucugugcccacuuuucugugaaguacuucuucauuuuuugcccguuuaaaaaaacuagguuguuugacuuacugcuuugcaggggcuuuuuauauauuagggauauuacuuuguuuuguguugcaaauauuuucuccuuaucuguuugucuuucaguucuucuuauaauucuccuuugcuuuucaaauuauuuucccguuuuuuagcuguugaauuaaacauuucuuaccauauuuugauucccugcauuuuuccauuacugcuuccuguugggaacgcuuguuugaaaaaaauaacaggaaguugaauuuuaacuauacuguugaguuugagcuuuuguaaagucaaaagacaaaauuaucacaaauguaguuuaaagaucuuaacuggcuuuauuugcaguucugguaucgggcagcaugugauuccauaagauuguguucgagugagcugaggagaggaggcuggcuuuguggaaagaaaagggcugaaaaaugcagaaacauagaacccaaaauaggucguuucaaaguuacuuucuuuguaaggccggaacagggagacacaacaauggaaaauaacugguuaaaaucgguuaguuuuuguuguaaggauuaaaacaaaggaaaggucauuucugugauuguaggaaaaugugaauuuucugacucaggugugcccuccaccuugaccagucuccccuugguguucucccgaagcagagcccuuccuucucccuuguuuauuuaauauucauuauaguuauggauuucuggauuccuaauuuuucaggggucuguuuucaauacuguucuuguuuuugucccuacauugucccagcuuuaggauugccagacucaaauauuaugauuauggccuacuaggugaccuucaguucauacugucuggaggagugcugaaugcaguuauuggcagguguguaauguuugacuguuugcugugugcuucuguugccguaauacucaggacacagaauuuuaggagggggacugagagauuagguuuccccuagguuuucagauucucauuugugauuuucaugacaacccuaugauacugcaagguggcauuuggacacgacuuaccaacgcauuuccucuuugcucaagcuuaauaaaagacugacuauauuggccuaugggacuaacgcuaguagaaaccaccucuuccuccuaacauguaugguuuuauguacuaugauuugcuuucaaaauacauuuuacuucucaagugaauauauguucugguauuugguuuuaugcuaagugguagagagcccuaucuaauauuaguguuucauauaacauuacauagaaaaaccauuucccagugcucuugccccacuuucccgacaagucaucuaaguggacauccuuaguuuggagugucuuguuauucuguauccuuguugauucagugccuuacaagcuaagaugggcuggaggacccgccuagcaaugacucccuguuuucucuagaaucaaaguuucuuaagauggcacuuuaggcccauuuauagacagagcuaucuuuggagacucauuacccaggcacuuccccaucccauaccuuaugcuucaauauuaugugacuccugaacccacugugauguuucaugccuuuguugcuuugcacaugcuguguguuaagcuggaauauguucucacucccaucugcugaauggacuauuauuaaccuuuggagccucccugauucccuuuuccuggaguucauuaugcuuuccauuauaucuuguaccaucuuuaucuuugcaugugagaaauuacauuaaaaugcuuuauuuauagaagucuuucauugggaagacugaauuuucuaaggggagaaacccaaaacuuggcacaaaguagagcccaaauguuuuuugaacaaacuucagucaaacaacagagcuuuugggugaguagauagaaacauguugaagggugccaucuuaacucaggcugccauaacaaaauaccauagacuggguggcuuaaacaacaggaauuuauuuucccacaguucugaggcuggaagucugagacagggcaccagcaugguuggguucuggugagggcucccuuccugccuuauaagaagaggaagagauaccugagcugccuucucaguguguccucacaugguggaaagagcccaggucucucuuccuucucuuauaagugcacccauugaauaggaucagggcccuacccuuaugaucuuaugguuugcaagugguccccgccccacagauguaguucugaaauuguuagugaauucagugggggaagucuaauugcuuuggggaaaaugaaugucugugcuucauguuagggacaaaguauacggauaccugcaauuuacacugaaauauaucggaaaaugaggugcacugauggguagagagagggacgacagaugaauggauuugugauaaagcaaauggagcaaaauguugauuguaaaguccaggcagugaguguauggauucacaggaugguuguuucaacuuuucuuaguguuugaaacuuuuugggauaaaauguuggggaagauaccuguauuuuuuuaagaacacauuuauuggcuaggcauuuccauuauagguauuaaaucauuaacgugagcuuccuaaacuuaacugauuuuuuuuuccuuccugcucuuucuccuccugucuuuaucuagucaguuccuucagcucuuaguucaugcgaugucccuccaggaaauuuccccugaccuuccagccugauacagauaugucuuucuguguucccagggcaccacuugcauacuucugccauagaauuuauuaucuuguacuguaaucauuuacuuacuaaucugucugaaccacuagucuuugaguuuuuugagggcaaagacuguguucuggaauguuuuugguacaagaaaaaacaaacacaacaguggacucuuuguggcuuaaacaguuagaaguuucuuaucucuaauacccugugucaucgcccguugggucuuccugcccacugcacagacaaaaccaauucacugagaccaugguauugcaguaaagagaguucaguggacucgaggcuggccacaugggagaacuggaauuaucagucaaaucagucucccuaaaggcucagaguuuagaguuuuucaaggauguuuugguaggcaggggguuagggaaugggugcugcugguugguuggggaugcaacuauagggguguagaaaauggugcuugugcccuugaguucaccucuggaugguggcgaggaaccacaggacugguugagucauaaguccauguggggucagucugaaaaacaucucaaaagaccaaucuuagguucugcaauacugauguuaucuauaggagcaacugggguaguccacaucuugugaccucugaccacaugacuccugagcaguaagggauuauaggaaggaggccuauauuuuagcagaacucaggccccucccauaauucuaaucuccuggccuuuuacuaguuuuauaaaggccguuucagucccugaacaaggaaaggaucaauuuuagggagggacuauuauuauccuuguuaaacuagaaauuccucucaggguugguguggccuaugcccaggaauaagagaagacgccgaccuguaagaccagaggcaagauggagucagcacguucagcuucuuucacugucagaaucuuugcaaaggcaguuucacccaaagucuggagguugcuguuucuaggauugguucagugaggggcauguggucagcaccucuaccuucccuguucuuucccuuaauuaugccaaguugacugaagcagugauacaggcuggaaauauccaccaugguuauuucaguuuuugaacuuuaagcacagauauuuugggaaguaucgggguguguugaauaguuuucaauucauuuauuauuucuucuagagaaauugacuuguuuuugaaaacagcaguucagaauuagauaacuacacguguuugcaaggaucccccccaaccuggaaaaauauccuuuucagacagccauaauaauucauagaaccaggauugauucagagaaauugugugacagguugauggucuggagguuccaaccucauucacaaaccucagcucuguaggaaacaguguggaccagaaaugaggccagaaguaguuucaccuuccuaaacucaagccuuuuggggaggucugccucuuauuccauuuauucuauuuuagccacauuucagaugugcuuacuuaucuaguuacuugcuuagcucacuuauuuaaaaaaaaaaaguacguaauuugcaaagggggaguggaaagaacgccugguguaggcaggcggucaagaguaggggggagaagagcaaaugugaucuggacuccuggcagccaaggccuuucacaaacugaugagugcccugaggucgucaagagaaagcuugguuauguucagucugugcuguuucagaagacagagaaaucuaauacaugaaaaguaacuugcaacacuacauaaauaauggccucaaacagguuuuaaauauaggaagguauagauaaaauucugguauacacaguuaauagugaguaucucugggugguaggaucauaggugcuuuuuauguguauucuguaaauuugcuaugagcaucguuacuuuuaaaauacuuaaaaaguauuuuaagcauucagaaugguucuuuuucaacuccaucaggucuuucaaugaugucauuuuuuucacauuuugccuuugucuuuguuaaaauugaucaacuaauacuuuuuauaauauuugccugaagaguccugcuuguuacugccauugacucucaugaauugcgauuugcuuguguuuugugagcuggaauuuuaggcuuuagcugugagacucccgaacacucauugccccuuguucccccagagagguuucguuuagcauugccugggccuccagcacuaugagcagccugggaccacuuuucauguuacuuuauuggcuuuagaggaguguuguggguauagguuuucaggggagaauucccuacagccagagcccagacaagcuuccuugucauuuuccucuguuggcgcacagauggugugcuccuucaagggucuugacuucucaguucccaauugaaaaggugucucaauucuaacugcuaccuuguguguaugucuggucucccagccaugugaaugugugugugugcaugcgcacacaugcacauguacguuaaauccuaaauuaccaagaacagcaaccauccagaacugcaggaacugccgcucuuacugcucugauucucuccuguuuggggauccuuacuuucuuuugagcucagcugugcauuuaagagcaauucuaagccuuggcugcucaugaggaucaccugggaaucuuuuagaauuucccaugcccagguugcaucucagaccaauuauuucagaaucuagggugggacccagguguaaggauguuucugaagcucccugcaugauucuguuguauagcuaagaaugggaaccacugauuuaagaugauguuguuuuauuucgcccagugauguguguguguguuguguguguuuauuuuucuaguggggauguuuucaggcuaucucgucagcaguaagggaaauaggaguccaccauguuguaguuagaaugaacacucucguaaaguggccucguugucuggagugacauccagaguucuuggucucauggccaaggaaaucaaggaugcagacacaccaagggugagguuuagagcagaaauugaauaggagaaagaaagagaacgguucucugccacagagaguaguccuggaaaaaggguugccauccugcagugaaaugcagggguuuuuacagaugugcuaguggggaggcaguaucugaucuacauaggguguggaaaaccaguuaggaccaagugugccaucugcauaaggcaugacucucuggcagcacccaccacagucuuuuauuaugcaggcgaguccucagccugagcuacucuauguugcuuauuucuuuccuauugcacaugugcuaaaaaugggggagguggaaccaccaugguggaccugccuggccccagguagcccuucuauuggugcagccgcuggcaugcagcugugcaagccuccggcuuccuuaucuauguuuguaaccugaucuuccaggcugcucuuuuuuagaaaauaauugauuucuugggcuguguuuuguuagaagggaaguucuggccaggugcaguggcucacaccuguagucccagcauuuugggaggcugagcaggggguggaucacuugagaucaggaguuugagaccagccuggccaacauggugaaaccccaucucuacuaaaaauacaaaaauuaacuaggcaggguggugcgugccuguauucccagcuacucaggaggcugaggcaggagaaucacuugaauccaggaggcagagguugcagugagccgagaucguuccauugcacuccagccugggugacacagugagacucugucucaaaaaaaagaaaaaaaaaaaaggaggaaguucugccgaggacucuuugcccucacuaucugccuaaauggucucuuucuaccuccuguaucacucuuacaauuagaugggauggaaaacaacauugguucauuccuacugggugcugggucugugccuugguguuuuccauguauauccuauuuaguccucagaacauuccugcaagguagguggugguugguuuuaugcacauaagaaaacuggcuuggagacauugaacuaguucuagggucacgcagcucacaaauggcagaaccacacucaugccugccagaugcccaagcccugcccuuuauucuuguguuuugguauaugugaaauagauuuuuccauacaaauugguuaaaauaaagauuggcacuuggguuacgguagauuccaggucccuguuaaauauacuuacuugggaugcuuuguugucccauaauacuggaguugcucuacucauuuuaucuuccuucugauuagggcaaauugauuuugagauuucuccuuuuaacucucaugucaugaagggguauuuguucuugaacucacuucuuuaaucaaccagagggauguguggggcuguguaagagugugagagcauaugugugugugagaaaguguaugagagcauaagagugcaugggagcaugugcgagagcguguguguucugugaacguguuacagcaugugagauuguguguggugugagcaugugaacaugugugugagagcaugugugugguggcgugaacauguaugugugagagcaugugaacacgcaugugcauguuagagccucugagccugugauaugagcauguguuagagcauguauguggugugagcaugaacauguaugugugguaugagcaugugaacguuagagcguaugugaguguguaguugugugugugugugaaagcgugagugcaccuaugagaggacaagugugugauaguguauggaguguguguugugagagcaugugagcuugugaguguacaugagcacaaauuugaaaguguugugagagcguugugaacguguuaugagugaaaguguguaugugggugugugugauagugcgugugugauagugugugagcuugugugugaaugugagcauguaugacagcgugugcuagcaugugugagccugugauagugugugagagcgugugagagcaagugugugaauauguguguuugaaugugagaacaugagcaugugugaaugugagaacaugagugugaaaaugagugugagcgugugugugaaugugaguuaaugugagcgugugugagcgagugugaaugugugaaugugagugaaugugugugaauaagagcaugugugaaugugugugcgagugugugagcaugugugaaugugaaugugagagcgugagugugugugaaugugagcgugugugagugugagcaugugugugaaugugggcaugugugaguguguuagugaccguuugugagugugaaugugagagcgugugugagcguguugugagugugugcguguugugggguagaggguaagagggcaaagcgaggaguaaagcuaaagagcuggggauugaggucccaagcuguucuccgcggcagccgagaaccgagcagagagguaggaaacuggagcuacgagcgguuuggucucugccucagugaggcccugcugagggucugaugauuuuuggugacuggguguccucuccacccugcccagugaggcgggcguggggugugcgcuccuguuucuccccucuagccuuggcuucgccccagcugugcugggguaagugacuuccagaguuguuggagggcucgcaugucugcccugagccugaaaggauuacuuuccuguuggaaugucuggguuaguuaggcuuuaauggaggaugugaaugacauuugguuuuagcuagguugaaagcaaaucgccucuaagucuuugucuuugucaucagcagcucuucagugggucaucugugugucacagccucagaagaccagcgagauggcugccaacaagaguaagggccagagcuccuuggcccuccacaaggugaucaugguuggcagcggaggcguuggcaagucagcccugacgcuucaguucauguaugacgagguaagcccugcuaggcacagaccaccuuccuuuggcauuggccguagcagugucccugcucccgcuguuucugugccgguccucccguacacagggguucacggagcaagucuguguugagguggcuucugaauagcuuccuaggaaggucuaaucagcauaagaucuggauugcugauucuagguaaauaauuucaacuccggcggggaugugagagaucucugcuugcaucguuuccauuguuauacuucgagcuuucuuucugacaaaagcccaggggaggagagaggagccuuuguacagauuuuccaaacaacacaagcauuuagccuugugauugucagucaaucgcgaagugaaagagagugaaaggggagcugagcugucauacaacuuaauccuuucgcaagugauagacaucagauccaguucucccgugcggcaagguaaagcuugcacuauccuugcccaaaauuuacgucaccuacuuaauguggauaacaucacugguguugaguucagugugacaacacagccuugauccccggagcuacaaaagucccugcuugagcuguuugcuaggauacuuagccuacugugggcucuacaucugcagauucaagcaauguagaaugaaacguugcggaaugaaaauauucgggaaaaaaacccaaugaaaaauaacaaugcaaugauaaaaacaauacaaauuaaaacaugcaauguaacaacuguuugcguagccuuuacauuguauuauguauuauaaguaaucuagagaugauuuaaaguguacgggaggauguuacauguaaaugcugugccauuuuaaguaaaggacuugagcaucugcagauuuugguauuuggugggggucauggaaccauuucucuagggauaccgagggaugacuguaguacaggcagggagaguguuccgagcagagcuuaaaccucagggccucucacuugcauugcggccacauggcuuuaugagauuugcgaaagaaagcuaucacaaccacgucaguuaagaucacuaccucuuuucacuagacuuucccauuguccugcuuccucuuaugcugggugcagcuggaguggccaugggcauuuucggccucuagcugagggaguuuguguugggcuggguuaggugggaauagugguauguguuggugugguuuggagucacgcggcauguggcgauuaucgcuggcugcaggaguacuccaaccgcccacugugcugacgugcgaacaucgugaugugaggugcagggccagggguggauccugaugcgaaccuguccuguggcaccugacacaagugugugagagcuagaagcuagaaacugggccagaaaagucuuucagaucuuacagcuuguacagugaagcucaauagagguuuccuaaauuuggcaguaaucccaaaacuuucauuacuagaaaugccauguagucacaugcacauguauguuuauugcagcacuauuuacaauagcaaagacauggaaccaacccaaaugcccaucaaagauagacuggauaaagaaaauguggcacauauacaccauggaauacuaugcagccauaaaaaagaaugaguucauguccuuugcagggacaucgaugaagcuggaaaccaucacucucagcaaacacaggaacagaaaaccagacaccacauauucucacucauaagugggaguugaacaaugagaacgcauggacacagggaggggaacaucacaugcuggggccuuuuggggggcggggggcaaggggagggagagcauuaggacaaauaccuaaugcauguggggcuuaaaaccuagaugaugggucgauaggugcagcaaaccaccauggcacauguauaccuacauaaccugcauguucugcacauguaucccagaacuuaaaguaaaaagaaaaaaaaaaaaacucauguaguugugaagcugaaagaaccucuucuaagcugucagaacaaaagacauuuucauuaaccaugcuaaaggaaagacuaaauuauuuuuuauucucuauaggaauguuucaaaaucauuggcauaugacaagaaaaaguauacagcaaacaaaaaaguagaagguauucuagagguaugucaggcaguuuaauuaauaaaaauauuguuauuuugcuggauuuugugaugucagugcuguuuguauuaguuuuuuuuauuacuguauaauaaucacaaaguuagcagguuaaaacaacauacauuugucauuccauaguuuccauggguccagaauuggagccucagcugaguccucugcucagagucccacaagacuccacucaaggugucagcuggggcugugaccucuucugaggcguggggguccucuuccaggcucccuaauuguugguagaauuuaguuccuuguggguguaggacacaggugcucggauucuacaaguugcccgcaggccccugccaugugccgucuccauaggcagcucauaccacaguggcuugcuucuccaaggccggcaggacagucuccagccagccuagacggucuuauaaaaugaaauggaaacauggggguauucccuucgccucacugagagucacccgggggugagaucgcuggaguacucaucuuuaaaacuuuauaauggauuaugauuucucauucaaugucaacauuuacuuuaauguccaguauuacguguguaauuuuguaucuuaaggaagggcccccauaaugaauaagcuucaaacccaaaccugguuauccuccugggucaugcuccccaugucuuauaaugagacacuuuuguguuugguaccugcuuuucuuuaucuuauucuggggggucaaacuggauaaaucuaauguaaucugcugaauuuccccaaaacguuuuugcauaagagaagcagguugggagaucugcaucugcuuuguaggucuuuuguuuguuuuugcucaaaaacuuauaauuugcuuacgaaagcuuuuuucuccccuauaacagagguuggggaagagaggggguggugaguaggggaauuaggauuagggagauaggauuagggaaguaguuguuaacagaggugagagagggggauuuugcuuccccagggaauauucguaagugccuggagacauuuuuggccaucacagcuugggggaagaugcuaccagcaucuagugcguggaggccaaggacgcacucagcauccuacaucacacaggacagccccgaacaaaguauuagccagcacaaaauauccacaaugccacuguugagaaaccugcauuagaggcagagccguggcagauccaaggagagaagauuccccuacaguguuagugauugagaggcccuggguugccaguuccaagagcaaguucagauacagagcuggggccgggcgcgguggcucacgccuguaaucucagcacuuugggaggccgaggcgggcagaucaccugaggucaggaguucaagaccagccugaccaacauggagaaaacccaucucuacuaaaauuacaaaauuagccuggugugguggugcauaccuguaaucccagcuacuugggaggcugaggcaggagaaucgcuugaaccugggagauggagguugcagugagccaagaucgcaccauugcauuccagccuggggaacaagagcgaaacuccaucucaaaaaaaaaaagauaacagagcuagcacugcugaggagacuaggagagccuggucuggagguuucuggguguguguguguuggggaggggggcggggguggguaagaggagggggcagaugcaugcagaagauucgagaguuuuuucucuucuuucuguucucuucacagagaccagggaaagcugugccuggccuuagucuguuuuucucaugggcuaacauacuugagaacuggaaaguggcaguuauugaagaaauuguaaaauaaaauuggggcaaggaaggaauagaaaugaagugauguauguuugggggaggaguucuaaucgauuuucuaaaacggugcuaauagaaacuuccaugaugaugaaaauguucuguaucuauacuguccaauacaaguggcuauugugcauuugaaauguggcugguggcuacuauauuggacagaaugguucuagaaucauaauuuuuuagcucgaagagaccuuagcaguaauugucaaaccuagcugauuauagaauuuccugggagacuuuaaaaaaaaaaaacaccuccugaauaauauugguggaguuggagaacugggacucuuucaguggugcucuucuggugguucugccgcguggccagguguggcagcuccugccugagagaucaucuagucaggaaauugagcucuguguucagggaggccggcugucuaaaucaagcuuguccaaccuguggcucaggaugacuuugaauguggcccaacacagauuuguagacuuucuuaaaacauucagagauucuuuuugcaauauauuuuuuuagcucaucagguaucguuaguguuaguguauuuuaugcguggcccaagacaguuuuuccgauguggcccagggaagccgaaagauuggacaccccuggucuaaagucuccugcaccauucagacucuuuguucauagugcaugcuuaacccuuauuuaaaauuguuuagcuuaugugauggaauuuucaugaagauuagauuauggaaggagccauagucccagagucuuuauucuugucuaaguucugacuuugagaaaaauuggagggagcugccaggguggcagcagucagauuuuaagcuccuuaugcucggccuaacauacucguuuuugccuuuuuugggagaguaagguuggggauggagaggcuuuggcagcaaccguuucagacuuucagucucuggcagcuuagaggaaagucagcuuagaaagaaaggguccacgugaaguuugucuuagacucuugggcaucugaaacugagccaugcagagcucugcaaggccaguaggggauacguaugguucacgcuaauggauacaaagacuuugugauuuucuguuuccagcugagcaauguaaauaaacaucaggguuguaauggaauguugggguaaucagcauacuuuucauugaguacagagguauguagguacagcaggacauucugacuucugugucaaaggagccaguggaacucuggcuggcuuuauccuuggaagcucagaaauauacaguugagauaauuuaugguagaauucagagauuuucaggggacagucguguguuggauuuuuuuggcguguauuuuucuuuuuggaaaggaguuaaaagaaggacacuugaaagcacaggcaaguuuucacaucucuauuuggagauaauuuauuaguacacguugaagagaaccuaauacuaaacaugucuuaauauuuuuauuuuugaguagcuguuaacugacaauacaaggcucuuuuuaacagucuuccucaaauaaccuuuaauucacuuggacauuuucaauuccauuuuuaaguuaaaaaaauuuuaaaucacagccuuauuaagauguaaugcacauaugaaauucgcucuuuuuaaaguguacaauuuuuuuuuuuugagauguaguuuuucucuuguugccuaggcuggagugcaauggcacgaucuugguucacugcaagcgccacuucccagguucaagugauucuccugccucagccuccugaguagcugggauuacaggugugcaccaccauaccuggcuaaucuuuuguauuuuuaguagagauggguuuucaccauguuagccaggcuggucucgaacuccugaccucaggugaucugccugccccggccuaaaguguacaauuuaauagguuuuuuuuguauauucauacagaugugcaaccaucaccauuaucuaauuuuagaucacuuucaucacuccaaaaaaaaccaaccuacguauuaguagucauuccccguuauugcuuccccgucccaccccuggccucuggcaacugcuuucugcuucuauggauuugccuauucuggacauuucauauagauggaaucauacaauauguggccuuuaugucuaacuucuuucacucagcaucauguuuugaaaguuguuccauguugcagcgugcguugguacuacuucauuccuuucucaaaaacccacaccacugaaagccucuugguacacuguguuaguucauucucuugaugcugugaagaaauacccaagacuggguaguuuauaaagaaaagagguguauagccucuuuucuuccacagggcuggggaggccucaggaaacuuacaaucauggcagaagggggagcaaacauguccuucacaaggcgccaggaagaagugcagagcgaaguggggaaaagccccuuaugaaaccaucagguccugugagaacgaacucacuaucacaagaacagcauagggguaccgcccccaugaucucauugucucccauaaggucacuuccccaacacauugggaugauaauucggauuacaaccuaaaugaugagauuuggguggggaugcagaaccagaccauaucauacaucuugccaaauuacuuuucagaugaauuuuauacuuccguuaugaauaagaacuccaguuuuuugauauaccuaauguuaaaugacgaguuaaugggugcagcacaccaacaugacacguguauacauguguaacaaaccugcacauugugcauauguacccuaaaacuuaaaguauaauuaaaaaagaauuccaguuucucacccuugcagguguuugcauuaaaauuuuauacugacaauaauauugccaaguguucugcucugugccugguuuccucaucuguaaauugggauaucugccuguauuguuuaaaaacaaaaaauggcaaaacagagcuauaaagaacagaaguguuacguaaaauguugcuucuguaguguccuguucauagugugaagugcccauauguggaauuuuguuuuuuggcagauuuuguuccccuuaagacuuuguuaauuaccgauaauguuuauuuccucaguuuguagaagacuaugaaccuaccaaagcugacaguuauagaaagaaagugguucuugauggggaagaaguucagauagauauucuggacaccgcugggcaagaggacuacgcagccauucgagauaacuacuuucggaguggggaaggguuucuucuuguguucucaaucacagaacaugaauccuuuacagcaacugccgaauucagguaugucugaaaugaaauagcagaagcccccaggaagcuuuuugccuuuucucauaugucuuaggccuaugaagaauuuggggcugagcauacuaggagagggcugagcuuguucucaggaauaauucugucuaaagaaucuucuggggcuuucugaaucuuggcacauuauagacuaugaugauuauaaucucuuugggcuuuccugaucugugauuucugaauaaaauaauuuuaagagucuuacuguccccgaaaacaaugaagcuauuccauauaaucaagaacauauaauuuuguuccuauaaauacucagagauuuucauugauaaauuaaccaucuauccuuuaaauaauguuacuaaaaaaaguagcagguuuagucuguguugaagguuaugaaacaaugacuggaaagugaaagaugggagucaaaaugaccauuugcugcuacuuaaggacuuucagcacaguggagggacgagaacgcggcuuuagagucaggagaccugguuugaaucccugccuugccgcucacugaccaugggcaaguuuacuuagugucaggauuuuguuucuuucucuggaaaugcacuugugaguugagaaaugaaaugaaaggauguauuagacugugaauuucaugugggcaagaaccuggcuacccuccauuguccccugucacaguguagacacauggugcuuccauagugaguagaauauccauuguuauuuauuuuaaaauauggcaacuauucuccaugaagguguuagagaagaaagaaaaagaaaauauagcagugaaaaaaauaccuucaguucauuuuguuauaaagaaauagccuuuugggcauaauucuuaugcucuauaaaugucucuuuaccccaugcccuucccuuucuccuacauaauugaguuuuaaaaaaucuguucuucuuauaaacauaucuaucuagaugacuuuuuaagaagcagaucuagaguuuaguagggaacugaagagaaaaaacccaaaaaucaaaucaguuuuuuucauucuucagcaaguucuggucugacaguaagguggucaaccagaggugaaaaggagaaagcuagcuauccuuccaggacuuggauggaagcaucacugagccagggaggccucgggugagcacaggucacccagcagggcuagugaaagauaauagggaggugccucagugaugcuucauagcuccaggcuucagagucgaagaccuacuuuucuggaagcagagugcguguggugcagugacuaguuaagugacuaugacucauuaugagaaguucuguuaauuuuuagacauuucagaccuuccuaagggcugcucuguuugaauguagcccauguauuuauaauuguuugcaucugcguaguccuguuuuuaaugccucauagaggguaaaacaggacagaugcacacacucucuucuuuucuucccugucccgagccuuuugauuuccuguuguucugugacuuacuuagaagggaagugggcaggagaguucucugcagaggauauggagaaauacagguauuucaagugcuccuuguccucuccucagucaccacacaugcacagauagcacucgggcguucucacagaguuggagcagggcuccccucaauguggaaaaggguuuugguuguuagguggaaagagagauccuuagaagaaaaaggacagaugaauaccuaaaaccagaaagaaggggaaguugaccucugcguagguuucucauguuguugggaacagaagaaugcaggucaauuaucugagcccuguggcuaaacucaagucacuuuacuucaugucuguuagcaguuuuaaaacagcauuuguguacuaucuuccaaauagaaaggccccaauauaaaaugacaugugaauaugcugucuuccuugaaacuuuuucuggaaaauauuuuaugaacuaagauaaguucugucauaagagaccagaacuugguacucccauuuuuggaucgauauguuuaucaaugagguaauuuugugugccccugcaagacuaaugagccagaaagcuaucaguuuuuauuguucauaguuuauaaugaucacaugacuucaaauguaucauguucuuugaccccaguucaaauguaggcuauaacaaggcuacacaaagccaauuucaagcaucuuuucaucuuuuuuaguuugucuuaaaauauuugaugucuggcacuuaaauugacuacaugaaaauuuuaguuuuuuuuuuuguuuuuuuuuuuguagauacaaggucucccuauguugcccaggcuggucuugaacuccugggcucaaguguuccucccuccucaggcucccagagugcuggcauuacagaugugagccaccacgccuagaaaauauuuuuauuauugugaaauguuacccuauaccauauaaaaaucaauacagaucucuacaaaauacauuuuugaaggggacucuuuuuagaauguauuggcauauaaaaguagaaauauucucaugggaccaaaauaauggaaaugggguauuuaauuuuuuuaaauauuuaguuuugauuaguacuuucagauagcugauaauuuuuaguagacguaaaauuuaauaugcuacgaguaaugguauuuuuguagaagacacuuuugaaguacuuuuccauagggcuugucguauuuccuuucauuuuuuucacuuuguaguagaaaaaugguacguauuggaaugugauuacugccuaacauaucugucucgauucuguggccuauaacauuacugugucugcauggaaacuggggaugggaugacauacuugucguguacacaugcagaucuaaucaaaacugaaguuucaaaacaauacaauauucaccuuuccuacuugagauucccuuggauauuucugaucuggucaguucuguucuauaaucuauuucacugcaggggggagaaacugcugguugcgacccacuagauugguuuugugauccacuaauaggcugccaccuuccauauagaaaacacuggauuucauagcuuuuaugucacaaacaaauauuuucaggggaauuaagcauuuuauggagauaguucccuuagcuuguuuuuauugcagagauugaccauuuuucuucuuuuuguuuuuuuuuuugugugugcauaaguuggggacccuguugugacguaaaauccugggcuccuauccagacacuucuguaagacugagcccagaaaucugcauuugugaugagcaucccaggggauucugaugugggcaaacugagaagcagacuuggaaaacacuugucuugcucaugacugccucuagggagugcuuucucagaacaugcccuaaaucuagugauuuuuuuuuuuccuucugccuuaggaaagccuuuuauuuuagauggguucacaaaaccaggguucguucuuuaguuuuuuuagcugcuguauuuuugguguaacaccuuagggaacagauucuccgugugaaggcugaagaagauaaaauuccacugcucgucgugggaaacaagucugaccuagaggagcggaggcaggugccuguggaggaggccaggaguaaagccgaagaguggggcgugcaguacguggagacgucagcgaagacccgggccaacguggacaagguaggcgugaauucuguguauuucucagaaacagaccugagaaacagcagaauggaggcaucucaucugcuggguuuuagggaaccauuuaugaaaacuaggugaagauucugauuccuaugaaugucuaagccauuaucaugauuauaaugagaaacauugagaggaugucaccuuguauuucagacaacucacagaaccuuuuacuuugucaugaggcuucauuagaguaugcuuaauguguucuuuuggguuuuucuuuuuugagacaaagucucacugugacaccaggcuggaguggugugaucucaguucacugcaaccucugccuccugggcucaagcaauccuccuaccucagccucccaaguagcugggacuacaggugugcaccaccacacuggcuguuuuuuguggagaugggguuucaccauguugcccaggguggucucaaauuccugggcucaagugaucugccugccucagccucccaaagugcugggauuacaggugugagccaccacacccggcggacuaugcuuacuguuggugugguccugggaaggauggugggacgaggccauugguuugugaaggcugggcuggagggauggacgucauuagcuucugugugugcucucaccuuccacagccuugcucuucaggagcagggugggcgggccuggcugcuucuaggagguuccccuggaggugcccuugaaagauacguggagcuucuugauuuugcucucauugaguuauuggucagauuuguucuuuucaccuuacuguucacugacagagccacaguguuccaucuuuguaguguagucucuaaauaguauuugcucucagaacucaaaucucugggaucucuuuuuuuuuuuuaucucuuaucccaucccagcauacuuucucauucaaaucucugaagcuaauaaaagggugaccuugagugacaaugaugaaugcugacaauuugaaaauccaccuaucagggauugcuauuguuaggccuuuuuucuuuuuaaaauuaaaguucaaggugguugccacacagcuaaaauuuuaacgcugugccuuaaagaugaggcuuucugccuugaccucauucacuagcucucacugcauauccaugugcuuguagaaucuaagcacauagcacuuuggcagccacacaguggacacgucugcuuuuuguucugcagcaucagcaucugaauccccuauauccugucuucuguuucucuuucuugugcagaaacauuccccuuugcuuucauuaccugacaagggagagauuuuuauccaagcuuuauuuucacuugaagugaugcuagaagaacauugguauuuagaauguugguauuagaagggguuugcuuuagacgcacuucggcaagauacaucuauuuguauguaucguacauaaaaacauguaucuuaggagacauauacauauaggauagauauacauauaggauacauauauuguacaaccuaaguccguuuaguuguaaucugcaaugggaagcgcguguuccgccgucagcuuuucuuuauauugucaucucucaacucuuacacucuuauauuauugugcuacuuaaaauauuuuuauuaaauuauuuuccagcuguggaaaccacacaggaaauccagaaauauggcucauuuuaaaaaaaucagggagacucucucagcuuggaacuguggauguguauuuccuggauggguugucgcguggggggucuguguugucaucuccccuugucugcuggaccagcuugaccugccaaacaggaaccagcagagacuuaugacuggcagcaugguauucacuuguaaagaauuucuaugaaaggugugauaagaucagcccaugaacaacuuugucaucauuuuaaguuggaugcacuccauuccccuccucuugucuuuugcuguuaggacaaaaagacaaaccuguagcauuugaaacuguucacuguugcugucuugggcagugcuuuccugagaggcuggcaagaagggauguuuggguuggccugaucuagcugggggcugggguugggggugcuuuucugugccuggagcuagugguaaaugcauguggagccccacacuccagaggcuugaucuugcuuuucaccaagaagaagguguggccaugaaggagcuugugguuuugugugaaugucugaagauaagggcugugcucagucccacacuugcagucucugucauucucuaugagaaaucucaaaugucucuucguaggauucauauuuugucugcuuggguauaaucaguccucuggcaugauggcugguagcagagggcaaaacccaaacuacugugacaaaaggauaauccauaucuaaguaacacacugaccuucaaaggacaagucucaucaguucuugauaaaguuccucucagcugacaucacaagggucggaggagugguuguccugagauugagggugggggaguguguguggggagggauaggguggccagaaggacaucucucauccuccaucuucucagucgccuagugcaggagcuuuaguuguugaugcuuuacgcccuccuucucccauccuacugccuccccaggguggcuguuguggaguuagcugggaaagcugucaugcauaaugauguuccaaccuccaugggguccuuguaaggauuaaaucagaugcaggggugucaagagcaccugggagcagggacucauuauggcauucuucccuucccuggugguuggaaaugcuagaaagucugcuugcuguuauuacucucaauauuuguaaauuuuauaaauguauagaucuguuauaugcaaaaauaugucuuacccuucaucacacuuauuguaagauuuuaucauuuugaaagcagcuguuaggccgggugcaguggcugacgccuguaauccgagcacuuggaaggcugaggugggcauugcuugagcucaggaguucaagacccgccugggcaauauggggagacccugucugaauuuaaaaaaaaaaaaagcugcugcugcauggcagugacaguacgaugauucuguccuuggcuugagcaguugugugauacgagcaguuguaugagagauguuugcuuuguauaauuagaauuuuuuaagguuaauuuuucuuauuugccccagagcuauuguuucuguugacauaugguuuauaaaaaucaguuugacuuugugcuuuaaaauguaacuacauauccugcuuagucaaauuauuucauugaauccuuaaaugcuguguucacagugucagguuaacaaaagaaaaaaaucauuaaauggcucuuucuucacuauucuuuuuacucuuuacuccucacccccagguguucuuugaccuaaugagagaaaucagaacaaagaagaugucagaaaacaaagacaagaauggcaagaaaagcagcaagaacaagaaaaguuuuaaagaaagauguugcuuacuaugagugucaaggugacggaugaagccagcugcuccuaaggacacagggcuggguugguaaagagaaggcuaugguugacuucuugcuugugcuucccacucuccccgacuucauucacucaaacuucuuuaaauggggaaaaauauuugugacucuguggcuggcagaagaaauaagcccaugcaaguggaagggcugcuuugucaggagguuguggaauuucuuucuucuccccuucuucccucccaaaagcuuagcuauguauaaagugccacagauaggaaacagcuguuaauuacaaagagaaagaauugucauagcaucuuauuuuguuccuaguuuuauaacauuaccauccuucguuuugaacuacagauguuguaguggguuuuggaggagggaguggaguaagaugcccucccacuuuuaucaguuuaguaguaguacugagaaaaaucccuucagcucuaagaacacugaaaaauccaccgauuuuuuggguaagcuucuuggcaauacccuguggaucugaaacagcuaaaaaaaugaauuugaauugcgccagauaggucaauaccaagcuucugauuccuccucacauaugaaaagugaaaguugugaguuguuuuccucuuauuuaaacauuggccuauuauaaucuguguugguuauuuuucuccuguaagcauccugauuuuucuguaggaacuuuucuuuggcagaccaagugaagacucaggaauggugugcauuauaaaugacacacauugccacuuguguagauauuuuuaaguucuuuggcuaaguccucuccuaacugccuguccucugguuaggccccucccucuccacuaguggugaaugcaugugucugucugaucagcaucacugcacacggaggucuagugagccucuugcuaagugucacacacacucuucccaaagacgugaugaguuaaaguuguauucugaaaucaugaagccagagccugugccagaccuucugcuaccucucauagaauugcucuguaauucuaaauuuaaaauuagaaguagagagagauaagccaucgccccuuugccucugagaauuggcugcuguuucuaauauaauuauuuucuaagauagccagauaguuagaaaaagauuuucauugaugacauaucuuuaaacuuucuugcaucaguauucuaaauugagcaaacugaaagauuuucaucaggaaaggagcacugugggaagagcccaguauucacauuuuuuccccauuuuucagaagcgacauuucauauauaggugccaaaagugaaucggggugcggagagugggaaccuuuugaauuuaugauugucacagagaugguagaaauuaugaucugacuggaaaacaauccuguauccccucccaaagaaucaugggcuuuuuuuuugaauaaaaaagcagacaaauaga

SEQ ID NO: 191139 - RNA, 166094 nt, Homo sapiens
gggcggagcugggagggagcuuuaagggguggacgggcgggaggucgggguccuccggggauuagagccggugggcucguugugggcgccauuucucggcgucuaccgaggagccgccccuuucucagccuugcucggcucuuccccgcucuggucgccggggcugcgccguccccagcucagguaagcgcgaggcccggcggcggcgccgcaguacaguccgcugcgcuccuagccgaguggacccuuccucgcccgcgccugcgguagcggccuuguccccggggaggcgggcgggggccgcacccagacccuagggcggccggccccucucucgucgggccggcagggcauuaaucccgccggagggaggggcggcggcggccaaugaggcagggccgccgaguuucggucgauaccgcgcgacgggccggggcggagggcccggggcagccggguuaauguuugccgagcggacgcgcuccccgagccgcggguaccccucgcugguccgcugggcugccguccagcgggagagacaaaagucgcaagggaaggggaaaaacgaacugaguuugugucacugucuugguggacuuuucgagcuaaccuguauuugagaaaaacuucagucucuugggaaaggagaggcagguguguucccaugaaagacgaggucugaaggucccgccccgcccccacccgggacgguugucgugcuaaugauggguucuuugguguguaaauguuaauugugucugugguuacucgaauucuaccuaagagcgagacccaacucuuaaaacguuuggcaauauuuuagacuaauauuaaaaguuuuuaaagaauuacggggaaaauucccauaaccguguacauuuguaauguaacccacaacugcauuaacucaguuucuaacauaacccguugcugagcucuaguuaaccuuguuggauuauuugugcauguaauaugcugugcaggcuuuagaaaauagguuaacauuauucgaaaacgauaugcguaacugcuguugaauuacucgcuugcauuuucuuuauugggaauacugggacaaaauauaguguuaccuuaaauggcauuugcuguauguuauauugcuuuaucaaaaagcaauuaaccaaccauauuguggccaccagucauguaagaguauacauauuucaugacuaacuuuuggguuuuggguacuuuuuuuaaccaacuucugauaggauugcuuaaauuugcauuuuaugauucuaaaggaaauccuucuaguuaggaacuagaguagaaacuacuguuuuuuggaagccacauaaaccuaccauccaaaaauuccacugugucauucuagugugucaggcgagaugcggguuaagccagcuguugggccaaaguagugaacaagccagacgaagucuuuguccuugugugugagugggggaaguagucaguaaaaaagauaauaauuaacagauauuuaauuacaauuucuuuguuauaaagaaaaggcuaagaguacugaaagagaugucgaauuuagacucacaagucugagauugcuuuucugagaauaagacauuucaacuauaagucugaaguuaguccagugaaaugggagcggguggaagagaggucaacuggaaaaagagcaauccagaaagguggaacagcuaaugaaaaaugguccagaauuaaaaagacucuccggccgagcagcaagaguacaagagcagagcaaacagaggggaguaggcugacagaugggucaggcaaguaggaggagcugcaucuaggaccagggccauuaaagauuuuagaacagggaucagauuugugguugccaaaaauccaguggcugcaacaugaagagcgcaauuggaagagugcaggugggaggggaaaagugaguaugagaaaacuuuuuucacaaucauuaaaaaaaaaaaaaacccacaacuuuuagugauccauucauauuauuuuuuuuuuccauuaaaaaaaauuaggccaggcgcaguggcucacgccuguaaucccagcacuuugggaggccgaggcgggcggaucacgaggucaggagauggagacuauccuggcuaacacggugaaaccccgccucuacuaaaaaaaauaacaaaaaauuagccggucguagcggcgggcaccuguagucccagcuacuugggaggcugaggcagaagaauggcguaaacccgggaggcagaucuugcagugagcccagaucgcgccacugcacuucagccugggcaacagagcgagacucaaaaaaaaaaaaaaaauuagguggggucuugcuguguugcccaggcaggucuugaacuccuggcuuccaacaguuccgccuuagccucccaaagugcugggauuacagacaugagccacuguacccagccauauauucuuguugugacuucugacaugccccucuucagagagaaucucaacaguuuacgugugugucuguuuagcgugucugugugugugcauguaucccaucuccguguaggaugaaacucucuucaguguucugugauuugauuuuucacuuagaaauuuugucauaucuaagucaacuauuuauuuaaaacaacuguauuauggcugggcuuggugccucaugcguguaaucccagcacuuugggaggcugaggugggaggaauccgauucccugaggccaggaguuugagacaaaccuggcuaaguagcaagacccugucucuacaaaaaaucauugaaaaaacguuagcccggugggaugguaugugcccguagcccuaggugggagaaucccuugagcaugguagaugaaggccgcagugagcccugggugcuagagugagacugucucuaaaaaaaaaaaaaaaaaaacauaaaaauaaaacaacuguauuguaugcuguuguguguaccauaacuuguuuaacuguuugcacauugaugaacacauuuaaaauuuucuuaaaucaguuaugcuccgaaaaauccuguuccuacaacuuaaagcacaugugugauuuuuuuucuuuagguuauccuuccagaaauagaacuguugaguaaggaauaugcauguuaaaauuucuaguauugguccggcgagguggcuuacgccuguaauccuagcacuuugggaggccgaggcgggcggaucaccugaggucagaaguuugagaccagccuggccaacauggugaaacccaguaucuacuaaaagcacaaaaauuagcugggcgugguggcugguaccuguaaucccugcuacucaggaggccaaggcaagagaaucucuugaacccggcagguggagguugcagugagccgagaucgcgccauugcacugcaaccugggggacuagguugagacugucucaaaaaaaaaaagaauuaaaaaaauauuaauagcauggucaagucucccuccaaaaaaggccaacguaggaggauuauuuuuucucacauucuuuuuuacacuaucuugagucuuuaaaugacagacaauaucuuauuuuuuuucauuuggauuuucuuggauacuguuaaagguguucguuuuuaugaacaucuuuuaaauuaucuuuuaggacuuuuucguaucuugcucuuuguucuuuuuuugauguagagucucagucucacucagguuggagugcacuggugggauaucauaaaauguuucuugggagauauugguggaguuaaaaggaauauguagggauucugugacacaggauuuuagaaaucugggauaacaaguacagucuuaggcagcugaaaugagacuggauagcaaguuccaaagggagaaauaccuggaaaaaaaaaucuggagaaagagacugggaccagguauuauauaugaguguuuggaacacuggaaaguuaucuaacuaaaauuuuaguuauuuccuugggauuaguuuaccuaauuacgcaagaguauacauguguaaaauguguaggcuaaucuucaguguauagacauuuuaauaugguacuaucuuaaaaaucggauuuuaucggguuuauaaauaaaucuaguugaaaaagucauuuuaucugaaggcuucucuugaaaaacagcauucuccugaauucuuuugcucccucuccugaggcaaucauuuucacauuuuaaaucaaaugcucuuacugcuaauuguugauuuuuaaauucuaguaaugaccuguuggcuugcuguuacgcaucaugaggaauuagcucuuuccauaucuguauccccuaccucuuauuauguaccuccugucuguugugguuauuguucgaucaguauuuaguauuugacauugaaaucauuagcagcugagucauguaguguauugugauuuacuuuuccuuuucugcacagcuucuuguuuucuuuggaauuaauagucuuuuuggcuuauuuguuggcuuauguguacuuaaacucucuuuguugugcaaaugaaacacaugaggauagcaaagugacuuugauuuuguguuuccauuuagugugcuauguuuuaaaaccuguuuuaacuguuuugauuaacauuaauguucuuuauagaguuaaggaaaaaagcauuaaaguacuuugacauuaaaaagauuuauguuaaguaguuauuuaaaaucuguauguaauagaauauuugacaaaacuuaggaaauuugaauuauaucuguauuuuagcugaaauaggugauuguuuuuguguuuuuauuaugaaugcucagaaaagaaauggaacuucucaggauuuuuuuugagacagaaucucccucugccacccgggcuggagugcagugaggcaucucagcucacugcaagcuccgccucccggguucacgccauucuccugccucagccuccccaguagccgggacuacaggcacccgccaccacacccggccaauuuuuuuuuuuuuuuugagacggagucuugcucugucgcccaggcuggaguaccguggcgccaucucggcucacugcaagcuccaccucccggguucaugccauucuccugccucagccucccgguagcugggacuacaggcgccugcuaccacgcccggcuaauuuuuuuuuguauuuuuuuuuaguagagacgggguuucaccauguuagccaggauggucucgaucuccugaccucgugauccaccugccuuggccucccaaagugcuagaauuacagccgugagccaccgcgcccggccacuucucagaauuuuuaugaucaucaaaggauaccuuagugucugacaucaucuugggauauacaagauguuguacauauaauuuaucuauuuagaagaccugaugaacuucaugaauguuugccuucuccugccaaaucaguuccugauaaaaugguccgguaaauuuagaaagcuccaaacuguggcugugucuuauacauacaagucuuuuaaaacuuugaauuaaaguaaccagcuuuuuaaauuaauuaauuuacuuuuuaauugacaaaaauuguguauauuuaucauuuauaauaugucuugaaauauuuaugaaaagccaguuuuaaugauuuuuuuuuucaaauuuacuugaccaggagcccuuuuuguuuuuuauuuacuuauuuuuugagacagggucuugcucuguugccugagcuggaaugcaguggcgcaaucccagcucacugccgcuuugacugccuggggucaagugauccuucugccucacagccccucaaguagcugggaccacaggcaugcaccaccacaccuggcuaauuuuauuuuuaguagugauuaguucucacuauguugcccaggcuggucuugaacuccugggcucuagcaguccuucugccuaggccucccgaaguguugagauugcaggcgugagucacugcacccagcccagguguccuuuuuaguagcauuucuacuaauguucacaggacuugacuaaauaaugccauuugacugacugcaaguuguggagaaucucauuuuuuuccugaugccaucuuuuucucucuguuuuuauagugacaaaaaugcugaguuucuuccguagaacacuagggcgucggucuaugcguaaacaugcagagaaggaacgacuccgagaagcacaacgcgccgccacacauauuccugcagcuggagauucuaaguccaucaucacgugucgggugucccuucuggaugguacugauguuaguguggacuugccaguaaguaggucuugcugagcuccaaauucuguuugcgauuacugucuuuguuuguuuguuuaaaagcuuuguauugguaacuucuggauggaaauaaguaaagguauuauggguuaguauagaucaggcacuguaacauucagguacauggaucagauaaccguagaccaaaaguacuuggauuggugguauuucucuuuggaauuaguggcgauuaccugaaacauuuaaaugacagggcaguuauuggcaugagucuguuucaugugucuuucuauguguucuuugugauggcagcacaugauguagucuaguggauuucugacaauccuuguugaaccauuauuaaaacguugugaaucuuugagaauaacaacacuuaaauguguacuguaagacuuuuagcuucuaugcacuucuguauuuuuuaaaacucuccuuacuuucuucuaaauaaauauuuccccacaauuugguuuacuugcagacauuaaugaggugaagugagaaaaaggacuuucuucauaccccucagcucugacugccugucucuuugcuccugaaguauuuugcauuguagguuuuucauacacuguagucuuuaucucaagacaggcuguuguaauuauauuugcauuuuggauagauuuuuuuuuuuucagaaauauauaaucauaacucagugugaaacaaucugacauguuugaaagggguuagcuuauuuuuuuacaggacuuuuuggguggaggaggggaagaaaagguuggcuuuuugguuuugggcaguugaauauuuuucugaguugcuugcuaauaccaaaucucuuucucaugucuuuguucugcauucaaagacuuaacgguaaauuacaucauuugaugugagcuucauaggauauuccuuaaugucuuuucuccccacagacuuuuuaguacacacucaucuacccaaaauucaauuuaaaaagucucuuugggcaaagugauagccuacgugcugcuguaauacauaauugaauaagcucgggaagaccuuaaacucaccaagugagaguauaaggaauuggagaguuuguuuaaauggauguucugauuaacuuaauaauuuggaauguauuagauauguacauuauacauuuuaaaauauuagaauaugauaaaauuaaucaaagacucaggauuucuugaaguguuuugaagucaucauuacguguauuuguuaucuuugucuauaagaauguauauuuuuaggguuuuugauucuggacaacuugaaagcaucuaaauuuucuuccuguaagugcuucuugaggguuuaucagacauuccaacaugagauauuuugugaggauaguuuucauacucauuucuuauuugauaggaaucuuaagaguuuuguuuacuauuucauuaaaauaucauuggauauguggugaaaagccugagauugcuguguaagagacuggaaagaaauuucuuauuaccuaauguuugaaguaugaaguuucaggguuguugauggacaagcugauaguaggagaguagaauuuguaaaaaaaaaaaaaagagguuuuuaaaaacgcagugcaguauggaggagaaacaacacuagcuuuuaaagugguggaacaaauggcuaguuacugaucuggaaugguuuccuaaacuuuguaugcuuagcuggguguaugugaugcuugaucaaauuuauaaacuagcuggucucucauggggacaauuguagugaaacagcuggagauauagauuggacuuuuugugaaacaagaacaguugucagccaggugcaguggcuuaugccuguaaucccagcacuuugggaggcugaggcagacagaacccuuaggccaggaguucgagaccagccuggccaacauggugaaacccaucuguacuaaaaauacaaaaauuaaccgggcgugguggcaugcgccuguagucccagcuacucaggaggcugaggcaggagaaucacuugaaccugggagguggagauugcagugagcugagaucgcgccacugcacuccagucugggugacagcaagacuccgucucaaaaaaaaagaaaaaggaacaauugggccaggugcaguggcucacgccgguaaucgcagcacuuugggaggccgaggugggcggaucacaaggucaggaguuugagaccagucuggccaacauagugaaaccccgucucuacuaaaaauacaaaauagcugggugugguggcggacgccuguaaucccagcuacuugggaggcugaggcaggagaaucgcuugaacccaggaggcagagguugcagcgagcugaauucgcaccacugcacuccagcccgggugacagugcgagacuccaucucaaaaaaaaggaacaacugucuuuccaauucuguaggugaaaucguacuuauuaaccuaacucuagguacgugcauggauauaaaguggucauuggccuguuuuacuaaauugucacuaaaggaaaaaauaguccagaagaauaauaauuucuaaaaaagaagaaaugauuuccccuuuucagauuuauuuucucaaccagucuacugugauucugggagaagauuuagaauugauuuuagaaauugaaugaagcacauacucauuucccauuacgauaagggucuaggauaagggucacuagugauuauaguuagccgucuucuuccuuuaaagaaaaaaaauuaaauagggugagaaggccuuucagugaaugacaaagguaucagguagaaauuucuaucuaauuuuuaaguuuuuucuuugaaaauacgacaguaaacuuguuuaagagcuuaguauugguaaauagcuuuaauguaaaacccuuauaaguuuuaaauugggaaauguuuggucaauuaaccaauagauaacaauuuuuuuuccuuuuuuuaaauuguacuuuaaguucugggauacaugugcagaacgugcagguuuauuacauagguauacacgugccaucgugguuugcuguacacaucaacccgucaucuacauuagguauuucuccuaauacuaucccuccccuaaccccccaccccccgacaggcccuggugugugauguucuccucccugugucuguguguucucauuguucagcucccacuuaugagugagaacaugugguguuugguuuucuguuccuguguuaguuugcugagaaugaugguuuccagcuucaucugugucccugcaaaggacgugaacucauccuuuuuauggcugcauaguauuccaugggguauaugugccacauuuucuuuauccagucuaucauugaugggcauuuggguugguuccaagucuuugcuauugugaauagugcugcaguaaucauacaugugcaugugucuuuacaguaagaugauuuauaauucuuuggguauauacccaguaauggaauugcugagucaggugauauuucugguucuagauccuugaggaauugccacacugucuuccacaaugguugaacuaauuuacacucccacuaacaguguaaaagcauuccuauuucuccacauccucuccagcaccuguuguuuccugacuuuauugauggccauucuaacuggcaugagaugguaucucauugugauuuugauuugcauuucucuaauggccagugaugaugagcuuuuuuucauauguuuguugacugcauaaaugucuuuuuuugagaaguguccauucauauccuucacccacuuuuugaugggguuguuuguuuuuuucuuguaaauuuguuuaaguuccuuguagauucuggauauuagcccuuugucagauagauagauugcaaaaacuuucucccauucuguaguuugccagaugauaguuucuuuugcugggcaaaauaaaaagaagcucuuuaguuuaauuagaucccauuugucaauuuuggcuuuuguggccauugcuuuuggugauauagucaugaagucuuugcccaugccuauguccuaaaugguauugccuagguuuuuuucuaggguuuuuaugguuuuagguuuuauguuuaagucuuuaauccaucuugaguuaauuuuuguguaagauguuaaggaagggguccaguuucaguuuucugcauauggcuagccaguuuucccaauaccauuuauuaaauagggaaucguuuccccauuccuuguuuuugucagguuugucaaagaucaggugguuguagaugugugguguuauuucugaggccucuguucuuuuccauugguccguaugucuguuuugguaccaguaccaugcuguuuugguuacuauagccuuauaguauaguuugaagucagguagugugaugccucaagcuuuguucuuuugcuuaggauugucuuggcuauacgggcucuuuuucgguuccauaugaaauuuaaaguaguuuuuucuaauucugugaagaaagucagugguagcuugauggggauagcauugaauguauaaauuacugugggcaguauggccauuuucaugauauugauucuuccuacccaugagcauggaauguuuuccauuuguuuguguccucucuuauuuuguugagcaaugguuuguaguucuccuugaagagguccuucacaucucuugugaguuguauuccuaggcauuuuauucucuuuguagcaguugugaaugggaguucacucaugauuuggcuguuugucuauuauuuguguauaggaaagcuugugauuuuugcacauugauuuuguauccugagacuuuguugaaguuguuuaucagcuuaaggagacuuugggcugagacagugggguuuucuagauauacaaucaugucaucugcaaacagaggcaauuugacuuccucucuucccaucugaauacgcuuuauuucuuucucuugcuugauugcccuggccagaacuuccaauacuauguugaauaggaguggugagagagggcauccuugucuugugccaguuuucaaagggaaugcuuccaguuuuugcccauucaguaugauauuggcuguggguuugucauaaaaagcucuuaaauuauuuuaagauacguuccaucaauaccuaguuuauugaguguuuuuagcaugaagacuuguugaauuuuaucaaaggucuuuucugcaucuauugagauaaucaugugguuuuuuguguguguguuuguuuauuuuuuugagaugaaaucucacucuguugcccaggcuggagugcaguggcgugaucucagcucacugcaagcucugccucccagguucaugccauucugcugccucagccucccgaguagcugggacuacaggugccugccaccacacccggcuaauucuguuuuuguauuuuaguagagaugggguuucaccguguuacccaggauggucucggucuccugaccucaugauccgcccacuucggccucccaaagugcuggaauuacaggcgugagccaccacgcccggccaauccugugguuuuugucauugguucuguuuaggugauggauuacguuuauugauuugugcauguugaaccagccuugcaucccagguaugaggccgacuugaucaugguggaugagcuuuuugaugugccgcuggauucgguucgccaguauuuuauugaggauuuucgcaucgauguucaucagggauauuagccugaaauuuucuuuuuuuguuuuaucucugccaaguuuugguaucaggaugaugcuggccucauaaaaugaguuagaguccuuuucuguuauuuggaauagcuucagaaggaaugguaccgcuccucuuuguaccucugguagaauucggcugugaauccaucugguccugagcuuuuuuugauugguagccuauuaauugcugccucuauaucagaacuucuuguuggucuauucagggauuugacuucuuccugguuuagucuugggaggguguauguguccaggaauuuauccauuucuucuagauuuuguaguugauuugcauagagguguucauaguauucucugaugguaguuuguauuucugugggaucaguggugauauccucuuuauuauuuuucauugugucuauuugauuuuuuuuucuugcuuuccauuugcuugguaaauguuccuccaucccuuuauuuugagccuaugugugucuuugcaggugagauggugcuccugaauacagcacaccaauuggucuugacucuuuauccaauuugccagucugugucuuguaauuggggcauuuagcccauuuacauuuaagguuaauagauaacaauuuuuauauaccuacuuucuuguacagaugcuaaaggcuuuaaauuauguaagacuguauauaguuauacuuuuaaauacaugaacaccaucccauguucaugaauuugaagacuuaagguugguaggauggcaguacaccucaaauugauugaugcauucagugcaguccccaugagaauuccagcugaccuauaguuguagaaauuuacaagcugauucuaaaauucuuaagauauuguaaggaacucuuaauagcuagaacaauauugaaaaauaauaacuaagaggacacacacuuccaauucuaagacuuacuacaaagcaacaauaaguuggugugcgacuggcacaaggauagacacauaggucuguggaacagaauagagaacccagaaacaaacccaugcggucaugggucagaugauuuuugacaaagaugccaagauguuaaaaagaauagucuuuuuaacaaacgguacuuggggaagugggauugccauaugcaaaagaaugaaauugggcucucacacuguaugcaaaaauuaacucagaauaaagaccuaaaaguaugagcuaaaacuauaaauccuuagaaaaaaauaggcauaauuuuuggaauuuuuuauugauauaucguagucguacauauuuuggggguacauagugcuauuuugaugcauguauauaauguguaaaugaucaaaucaugguacaugagauauccaucaccucaaacauuuaggaguaaaucuuuagaucuuagauuuggcaccacuuucuguuuuuuuguuuguuuguuuguuuguuuguuuuugauacggagucucacucuauugcucaggcuggagugcaaugacgugaucucagcuuacugcgaucucugccuccuggcuucaagccagucuccugccucagccuccggaguagcugggauuacaggcgccugccacacaccuggcuaauuuuuuguauuuuuaguagagacgggauuucaccauguuugccaggcuagucuugaacuccugaccucaauuguuccgccugccuuggacucccaaauuguugggauuacaggcgugagccacugcgcccggccuggcaccacuuucuuacauaugauauaaaaagcaugagcaacuaaagaaaaaguaaauaaauuggacuucaucaaaaugaaaaauuuuucauuuagccuucaaaggagaccaucaaauaaguuacaagacugucacacagaauaagagaaaguauuugcaaauuauauaucugauaaggaacuuguaucuaggcuauauaaagaacacccaauuuaaaaaugggcaaaggaucucuauagacauuucuccaaauagguuauauaaaugaccagcaagcacaugaaaagaagcucaacaucauaagucaucacagaaaugcaaaauaaaaccacagugagauacagcuucacaccaacuaagaaggcugaaauaaagucagauaauauuaaguguugguaaggauauggacaaaucagaacucucagacccugcugguaggaauguaaaauggcgcagcugcuuuggauaauaguggggcaguuauucauauaguaccaccugacccaacaguuacauuucuagguauaucuccaagagaauggaaaacauauugcacaaaagcuuguaacggauguucauaucagcauuauucauaauaguuaaaaaguagaaauaaccuggaugcucaucaauagguaaauggauaaauaaaaccuguaauauccauauaaugggauguuauuuagccauaaaggaaaugaagcguacugcuaaaacguagaugaauuuugagaacauuauucuguuaaaagaaggcagucacaaaagaccaugugauuucauucaugugaaauuccagaagagggagaucuguaagggaaagaaaauagauugugcuugcuuagggcagccugagugagugggaacugacagggugguagggguugacaacuauaauauauggacuuucuuuuuuuuagggauggugucuugcuacguuguccaggcuggauuugaacucuuaggcucaagugaugcaccacucaccucagccucccaaguagcugggacuacaggcacaugccacggugccuggcuuaggguuucuuuuugaggugaugaaaauguucuaaaauugauuuuugugaugguugcauauaucugugaauauacuaaaauccauugaacuguuuauuuugaaugggugaagguaugugacuuacagcucagugaagcuauuuuuuuaaauuucuuuaaauuuuuuaauuuuuuuggagauggaguuucacucuuguuaggcuggagugcaguggugcgaucucggcucacugcaaccuccaccuccuggguucaagcgauucuacugccucagucuuccgagucacugggauuacaggcgcccaccaccacacccagcuaauuuuuguuauuuuuaguagagaaaggguuucaccauauuggccaggcuggucuugaacuccugcccucaggugauccacccgccucggccucccaaagugcugggauuacaggcgugagccaccgcgcccggccggaaguuauuuuuuuuuuuaaaaagaaugcauugauuuuuguguauuuguauuuuauuccacucaagauuuuuuaguaguaagaaacaugacugggcauagugguucaugccuguaaucccagcacuuuugagaggccagggugggaggauagcuugaguccaggaguuugacuagucugggcaacacauggguaccccguuucaaaagaaaauaaaagaaauuagccaggugucaugguggacacuuguggccccaacuauucagaaggcuggaggugagaggauugcuugagcccaggagguagaggcugcaguggacuaugaucaucccacugcacucccgugugggcaacagagaaaaaaacaacaaaagaaagauacauagguuuaauuuagaggugauaugcuugauuuguuacagaagaaaaaaucaugccuggagacugcuacgguaauacagauacaagaugaugaggcugcagacuuacagugacagugaggcugcauaggaaagagugccugcuuaguacauggauaugguuggcgggaggggagugaggacuagugcuuacuacuuggauauagcguggggagggaauaaagaugaguaaaauacaguucuaacucugaugggaggggcgcauaucaauuaugucaaagaucaugagaagauagucugcugucaugaagagagaaaaaggauggaagugaagcaaagaguuuuggugggaugguguguuugaaagccagauuuuagagggcuaaaggaauuauuggagacggucauauuuuuuggaccucuuacagucccuugcacauaguaggugcuuaauauugauuaguuuguggaagugccugaagggaaaacgcaggauugcuaugagauuuggcaauagauggaaggaaggagauagcacggcaguuggagaauggcugguuagggcagaucugaguuucuuuaagugaauaggaaaaauguuccucaguaauugcgguuuuuguuguuguuguuguuucugagauggagucucacucuguugcucagguuggagugcagugacaugaucuuggcucacugcaacaucugccuccccaguucaagcaguucuccugccucagccucucaaguagcugggauuacagguggcccaccacuaugcccagcuaauuuuuguauuuuuaguagagauuuuuaguauuguauauacaauauacaaauuuuguauuucguauauuggucaggcuggcuucgagcuccugaccugaagugauucaccugccucaaccucccaaagugcugggauuauagguaauugguuuuauauacauagguagagaugggaggaagaacauucuaggagaaauaccuucugcugagaaagacggaaagcugaugaaaagauaaugcugaaacagccuauaauacaccuguuguuguuuuugaguuuuuauuuuucuucucuuuaggcuaaauccuaaauuuuuuguggacuguaaguccccaaacuaaugcuuucagaucuuuacuuuuaaaacuggaaguuguacuccuuaaccuaaaacucauuauuuaucuuauaguacacuguccauuuaaaugcuauacuaaaacuauagauaaaaauacuaccgccuuugucaugcaggccuuggaaucccagcccugccugcaugcauacacucagcugcaaagcgguuccacuccucucaccuuagggucagcuccuauucccacgaugcccgucagcaggaagaagccagaguuauugacggcuuuuuccagucuucguagcccacaccuugagaauaaggugcuaugaaacacaaagggagggauugaaaccgccuuggcaaaauuaugacugaggaaaugaugacagugaaagaaaucagaccuaauuaaguccaucuugcuucuaacguuuaagcuguccuuguucauuccugggcguaggccuaacuaacuucgggaaggaauucaguucaugguuuggcuaugaaacaagauugguaauaaccauuucccgaaaagacccccuucuugccuggggcccagccuggcuuugcaggacuaacaaauuagcuacaagaugagaaauuacaguuuaggggucaugcagccucuggcuccaagagucugaacuuccccaaauugcuccugaggauaacaucacuacuguaaaaccuaagauccgugcuugagauauuuugcagacccugcacuggauggaucagcugagaucacccagaucgguaaucuggcucaaccaguucugccaucccaucugggaacaagacagcaagaaaaacucacuuugaccccuaugauuccaucuucaaccugaccagucagcauuccccucuucccaagccccuaccugccaaauuaucuuuauuuuauuuuauugaggcggagucuggcucuguugcccaggcugaagugcagugguacaaucuuggcucacuacaacucccgccucccggguucaagugauucuccugccucagccucccgaguagcuaggauuacaggcacaugccacuaugcccggcuaauuuuuguguuuuuuacuagagaugaggucucaccauauuggccaggcuggucucaaacucuugaccucaggugaucugccugccucagccucccagagugcuggaauuacaggugugagccuccgugccuggccucaaauuauguuuauuuuauuaauuaauuaauuuauuuagagacagaguuucgcugucauugcccaggcuggagugcaguggugugaucuuggcucacugcagccucugccucccggguucaagugauucuccugccucagccuccugaguagcugggauuacaggcguccgccaccacacccagcuaauuuuuaguagagacaggguuucacuauguuggucaggcuggucucaaacuccugaccucaggugauccacccgccucggccucccaaagugcugggauuaaaggcaugagccaccacgcccagccccagccuccaauuaucaguaaaagcucugauccccuaaugcucaggcugauuugaguaauaauaaaacuccagucucccacacaaccagcuccgcuugaauuacucuuucuccauugcaauuccccugucuugauaaauugguucugucuaggcagugggcaaggugaacccauugggugguaacaauaccuugaugaacuuaaucauugcaaagaggaggugaagugagggcuggaucugaaagagguggugaccugaaauaaauuuguuagguggggauaaagaacaugaguagcagguacugguguagauacagaugacuaaugaauuuguagugggccagagcuuugugggucuguuuucacuuuccuguuuccaguuuguucauuuucaauagcuacaaggugagaaaaacauuuuauuuuuaauuuaugaaaauaaacaagacauugaaccuguaaucaagaucucacauccauauucuacacacucugaccauccuggaccuucuuacuguugccuaaacaugauagacccauuacaagucuaugcuggcuuuacacuaauuagaauuauggguacaagauaguacagaggaagcaggauuuauucucugugggauuauuggaaggcaacacugauauacugauucuugagaaaccagaaucaagaguucauuagaagggcgcagugugguaacucacaucuguuaucccagcaccuugggagguugggguaggaggauugcuugaggccaggaguuugagaccagccuguccaauguagccagaccuccaucucuacaaaaaaaauuuuuuuuaaaguucauuagaggcauaaaggacguucuaagcagaaagaaaugcauuuugcaaggguucagaggcaugacuuauuggggagauuauaagcagauaaaaaugcugaaaugggccaggcgcgguggcucacaccuguaaucccagcacuuugggaggcugaggugggcguaucaugaguuaaggcguuccagaccagccuggccaacaaggcgaaacuccgucucuacuaaaaauagaaaaauuagcucagccuggugggcgccuguaaucccagcuacucaggaggcugaggcaggagaauugcuugaaacuggaagauggagguugcagugagccgagaucaugcuacugcaccccagccugggcaacaagagugaaacuucgucucaaaaacaaacaaaaaagcugaaaugauagaggaaauaggcugugauauguaauaauaagcaaggaacagcuaggaaggacuauuuugugccuggaguuugcacauugaucuguaaaugaugaggaaugauuaaaggauuuuaaagaacagagugacauuucuguguggcaguuuuaggcagaucacaguccauuggcagcuucugucacuucgucuucugacucuugccuacagucuuuucuuuccuaaacccuuccuuagacugucaagauuucagaucuuuauuuuguuuuuaucuagguuaacagaauucuguucacauuuccaggcccgguuuugaauauagaaucuucugaagccuuuaauacgugaggcagaaugaacaacucacccucauuucuuuagcauuuuguuauacuguaagaguaacauucacauuuauuguguuuaaaguaguuguuuguaauuuuauauuuaguuaagaaccuugugauugcuugagggcaaauauaagcauauucaucuguauaacuaacaucuaacacauaauaggugucugucuaggaauugaauauuaugucaaaaauguuuuuuuccuguaaugaaaauuuucccguauguauuguuaagugcguaaugaaauuaaaaacucugaaaauauagaaugggacagaaccaauugauuuagaacaccauuucuaagguugauacuagcagguugauaauuauuucuccaauuuugauugagucagguauucacucacccagaauaaguauuaucaugaccaugcuuuccaucuuaucaaugauaacauuuuauuucuggguuagaaucagaaaucuuccugaaaccagcauacuacaguuacugcauuuacuuguuaucugugacuuauuuucaugaaaugguauaguuuuuucucaggaaggcuagacucaaugaaguuuuuuaaaaauuacaugcuaucucuaaaaguaagauguucugagaaauucuuuuuugggauaucagaauuuuguuaugagguuggugcaaaaguaauuaugggccaggcaugguggcucaugccuguaaucccagcacuuugggaggccaaggugggcagaucaccugaggucaggagcuggagaccagccuagccaacguggugaaaccccaucucuauuaaaaauacaaaauuagccgggcguaguagcaggcaccuguaaucccagcuacuugggaggcugaggcaagauaauugcuugaaccuggggagguggagguugcagugagcugagaccacgccacugcacuccagcccaggcaacaagagcgaaacuccaucucaaaaaaaaaaaaaaaaaaaaaguaauuaugguuuuugcaauaguuuuuaauggcgaaaaccgcaauuacuuuuguaccaaccuaaaauagauugugcauuguugcccaggugugauggcucacgcuuauaaucccagcacuuugggaggcugaggugggaggauugcuugagcccaggaguuugagaccagucuggguaacauuaugagaacucugucucuacagaaaaaguaaaauacuagccagcuaugauggugcacaccuguggucccagcuacuugggaggccaaggugggaggauugcuugagcccaggagguugaggcugcagugagccaagaucccaccacugcacuccagccuggacaacagaguuguccugucugaaaaaauaaaaucauguaucguuuacuucaggaaccuauaaaugucuuguguucacuauugguugucuuagaacuagcaucuguuaaggaggagucaauguauaaccuugaaaagguuuuuguucugaggacgcagcugucuagcuggcagaagcccauucuuucucaccuuagaacacaacuguuguauuucaauagucuagcaaaugaugcuuuggcagaauaaggaggagaguuauuuuuaaagcaaugcuucccuuuugucuugaagcaaauauagaauguugauggaauaugaaauugauucuagagcuaugccuuagaaugaaaguaauggaaacauauaaguuugguaccagauagaugaauucagcagaagacuuguguggcuuucugcuguaguguagaaauauuuuguaguguagaauaaaaauacuuguaguguagugauugccauuagcaaauuuuagcacaguuaaauuuguuagcugggcucagugugaccacgccuauaacccagcacuuugggaggcugaggcagucaagaccagacugggcaacauggcaaaacccuguaaaaacaaaacaaaacaaaacaaaaaaaaaaccacacacacgaaaauuagccaggcaucauggugcacaccuguagucccagcaacuugggagacugagccgaaaggauuccuuaagaccuggaggucaaggcuguggugagccaugcaugccgcugcacuguaaccuggguaacagagcgagaccccaucucaaaaucagucagucagucaaacuguuagcaguacuuuguuguuguuacaagcauuguuuaaaaccaguaguuuucuuuuucauuuccaauaaugacuuucuccuccuuuuccauuguguugcuagaacaaauauguugaaauauucaguugguuuguuuuauuauuuaaacgcacauacacaguugggaauuuugcauuuguuguaauuucugccugggauuuguuuucucuagguaauuacauaguuaugucacucagucuuuuuucaaaucucccuuauuaaaugggccccauguaaacaccauuucccauaguuaccuuguucuguauaaccuuuaucacucgcuagcauaauauuuucuucccuugcuaggauauaagauucuucuaaaaaaauuuuuuuuaaaaauuuuuuguagagauagggucuugcuauguuauccaggccagucucggaacgccuggucuuaagugauccuccugccuuggcuucccaaagugcugggauuguaggcaugagccaccaugccuggcuguuuuuuucuuuaauugaauaugagcuucuugaaggcaggggcuuaccuguuuuguuuuccuguuuaguugcuuagaacagugccuggcacauaguaagcgcucuauuaauguuuguucaauaaaccaacuucagugauagagugccuguaguuccagcuacucaggaggcugaggugggaggauugcuuaaggccacgaguuugaggcuguagugcagucuucacaccugugaauagccacugaauucuggccugggcaacauggugagacccccaucucuuaaaaaaaauuguugaauaaaucaaauuaggaauaguauuugaaacagaucuuuaauuuuaaaagaaauucaucccugaaggaaguuaagaucacucccaaucauaaauuuuuaaugagaauucuugcccuguuugggacaagauaaugaaguaauaagggcuucuaguguccuaagauuaacccaugaaugaucauaaaacuuaagacagaaaaauuagucccagguaaggaguguugauacuggagugugugugugguaaugguggcugcagucugguuuagggggcugcuccuguggcuguggaaggauaauugagguaaaaggcaguuuggauggaggucuuacccccuguuccaaauuugucuugauaauuaguaucucuuuuaaggggugugauagcaauaacucagacaguggguggaagugucuucaagaauaaaucauaauagcacugccuaaaaaguuucucaccucuaaaaauccuuauccuuaaaauucccuuaccuaaauuuccuacccuuccuccaccaaacucuuagagagcagugaauuauuauuauagaaaaugccuccuucccaaugcuacuuucaucuguggacaaagaaugaauuauuaaccugagggaguuguuuguauaauggaaagugauuaacugugauuuucucuuguuagggcucuccucccuagaauucuucuauucccccagggguuucucagugcuaaauguugcugauacagacuagagucaggccuuucucuuguuacacauaaucuagagaaaguaacucauguucccaaauaaauauguccaaaauaaggagacaaaugagcgcaagcaccucaaaaggcaaguaaaagauaacaaacuguguguauguguguguuuucuuguuuuauguuguuaauaucuuuguguauauaguagaagcaaaggcagauggaauaaaaagaaaagucuaauaaauuuucuaaaagauauuaacaacaugaaacaagaacaaaaacuuacuuaauaggaccaaaggaaaauacuagguauaagaaguauaaucuauagaacacauuugaugggaugaaauuaggaucaguuaaggugaaggagaaauuagugaguuggaagaucauauuuagaauucuuuccauaagaggaaagaaaggauauaauaugaagcauaaaauaaaaauuaagaaauaaaugaaauucaaaaguaggaguuccuuuuuccccuaagaucaggaacaagauaaagguaucugcuguugccacuuuuguucaacauaguacuggaacuucuguccagagcaguucagcagaaaaaagaaaugcauccaaaugggaagggaagaaauaaaauuaucucuauuuaagaugacaugaucuuauauguagaaaaccaaagauuuugcaggaaaaaaaaaccuuauggugcuaauaaguuagcaaugaucugaaaacaaaauuaagaaaaccauuucauuuauaauagcaucuaagagaauaaaaugcuuaggaauaaauuuaaccaaggaggcaaaagacuugcaguauaaaacacugcugagaggaaugaaagaacauguaaauaagaaggaagauaucccacguucaagaauuuggagacuuaaucuuguuaagaagacaguacuacccaaagugauccauagauuaaaugcaauuccuaucaaaauccaaacgauguuauuugcagaaauagaaaaacccauucuaaaauccauauggaaucugaagggagccaaaacaaucuugaaaagaagaagaaaguuagaggacucacaguuccugauuuauuucaaaaguuacuacgaaacuacagaaucaaaaacuguggggcugcgugugauggcucacaccuguaauuccagugcuuuggguggcuaaggcaggaggauugcuugagaccaggaguucaagaccaggcugagcaacauagccagaccccaucucuacaaaagaaaaaaaaaagcaguguguuacuggcaauacagacagacauugaccaauggaauagaauagagagacuagaaacaaacccuuguaaauaugguaaaaugauuuuugacaagggugccaaaaccacucaguggagaaaagacagucuuuucaacaaauggugaugagaaaacuggauacccacauggaaaagaaagaagucagaccuuuuccuuauaccauauacaaaaauuaauguaaagauggcucaaagacauagagaccuaaaacuauaaaauucauagaagaaaacagggaaaaaaucuucaugacauuagauauggcagugauuuuguaggauaugauaacaaaagcacaggcagcacaacaaauaaguuggacuucaucaaagcuuuuguguauuaaaggacacugccaagagaguaaaaagacaacccacagaaugugagaaaauguuugcgaaccagauauaugauaagagauuaauauccagaauauauaaagaacuccuacaacucagcaacaacaaccaaaagccaauucgaaaauaggcaaagaacuuacacauuucuccaaagaacauauauaaauggcuaauaagcacauuaaaauauuuucagcaucacuaaucagaauggaaauuugaaucagagccacgaugagagagacugauucauaccuaucaaguggcugguuuuaaaaaguaaaagagaaaguaacaaauguuggcaaggauguggaagaacuggaauuguuauacacuuucagagggaauguaaaauaguguugcugcuguagaaaacaguuugacaguuucucaaaaaguuaaacauacggcugggugcaguggcucacuccuguaaucccagcacuuugggaugcuugaggccaagaguucaagaccagccuggccaacauggcaaaacccuaucucuacuaaaaauacaaaaauuagccuggcaugguugugcaccuuagucccagcuacuuggaaggcugaggcaugagaaucgcuugaaacccggggguggagauugcagugagccuagaugaugccuuugcacucuugccugggcgacagagugagacuguaucucagaaaaaauaaaaaauauauaaauaguuaaacacagaauuagcauaugacccagcacuuucacuccuagguguauaccaggaagaguugaaagcagggacucaaacagauacuuacacaccaguguucguggcagcauuauuccaaacugaaaagauggaaaaaucccaaauguacaucaacacuugaagaaguaaacagaaugguauuuauaugcaauggaauauuuuucagcuuuaaaaaggaaggaaauuuugauauauuuugcaauacggaugaaccuuaaaaauacugugagugaaauaagccagaaacaagaggacaaauauuguuaugauucuacuuaugugagauacauggaauaggcagauucauagagacagaaaguaggagagagggugagugaaauaagccagaaacaagaggacaaauacuguuaugauucuacuuaugugagauacaugggaugggcaaauucuuagagacagaaaguauuaaugggagagaaguuacuagggguaauggugagggcaagugggggaugauuuuuuuaauggguauaguguuucugauuggaauagugacagguucuggaaauggauaguggugacaguuguacaacauggugaauauuuucaauggcacugaauuuuauacuuaaaauaguuaaaauggcaaauuguguuauacuuuaaaaaaaggagaagugaggcugaugucugugaaguugggucaguguacucgaaauuccccaugugguuggagaacuuaggcauugaaaguaauuuuguggccaggcgugguggcucacaccuguaaucccagcacuuugggaggccaaguugggcggaucaccugaggucgggaguucgagaccagccugaccaacaugaagaaaucccaucucuacuaaaaauacaaaauuaggugggugugguggcgcaugccuguaaucccagcuacucgggaggcugaggcaggagaauugcuugaacccaggaagcggagguuucagugagcugagauugugccauugcacuccagucugggcaacaagagugaaacucugucucaggaaaaaaaaaaaaaaaaaaagaagaaaguaauuuuaugaauaagcuagaagaaguuguuuaagaagugggguaucugacuuacugaucucaggugacauuccaggugaaaucuagaucagguauguauuccucagugaauuugaacuuggaagguagagcaaaauucaaauucuagcguugucauuguuuuaaauguaauuuugucauauuacuaaagcuuucugaacuuuugucugugcuuuuuauauauauauauauacguauuuaaauggauaaguaauaugugcuaaaaaaaagauggcagcacugacguaggaaacuuaaaaugacaaaggagaaauauuugagaaaacaauagagguugacgucuagaauuaaagaaauaugaaagaucucagguugaagagguccauauagaauacaauaugauuaagaaaaacucacacuuguacacaguacagugaaauuaaagagucuaaaagugaacaaguaacauuacgaagaaagaaaauugagauugacaucacacuuaccaguagcaguguugacugcaagaagauaauggaauaaauuuuuuuugaguauggagaaaguauugaaagaaacugugaaccuugacauuucuacccauccaacugucauucgagugagggcaugauuaaaauauucucaaauauagaaggccaaagccuuagaagauaagccauacaaaagccacaugggaaacauuuuuggagaaagaacucaaaugaguauuugcaaaucuagcagaugcugcaggacauguaauguacacauguaaggcauguacauuuuugaaauacccaaguagaaguuguugucuuuaaaaaguuagcuaagaauaaaaaagaauaaauagaaguaugucuauaaaacuugaugggaauuggguggaggggagauuagaggacaugaaggcauggucaaguucuugaugaaaggaaauauagaugacagauuuacuuaucuaaaaaagcaaaggacaaguugagauaauaaacuugucaguuaaaaggcagagauugauaugauaaaccaacuauauguucauuuuuuaauaggaaaauacuauaaaucacaauuuagaauucuacagaugggagaggcauggaugagcaguuaugaaaauugaggaucccaacaaugcuuuugcuuauguggauuauaccuaccaauaguuacaguauuagaaauuaaaacugaaaaaauuuuaaguauuuauuaacugauuaaucaauaauugucuauuaauauagcaacaacauaccccuuuuauguuaacguaauauaaaacauauuauaaaaauaacuauuuucuaaaacaacaaagagcuuagaaaaguggcauuguuuuaagcacuuuugcaaaucuguuuaaugucugguuuaauagaagguacuuggauucucuuaucugcuuccacguucacuguguugcaauguguuguuuuguuucagguauauaagaaaccuaggaccucaugaaucuuuugaaagggucuuggaaacccucggugaucaugagaccacauuuugagaacugcuuuuuccauacaaaguuucuuuccuauuuauuacccuacuauuuggugucuucugcaucaucacaguacuuuucuuaugcucucauauuccccgcaccucccaguuuuauuauuucuuaccuuacguucucuuccaguuugauucuucugcaucaagccuucauugauuauucuaguuucugucucuucucuaaaaucuguuugcaaguguaguuucacauauuuuguacuaaaguacucuuaaguuuuuuguauuuucuuuguccaaugacauuauggcccuuuuaaaguagggacucuaaaaauugauuacaacacaagaauuuauccauacacacacacaaauauuuguaucucaaaauagguaauuuuuguugguugauuggaaguaacacucuccaggaaaacacauaaaucgcaaauuuguuuuuggccuuaagugauuuauuagaaaacuguaaugucuuaugcauuaucugccacaugcuaauacuuuugguauugcaaguccuccuuucuucaagagaucuuguauaacuaaaaccuucuuuuguucaggcuuguugaucuuauaaaccacuuauugauuuacuuauuaucuugccauuucagaaaaaagccaaaggacaagaguuguuugaucagauuauguaccaccuggaccugauugaaagcgacuauuuuggucugagauuuauggauucagcacaaguagcagugaguaacuguuuuuuggaaguuuuagcauaaggagaagaaacaggaaauuucagaugauauacuaauugcuauaaggcuuccuauucuugauguguuauugugauauaaagcuuugacaccgcucccuccccccaccuccuugcuuuagcaucaccugaaguacuuguuuuaaaaaaugugaguucugguccuaauuuccuaaccugaauuacaagaacaaaaguuuucaggauggggcuccagaaucuuuguuuuuaauaacuguugucuggauuguugggcacacaagaauuugagaaacacuguguacuggaaagaaugcuagaaugggaguuucaugggcucuuggguaaacaauaguaguuuuuaauuugcaaaugaaguugaguagacuaggauaucucuaaguucccuuucagaucugugauucuguaucuauaaauagugguacuucgacaugcauuucugacaagagaacagcauacauaauggaguagaaaguuggaggcuauucaaauaacugauuacuauauuaggauuuuacuggaggauguuugaaagaaaguggcagaugaaaacauugggaggugguuuagugguuauaucauucaaacugaaugcccaaaguauuaaauaauaaauuggcaauauuuacucucaaauaauugggauuagguagucuucaagcagggagguuuuauuuuccuucaggaaguuuuuuguagagauauguaggauuuggaauggggagagauugaagucagggaaaguuauuacaaauacuuuaggauaaaaguaauauuaaggccuggacaguaggaggcagaggaagagaccacagaugauaaggauaucauggcauuaagccuuuuuuucuggaaauguguguguguguguguguguguguguguguguguguguguguguguguguguuuagaggggaacucccagcugacuuuauaaagcaucugggcuaaguuuacagcugugaauaauuuuagcugucauuuuuucaugacaacccuucccaucaugccuccaaauuaaguaaccaugagcauauggcagcaggguauugguuaggcaaauuuuggcgcauccuugaaauuaauacuaugcagcucauuaaaaauagcgguuuugggccaugcaugguggcucacaccuguaaucccagcacuuugggagacugaaccgggaggauuacuugaggucaggaguuugauaccagccuguccaacauggcaaaacccucugucuacuaaaaauacaaaaauuagcugggccugggcaugguggcgugccccuguagucccagcuacucaggaggcuaaggugggagaaucgcuugaacccgggaggcagagguugcagugagccaagauugcgccacuacacuccagcuugggugacagagcgagacccugucucaaaaaaaacaaaaagaugauuuuuauuuaaaaaaaaaaaaaauuagcugggcguggcggugcaugccucuaguuccagauagcugggagacugaggcgagaggaucccuugagcccaggaacuuagaguuggaggcugcagugagcugugauugcaccacuacacuccuaaccugggugacaaagugugagacccuauuucuaaaacaaaauggugauuuuuaaguauuaauaugcuaauugauauggagugguagaaguagucauaaaggauuauaaggcaguauaauugaauuuuucuauuuuuuaaaaaaaucuaggccaggagcaguggcucaugccuauaaucccagcacuuugagaggcugaggagggaggauaacuugaggccaugaguuugagaccagccuaggcaauauugcaagacccugucucuacaaaaauaaaaaaauuagcuaggcaugguggugcaugccuauaguccuggcuacuugggaggugggaggaucgcaugagcccaggaguucaagguugcagugagcugugaucaugccacugcacucuagucuggguaacagagcaagacccugucucuuaaaaaaaaaaaaaaaaggauauauggccaugcauauacaugaaaaaauugugaaacuauuuuucauaguuucagaguuucuaaucucuuggugacauuaguguaggagauauuucuuuuauuuuucuuucuaauguucuuaauucucuuuuauuagacuaaauucacuaauggcagggaauuagucuuacguaccucuguccagcagguaguaggcacacaaaacauuuguugaauuuaauucuagacuucuguuuaguuugauaaaaucuugguugccuauuaauuuuaauaucauucagcuuucacuucuagaauaauaguaaagccuuacaaucagaugaaugaacagaugauauuaaggauaaacaaucugugacuuccuguuuuuugaggcagugugagggaaaagaaaguaaaaguaugccaaaguuagguuugaguuacuuaguauuuaaguaacuguggaaagaaacaugcagucauuacuaaguuguauuauuagcccuuugcuaauauuagcaauuacugaauuccauauugauuuuuuucucucauuugauacacauauagugccuuucuugucauaauaauaaauuuuugguaaagccaggauuagaauauuuaaucccuacucuuuaguucuaguuuauuccuuccaguaaccagaaaucuaggcauuaaaauucaacuuauaggcuucuguuuacuucauuuuauuuuugcuucacuaaaacacucuaaacuaugaguugagcuggaagaagaguuaguagauuaaagauauuaaaaaugaacuccagauaagcuaaacuuuucaaguucuuacucacuugauuccaugagucucaugacauaaacaaucagcuuguuguguggccauauucaaccucagaaugaaaugaaaccaaaguggggugaagggaagcguaaaaugcgaccaaggaauuacaugcuauaauuucacccucagcauauggcauguccauauauguaagguuaaugugccacauuuuaguuuauuggucacuauagaucaguccaaaacgucuaugacuauagaauuauggagucaucauggagauaaccaaaauuaguaaaucgaugaagccaaaguucacuuuucuucuuauauagacauauaaucugagcccuguuuuuaaaauuguuuacuuuuuauuagacuggguuauuuuacguucauguacacauauuuaauuucauaguugaaacaaucucauguuuauagaaaguugcaaggaugguauaaauaaccauguuucugggaccaugugagagagaguuauagugaagaugucccaucacaccugaauucuuuaguguauguguccuguaagcaagcacacuucacaacucaauacagccaucaaaaccaggaaauuaacacaaugauaguaccaccaucuugucuccuuagacuguauucagauaauguuaacuguuccugguauguuuuuuauacccaaaagaucccacagaaucaugcuuugcauuuuuuucuuuuuuuaaaauuuuuauuauuauacuuuaaguucuaggauacaugugcacaacaugcagguuuguuacguauguauacaugugacauugguaugcugcauccauaaacuugucauuuacauuagguauaucuccuaaugcuaucccucccccgucccccccucaaugacaggcccuggugugugaugcucgccuucccaaguguucucauuguucaguucccaccuaugagugagaacauauguuguuugguuuucuguccuugugauaguuugcugagaaugaugguuuccugcuucauccauguuccuacaaaggacaugaacucauccuuuuuuauggcugcauaguauuccuugguguauaugugccacauuuucuuaaucagucuaucauugaugggguuuggguugguuccaagucuuugccauugugaauagugccgcaguaaacauacgugugcaugugucuuuauagcagcaugauguauaauccuuugaguauauacccaguaaugggauggcugggucaaaugguauuucuaguucuagauccuugaggaauccccacacugucuuccacaaugguugaacuaguuuacagucccaccaacaguguaaaauuguuccuaugucuccacuuccucuccagcaccuguuguuuccugacuuuuuaaugacggucauucuaacuggugugagaugguaucucauugugguuuugauuugcauuucucugauggccagugaugaugagcauuuuuucaugugucuguuggcugcauaaauguguucuuuugagaagugucuguucauaccuuucgcccacuuuuugaugggguuguuuuuuuuuuuuucuuguaaauuuguuugaguucuuuguagauucuggauauuagcccuuugucagauggguggauugcaaaaauguucucccauucuguagguugccuguucacucugaugguaguuucuuuugcugugcagaagcucuuuaguuuaauuagaucucauuugccaauuuuggcuuuuguugccauugcuuuugguguuuuagacaugaaguccuugcccaugccuauauccugaaugguauugccuagguuuucuucuaggguuuuuaugguuuuuaggucuaacauuuaagucuuuaauccaucuugaauuaauuuuuguauaagguguaaggaagggauccaauuuuagcuuucuacauauggcuagccaguuuucccagcaccauuuauuaaauagggaauccuuucccuauuucuuguuuuucucagguuugucaaagaucagaugguuguagaugugugguauuauuucugagggcucuguucuguuccauuggucuaugucucuguuuugguaccaguaccaugcuguuuugguuacuguagccuuguaguaugguaugaagucagguagcaugaugccuucagcuuuguucuuuuugcuuaggauugucuuggcuauaugggcucuuuuuugguuccguaugaacuuuaaaguaguuuuuuccaauucugugaagaaagucauuguuagcuugauggggacggcauugaaucuauaaauugccuugggcaguauggcuauuuucacgauauugauucuuccuauccaugagcauggaauguuccuccauuuguuuguguccucuuuuauuuuguugagcagugguuuguaguucuccuugaagagguccuucacaucccuuguaaguuggauuccuagguauuuuauucucuuugaagcaauugugaacgggaguucacucaugauuuggcucucuguuugucugugauugguguauaggaaugcuugugauuuuugcacauugauuuuguauccugagacuuugcugaaguuccuuaucagcuuaaggagauuuugggcugagaugaugggguuuucuaaauauacaaucaugucaucugcaaacagggacaauuugacuuccucuuuuccuaauugaauagccuuuauuucuuucuccugccugauugcccuggccagaacuuccaacacuauguugaauaggaguggugagagagggcaucccugucuugugccaguuuucaaagggaaugcuuccaguuuuugcccauucagugugauacuggcuguggguuugucauaaacagcucuuauuauuuugagauacuuucaucaauaccuaguuuauugggaguuuuuagcacgaagggcuguugaauuuuaucaaaggccuuuucugcaucuauugagauaaucauguguuuuuugucuuugcuucuguuuauaugauggauuacguuuauugauuggcauauguugaaccagccuugcgauccagggaugaagcccacuugaucaugguggauaagcuuuuugaugugcuccuggauucgguuugccaguauuuuauugaggaguuuugcauugauguucaucagggauauuggucuaaaauucuuuuuuuguugugucucugccaggcuuugguaucaggaugaugcuggccucauaacaugaguuagggaggauucccucuuucucugucaauuggaauaguuucagagagaaugguaccagcuccucuuuguaccucugguagaauucggcugugaauccgucugguccugggcuuuuuuuugguugguaguccauuaguuauugccucaauuucagagccuguuauugaucuauucagggauucagcuucuuccugguuuagucuugggaggguguauguguccaggaauuuauccauguuuucuagauuuuuuguuuauuugcguagagguguuuauaguauucucugaugguaguuuguauuucugugggaucaguggugauauccccuuuaucauuuuuuauugcgucuauuugauucuucugucuauuagucuugcuagcggucugucaauuuuguugaucuuuuaaaaaaaaacagcuccugcauugauugauuuuuuugaaggguuuuuugugucuuuaucuccuucaguucugcucugaucuuaguuauuucuugccuucugcuagcuuuuuaauguguuugcucuugcuucucuaguucuuuuaauugugauguuagggugucaguuuuagauauuuccugcuuucucuugugggcauuuagugcuauaaauuuuccucuacuuuauagcucugggacacugcuuuaaaugggucccagagauucugguauguugugucuuuguucucauugauuucaaagaacaucuuuauuugugccuucauuucguuagguacccaguauucauucaggagcagguuguucaguuucuauguaguugagcgguuuugaguuucuuaauccugaguucuaguuugauugcacuguggucugagagacaguuuguuauaauuucuauuccuuuacauuugccgaggagugcuuuacuuccaacuauguggucaguuuuggaguaagugugauguggugcugagaagaauguauauucugcugauuugggguggagaguucugcagauaucuauuaggucugcauggugcagagcugaggucaauuccuggauauccuuguuaacuuucugucuuguugaucugucugauguugacagugggguguuaaagucucccauuauuauugugugggagucuaagucucuuuguaggucucuaaggacuugcuuuauguaucuguguucuccuguauuggguacauguauauuuaggauaguuagcucuucuuguugaauugaucccuuuaccauuauguaauggccuucuuugucucuuuugaucuuuguuaguuucaagucuguuuuaucagagaguaggauugcaaccccugcuuuuuuuuuguuuuccauuugcuugguagaucuuccuccaucccuuuauuuugagccuauggacgugucucugcaggugagaugggucuccugaauacaguacacuggggggucuugacucuauccaauuugccagucugugucuuuuaauuggagcauuuagcccauuuacguuuaagguuaauauugccaugugugaauuugauccugucauugugauguuagcugguuauuuugcucguuaguugaugcaguuucuuccuagcaucgauggucuuuacaauuuggcaugguuuugcaguggcugguaccaguuguuccuuuccguguuuagugcuuccuucaggagcucuuguaaggcaugccucguggugacaaaaucucucaccauuugcuugucuguaaaggauuuuauuucuccuucacuuaugaagcuuaguuuggcuggauaugaaauucuggguugaaaauucuuuucuuuaagaauguugaauauuggcccccacugucuucuggcuuguagaguuucugccaagagauccacuguuagucugaugggcuucccuuuguggguaaccugaccuuucucucuggcugcccuuaacauuuuuuccuucauuucaacuuuggugaaucugacaauuauaugucuuggaguugcucuucucgaggaguaucuuuguggcguucucucuauuuccugaauuugaauguuggccugccucgcuagguuggggaaguucuccuggaugauauccugcagaguguuuuccagcuugguuccauucuccccuucacuuucagguacaccaaucagacauagauuuggucuuuucauguagucccauauuucuuggaggcuuuauucauuucuuuuuaucuuuuuucucuaaacuucucacuucauuucauucauuugaucuucaaucacugauacccuuucuuccaguugaucaaaucagcuacugaagcuugugcaugcaucacgucauucucgugccaugguuuucagcuccaucaggucauuuaaggacuugucuacacuaguuauucuaguuagccauucgucuaaucuuuuuucaagguuuuuagcuucuuugugauggguucgaacauccuccuuuagcucggagaaguuugaucgucugaagccuacuucucgcaacuugucaaagucauucuccauccagcuuuguuccguuuguggcgaggagcugcguuccuuuggagggggagaggcgcucugauuuuuagaauuuuuggcuuuucugcucugguuucucccuaucuuugugguuuuaucuaccuuuggucuuugaugauggugacauacagaugggguuuugguguggauguccuuucuguuuguuaguuuuccuucuaacagucaggucccucagcugcaggucuguuggaguuugcuggaggucuacuacauacccuguuugccuggguaucaccagcggaggcugcagaacagugaauauugcugaacagcaaauguugcugccugaucguuccucuggaagcuucgucuuagagggguacccagccuugugaggugucagucugccccuacugggagguggcucccaguuaggcuacucgggggucagggacccacuugaggcagucuguccauucucagaucucaaacagugugcugggagaaucaccacucucuucaaagcugucagacagggacauuuaagucugcagaaguuucugcugccguuuauucggcuaugcccugcccccagagguggagucuacagaggcaggcaggccuccuugagcugcggugggcuccacccaguucaagcuuccuagcagcuuuguuuaccuacucaagccucagcaauggugggugccccucccccagccucgcugccaccuugcaguuugaucucagacuacugugcuagcaaugagugaggaucugugagcgugggacccuccgagccaggcacaggauauaauuuccuggugugccguuugcuaagaccguuggaaaagcucaguauuagguugagaguuaucugauuuuuccaggugccgccuguauuagguugggaguuaccugauuuuccaggugccgccugucacagcuucccuuggcuaggaaagggaauucccugacuccuugcgcuucccgggugaggcgaugccucgcccugcuuuggcucuugcucagugggcugcacccacuguccaacaagccccagugagaugaacccaguaccucaguuggaaaugcagaaauuaccugucuucucucuacacugggugauguagacuggagcuguucuuauucggccaucuuggaaccuccugcauuguuuuguuuuuuuuuugagacagagucuugcucugucacccaggcuggagugcagugacguggucuuggcucacuguaagcuccaccucacagguucaagugauucuucugcuucagccuccugaguagcugggacugcaggugcacaccaccgugccuggcuaauguuuguauuuuuaguacagacaggguuucaccacauuggccaggcuggucuugaacuccugaccucgugaucugcccacccuggccucccaaagugcugggacuacaggugugagccacugcaccuggccaugcuuugcauuuaauuuucauguuucuuuaguugccuuuaaccuggaguacugcgguuuccuuagucuugccuugacuuucaugacuuugaagcuuuugaagauacaggacaguuauuuuguauaucgucccucaauuuggguuugucugauguucccuuauaaaguagauuaaucuuggcaccuuuggcagaaaaauaaccgaagugauucuguguuucguucuguccuauugggugucauguacuuucauuuggucccauuacuagugauacuaaauuugaucccuugauuaagauggugucugcuaggccucaccacuaugaaguuauucuuuuuucccuuugucauuaacuauuuugugggcaguuauguugagacuuuuccucaucaaacuuucuauuuauuuaugaacuaauagauuccuguuuuaauucaauggguuauaucuguuacuaucauuuaauuuguugcucaaauuuucccacguauggucaaugggagcugcuucaagauggcuucuauguucauuugacauggccccuucauucuuugagcucugccuuacuuucuggcuuaugaagguaugccauguucaucuugcagugcccuacuccagcccuggaauuagccaguucuccaaugagucuugugaccagauuuagggaauauguguuuauguuuauuucuccauaucucucucucgaauaccaugaauaccauaacuucaacacccauaaauaauugaaauuccagucuaacacuacagggcuucuuguaguuuuuuuucucuuuccauauuuguaguucucuucuauagaaaccaggcuaugauuaucaccaguagauuuacuauauugaucacucagcauguguggaaccagucucuagccucucccuguguacaugcuggucuugcucagacaaccuaauuauuucuggacugaguuauuauuuuuuauuuuuauuuuuugcuguuucuuugaucuuggauggacugaauuauuuggaaaaaggaaaggauugugaaacuugucaccuuacaaauacacaguggaacguaaagcacuccuuugacaguuguauugaagaguuauuaccucagagauuugguuuggaguaggaagcuuaaagagaagagagaaggcaugcuuaaguaaaagaaggaguugguuuuaguuagcaugacgaugucauuuuuucuguaaaguaggccacuuaaaaaaaagacaauuuacauaccauaaaguucaccauuuuagauuguacaauucagaguuuucaguauauuuagaauuguucagccaucaucacuaauuccagaacauuuucaucacccccaaagaaacccucuuacacguuaccagucauuucccauuuaccccuccccacagcaucuggcaaacgcugucuauggauugccuauuuugaaaauuucauuugaauggaaucauguaauagguggccuuuggaaucuggaaauguacuuagcauaauguuuucaugguucauccguguuguagcauaucuuagugguugauuccuuuuuauugcugaauaauauucuauuguaugaauauaucacauuuuauuuacucauccauugauggacauuuggaguauuucuacuauuuggcuguuaugaauaaugcugcucugaaggcugggcaugguggucuguaauccaaacacuuggggaggcugagauggguggauugcuugagcccaggaguucgagaccagccugggcaacuuggcaaaacacuugucucuacaauauacaaaaauuagccaggugcgguggugugugccuguaguuccagcuacuugggaggcucagguaggaggauugcuugugccaaacuuuuccagugauggcaccauuccacacucccuaccagcaguguaugaggauuccuguuucuccacauccuugccaacuugugauuuccccuucuuuuuguuuagccauccuaguugguaugaaauggugucucauugugguuucgauuugcauuucccuaaugacuaaugauguugagcaucuuuucaugugcuuguuugccguuuguguaucuucuuuggagaaaugucuauucagauccuuugccugauuuuuuaaaguguguuauuugcuuuucugcuguugaguuguaagaguucuuuguauuuucuggguacucagcccuagucagauacaucugcaaacuuuuuuccccuacuuuucacuuucuugauaguguccuuugacaaaaguuuuacauugugaugaaauccaguuuaccuacuuugguugcuuaugcuguuuguguuauaucuaucaaacgauugccuauucugaggucauaaagauuuacacguuuucuucuaaaaguuuuuuuuuuuuuugagaaagagucucacucuucucacuccagucaccaggcuggagugcaguggugcaauuucggcucacugcaacuccgccucccgguucgagcaguucuccugccucagccuccgaaguaccugggacaacaggcaucugauucauuuagaguuaauuuuuguauaugcuaugaaguugggguccaccuucauucuuuagcaugugaauauccagugauccuaacaccacuuguuaaaaugacuugaagggucuuguugcaugcuuguuggaaaucuauuuacuauagacuauagauauguggguuuauuucuggauucccucuucuguuccauugauacauacauauauacacuuuuuuuuuuuuuuuuuugagacggaguuucacuuuuguugcccaggcuggagugcaaucaugcgaacuuggcccaccacgaccucugccucccggguccaagugauucuccugccucagccucccaagcagcugggacuacaggcaugcaccaccaugcccagcuaauuuugcaccuuuagcagagaugggguuuguucauguuggcaggcuggucccaaacucgaccucaggcaauccgccugccucggccucccaaagugcuggaauuauaggcgugagccaccaugcccggccuguuccauugaucuuuauguugauccuuaugccaguaccacagugucuugauuaugguaacuuuguaguaagucuuaaaauugggaagugugaguucuccagcugucuucuuuuuucaguauucuuuugguuauucugagucccuugcauuuccguauaaaucuuagggucagcuuauccauuuaugcaaaaaaggcaguuggaauuuugguagggauugcacugaaucuguauaucaauuuggggaauauugccauuuuaacaauguagucuucugauccaugaacauggaaugucuuucucuguauuagguuuuuaauuuuuuuuuuuuuuuuuuuuuuuuugagacagagucuugcucugucaaccaggcuggagugcaguggugugaucucggcucacuggaaccucugccucccggguucacgccauucuccugccucagccucccuagguuuuuaauuuuuuaaaacaauguuuuauaguuuaaguuuauagaagucucacuuccuugguuaaauuuauuccuaagcauuuuauuccuuugguacuauuuuaaauggaauuguuuuuauaauuucauuuuuggauuguucauuguuagcauauagaacugcaacugauuuuuguguauuuauuuuguauccuguagucuugcugaacguguuuauuaguuuuaauguguuuuuauguauaagaucaugucaucugcaaaaagaugguuuuaugucuuccuuuagaaucuggaugucuuguguuuuuuucuuuccuuuucuuuccucagugcccuggcuagaaccuucaauaaaauguugaauagaagcagugggaguggacacccuugacauauuccugaucuuaguggggaaaauguucagucuucuaccaucaaguauggugugggaauuuuauagaugcccuuaaucagauugagggaaggucuuuucuauuccuaguucguugaugcuuucauaaugaaaggucguuggguuuugucaauugcuuuuucugcauuuauugagaggaugaugugaaguuuuuaaaaaaucuguuuauaugguauguuauguugauuuuuuuuuuuuaauguugaaccaaccuugaauuuuugggauaaaucccacuuagucaugguuuauagucuuuuuuuuuuuugagauggagucucgcuuuguugcccagguuggagugcaguggcgugaucucagcucacugcaacaucugccuccugguucaagcgauucuccugccucagccucccaaggagcugggaugacaggcaugcaccacugugcccggcuaguuuuuguauuuuuaguagagaugggauuucgccauguuguccaggcuggucuugaacuccuguaugcaagcgauccuuuugccucagccucccaaaguguugggauuacaggugugagccaccacaccugaccauugguuugccaguauuugaugauuauuuugguacuauauucauaaaggauauuagucuguaguuuucuugugacuuuuuuuuuuuuucugguuuggguguaaugcuggucuuguagacgaggugggaaaaccauccccccucuuguauuuuuuuggaaaaucuugugaaggauuaguguuaauucuuucaacauuugguagaauuugucauugaaaccaucugguucugggcuuuuguuugugagaaguuuuugauuauugacucauuccuuuacuuguuacagguguauucagauuuucuuuucuuuccauuuugagacagggucucacuuugucacccaggcuggaguguagugacgccaucacagcucacugcggccucaaccucccaggcucaagggauccucccaugucagccuccugaguagugggggcuauaggcacccaccacgccuggcuaauucuuuauuuuuuuguagagaugggggcucaccauguugcccagacuggucuugaucuccuggaugcaagugauccucuucagccucgcaaagugcugggauuacaagugugagcuaccacgucuggcuguguuuucucuaaaggccacuuuagagaguaaaagggguacuuaaugaaugagggauugggauaguaggcauaagcugccaguauuauucugguaaaccagaauauauggucaucguuguuuuaguggacugcagaauacuaccccaucgucuauuuuaaaaucuaaauguaauuuaauauccuuuuauauaguccagugaugaucuuaaacuuagaguuaugaaaucuguggacuuacccuagaaaaaugcacauacacauaacguuuugucuguacauaguaauucagauaucccccaagcccaacuaugaauucuccaauuuaguaacccuucuuuagcaaaugaauaaccuauagcuuaagggaagauggauaaugguauaaaucugugaguuuuucuguuuaaaucuuuaagacaguuacgccgucaaacauuuauaaucucuuuuuuuuuuuuugcuguugguacaacuuuguuauuaaaucucauuguauaacuaaacagauauuuuuaugguaauauauucuuucuugaugaaggcuuagggaaacacuuuuuuuuugcugucauaaaaauaguacauguagcaaagccacccaugacaggagcacugccaauauuagugguuaaaaaagugacaauuuuggguaguuucuuguauacaggacuuuccacaguagaaguaauauauuuuuaauuuugauauugagugguuuuagguugguacaauaagacuuugcaaaauaauuggagaguuaacuguaccgauuuccuggagaacacauuugauacauuuugaaggaacaauuuucagucuuaaaaucacauguuuacauggaccaggcaggagagcaaaagaagggaagcagguuggugugcacauuaaagauuuugcaugguuauuuacuccaagaagaaauaugguuucucucauuuaaaaaaaaaucuugcuacauacuuguuauguuuuguauuuuccuucauuuuauuuuauuuuuaaauaaaagaagcaggguuuugcugucugugucugcccaggcuggagugcaguggcaugaucagagcucacuguagccuugauccccugggcucaagugauccacccaccucagccucccaaguagguaggacuacaggugugcaccaccaugccuggcuaauuuaaaaaauaauaauuuuguagagacugcccaggcuguucuggaacuccuggccucaagugauccucuugccuuggcccucuaagguguugggauuacaggugugggccacugugcccagcccuuuucucauuuuugauagggauagagacagagaaauauagauagcgugaugauaaaucauagcugauauccagcagacuguagaggaucaaaaaggauugguggaggggauguggugaagugggaagcauuuuacauuuaccugcaaaagacaguauauggcaacuaccaccuagcuccaggcauuugcuguuaaauagguuuguuguaccagcauugcuggaucuucagguauuucaagaaaagcugaaauccagauuucaaggcuaaauugucuauuuuuaaaaaguuguuaaacauauuuuuaaaaauagcguggcugauggagaaaucaaagaagauaaaaguaaauggaaagacauucuacauugaauggaagacucaacaaagauaccaguucuccccaaauugauauacagguuuaaugcaguuuuucucaaaauuccaguaagaucuuuuguagauauagguaagauuauucuaaaauuuauauggaaagacagaggacuacuagaauggcuaaaguaauuuuaaaaaaggggaauaaaaugggaggaaucaugcuacccaauuucaagacuuacuauauagcuuucauaaucaagacuuugugguauuggcaaagcgacagacauguagaucaauggaaagaaauagccauacacaaauaugaccucugauuuuugucaaaggugccaaaguaauucaguggaagaauagucuuaauaauggugcuggauuagaaccuguggaagaaggaaaaacaaacaaacuaaaaaaagugcuggagcagcuggauaucuguaagacagaaaaaccuugaccuaaaccuuauaccuauacaaaaauuaacucaaaauggauaaugagccugaauauaaaauauaaaacuaugaaacuuagagacaaauaaacaggagaaaaucugugggaccuagaguuuagagaagaguuacuaguaaacaugauaccaaaaggaugauuuuuaaaaaaaagauaaaauggacuucauaaaaaauuaaaaacuuuugcuuugggaaagacucuguuaauagaacgagaagcuaagcuacagacugggagaaaguauucguauaucacacaucugaccaggaacucgugucuagcauauauacacaaugccuagcugggcgcaguggcucacgccucuaaucucaucacuuugggaggccaaggcaagaggaucacuugagcucaggaguucaagacuagccuggacaacauagugagaccuugucucuacaaaaaaaaacaaaaaaagucugcugcuguggcuacuugggaggcugggcaggaggauugcuuaagccugggagguggaggcugcugugagugugacagccacugcaccucaaaccugggcgacagagcgaaaccgugucucaaccaaaaacaaaacaaaacaagcuccucagcucaacaauuagaaagcaaacagucuaauucaaaaaugaacaaaagacaugaagagacauuucaccugagaggauauacagaugacaaauucaugaaaagauguuagacuagccaucagggaagugccaauuaagaccucagugagauguuuucacuacacaucuaucaaaacagcuaaaguacaacauggugacaacuccaaauuuuggugagaaugugcagaaaugggaucucuuauacauuguuguugggauuguaaagugauaucgcuacucuggaagauaaucuggcaguuucuuuuaaaacuaaacauauacuuaaaccauaugacuaaucaguuguaugccugaccauuuaucccagagagaugaagacuuacuuccacacaaaaaccugagcaugauuguucauagcaucuuuauuuguaguagcaaaaaacuugaaacaaccacaguguccuacaguaagugaaugauuaaacaguggcacaaucauaccauguaauacuacucagcaauaaaaagaaaaaacuauugauacacaccaacuuggauggauuucagagggcauuaugcugaauaggaaauaaagccaguaucaaaagguuauauauuauaugauucuauguauguaacauucuugaaaugacacaauuauagagauugagaucaaauuaaugguugcuaaggguuagggauauuggcguugggggaguggugacuauaaaugaguaaugugagagaguucuucgugauaauggaauauuucuuuaucuugauugugguauuaggauaggaaucuaaaugugauaaaaugacacagaacuauacaugcacauuguaccaauguugguuuacugauucuaauauuguacuguaguuauguuaaaauguaagcauuggcagaaguguacacaggaccgggccucuucuuacuaucauuccaacuuugugugaaucucuaauuauuucauaauaaaaccuuaaaaaauaaacauagcauggaacaagcaaaccaugucucgggagcaaaauuuaauccucaaaaauauauaucugugcuuggugaaguuugaaaagguuauauauagagauuagaauuuuaacugguucagggaaguuuuuuuuuuuuuuuuuuuuuuuuuuugagaaggagucucacucuguugcccaggcuggagugcaguggugugaucucagcuuacuacagccucugccuuccggguucaagcaauucuucugucucagccccucgaguagccaggacuacaggcacacaccaccaugccuggcuaauuuuuuguauuuuuuuuuuuauuuuuuuuuuuugagacggagucucgcucugucgcccaggcuggagugcaguggcgggaucucggcucacugcaagcuccgccucccggguucacgccauucuccugccucagccucccaaguagcugggacuacaggcgcccgccacuacgcccggcuaauuuuuuuguauuuuuaguagagacgggguuucaccguuuuagccgggauggucucgaucuccugaccucgugauccgcccgccucggccucccaaagugcugggauuacaggcgugagccaccgcgcccggccuuuuuuuuuaauagagacaggguuucaccacguugggugggcuggucucgaguucuugaccucaggugaucugcccuccucggccucccaaaguguugggaugacaggcaugagccaccacacccggccuauucagugaaguuuuuaaagaaaaauaaguuaguuagaugguagguaucaugcaucagguguaucuuguauaacgugauacuguauauuaugcuuuuagaaaagggaaacguagauagcauuucucauaaauacuuaaagaauuuuaagaugucaguauuaauuauguuuugucuuuuucuuaaauuguuuggaaagcuuguuuauguucuguaauuuuuuucaaaacuuccuugguucuugauguaagcauggguagacagaugguccaacauguggcaccuguggagaauagagcugguaguugcucacuagcucuccauuuuuuauuuuuuauacugaauuuugauuuuuuugagaucccuagauuaauaauauaagcacuucuaauaaagagaagaagaugacaaggaugccuacuauuaccauugcuacuuaauuucauaguagaaguaccagcaaaugcaguuauggaagagaaaauuauaaagauuagaaggaaauaaaauuaucacuggcaaaugauugcauuguauucagggauucaacugagaacacaauaggauucaguaagauagugggaggugaaaaacauagaaauaaauaacauguuaaauguauauauguguauauuguaacacacauauuugcugaacaaggaagaacuaaaaaguugaaggaguaagucuagaaaaggaugaccuuguugaauuuuucaggaaaacuccugaucuuacugcugcccaauaaugauuguuuauaauuuauggcuaauaauauucugaaguugaucaucuuuguaaauccuugucaguauucuggauuuuaaaaaaauuaaaauaaauuagaagaaauggaaucaucaggucaaagagagagaguuuaaagcuguuugauuauauuuacaaauuaaacuuaucaguguaugaaaguaacaguauguuuucuuuuaucuagauaguguuguuuuguuucaguuaauauuuauugcuacauuagaaaaugcuguauuaugaauauucaauaauucauuuaaagaaauguagaucuaauucauuuuauuuguucaauaauuaugggguuugaggcaauaguuuuuuaauuugauccucagaaaaaucuccugugaagaauaaaagguuuaagugaggucuagugauuucuagagacuggauuugaauuuauuauuuugauucuuaagauauggacugaauaccacagaggauucuguuuaaaaauagugaugaggagugugggaaauaagaucauauaaggcucugaugaacuuuuacuggguucuaaaaauguguuuagcuguuuuaaaauagaggguauuuugaaguggucagaaugugaguucgacuauauuguaaauagauacaugguugaacaaaauaaaauaagugggcugggugugguggcucacagcuguaauccuagcacuuuggaaggcugaggugggcagaucauaugaggucaggaguucaagacuagcccggccaaccuggugaaaaccugucucuacuaaaaauuaaaaaaaauuagccaggugugguggcucacgccuguagucccagcuacuugagaggcugagacuugagaauugcuugaacuagggaggcagagguugcagugaguugagaucgcaccacugcgcucuagccugggcaacagagaagacuuugucucaaaaaaaaaaaaaaaaaaaagugaauuaaguguaaaaaugaccaucaaaaccuagugagcuccuaugcaauuuuggcagcaugcugucucccuuuuuaaaguguguuuccaaaauagauuauguacuuuaucucuggaaagugaauauauaaccuacauaacucgugaaaaaacuaccauauuaccccuauagaguguacuaugcuuauuaccuggguggcaaaauaaccuguauaccaaacccccaugacaugcgauuuaccuguauaacaaaccugcacauguaccccugaaucuaaaauaaagguuaaaaaaaaauuccuggccgggugcaguggcucacgccuguaaucccaauacuuugugaggccgagaggggcggaucaccugaggucaggaguucaaguucagccuacauggcgaaacccugucucuauuaaaaauaauaaaaauuagccgggcgugguggcgggcgccuguaaucccagcuacucaggagucugaggcaggagaaucgcuugaacccgggaggcggagguugcagugaggcgagaucgcgccacugcacuccagccugggugacgagagugaaacuccaucucaaaaaaaaaaagaaaaaagaaacaaaaauccuuagagcaugcuaauaauaugcagaaaggcacaguggaagauauauuuuaauggugauacaagucuucauuuggaaugucuuauaauacagacuguuaacucaaaaaaaguagucacucaggaaguuuauaguggaaucuagaucaaauugaaguguuuucaguuagaacacaguaacgcuauguauucauccucucuuuccuuaguauagguuuuuaacuuuuaagauuauucacaguguaaaaauuuguuuuaagauaauucuuuaauucagagcauaaaccucuacucacagaaguaucuuuuugcagaggcaauugguuugaaagaugguuaacauuucucuacuauaagcucuuuugucuuugagcaagaguagugguggugcauuucuuuauuagagacauguagguuaagugauuagaaggcaggagucauugauuugaagagcuguuaacagaccauauuuaacaauagggucuggggugaggguauguauauguuaguguuuuauggacacucccuaccugauucuuuguuugguuuacuuauggcuguuauguuugugguuacauauuauuuauauuuuaagauacaaguagauaauuguucuuccaugccuaguucgauaggaugcuaagaaauguggcuuucuacauccuuugauauaucuuuaucaauuaaacuuuaaaagugggaaauagaagggaaguugucuccuuuuuaagguacagugaagaaagagaaucuuacuaguaaucuauaucugugugcuuucacuuuuaucuucuaguguaauauaaacucaacuccuaaagacccugauucaaggaaaacacuaucagugccugucucugaggccugaauuuuccaggccucggucuuggaauguggaggagaugaaagaaaacagacuugagaauaugcaaacaugaacccagaccuuucccagaagaacaucacccagaacucccacagcuccuaaaucucacuuuaacauguguuugaugcuuuaucugaguuuugggucaucuuaagggagugcagguauuagaaacuauuauauauaaguagaaaagagaugaaaaugccugccuggaagauaacuaugauccuuuuucucacuagggugauuuuauguuuauuuauguacuuacauuuuagagauggggucuuguucugucgcccaggcuggaguacaguaucauaguucccuugaagccccaaacuacuggacucaagcagcccucucgccucagccucccaaauaacugggggacuguaggcauaugccaccaugcucagcuaauuaaaaaaaaauuuuuuuuuuuggagaccggucuuacuauguugcccagguuggucucaaacuccuggccucaaacgaugccccugccuuagccuccugaguagcuaugauuauaagcaagagcuacugugacaaguuagacuagaaagguauauuugugagacuaguccuaaauaguuuuaaacagggagaaauuuaaguuauaacugucuaagaaagacuuuagauuguucuuuuuuuuuuuuuuugagauggagucucgcucacucugucacccagacuggagugcaguggcgcaaucuuggcucacugcaaccucugccuccuggguucaagcgacucucaugccucagccucccgaguagcugggauuacaggcgccugccaccacgcccagcuaauuuuuguauuuuuaguagagaugggguuucaccauguuggccaggcuggucugaaacuccugaccucaggugauugcccgcuuuggccucccaaagugcugggauugcaggugugagccaccuuacccggcugagauuguucuugaaauaguguucuauuuuuuaaaaaauuguuuucuuuuuauaucccugaaaacuuauucugucaaaauuuauauuuagccuauuaauuuucaguccacugauaauguucuucacucugccaacacacaugugugugcacauacucacacacuugaaaaauuuucuucuucccuguuugaggaaacucuggaaggaaucaagagaaaccaguaacaucuuggggaggaggagugccuguguuaugggguguggguaauagggggcagagacuggggggaacugaugaccauauaguuuuuaauauuacuaaaaaauuaaaccauuugaauauauuaccuauauaaaacauuaaaauaaggggguccaugauuauugccuuaaguaauauguguucauuguggaguaagcggauaauauaggaaagcacaaggaagaaaaaaaaucacucgcaauuucaaccagccgagagauaacaucucuguuacauuauuauuacagauuaucucugugaaugaaaauauguauuuaauagaaaauuguauaucuugacaaaacaauuuauaaugucuaauaaccugccuuuuaaaauuuaacaauguaaguaauuuuucaaauucuuaaguauuugcuuucauuauuuuucguggauauauagugcucuauuauauuaaaaugcuuuaaccaguucacucuuguuagauacauaggcuguccuaauuuucuuugaugaaauuucuuguagguaaaucuacacacauccauaaugauuucuagguguagaauugcuggguugaaggcacauaguuauuuuugagacauuaucuacugucuagucagauugcuuccuggaaggguugugcucauuugcacucacuaugguggaugagaggcuacaugaaauagugcccaggugaccagccauggaauauaggacaacucccaguuccaugguuuuggggagaaaaucuggggcaugaaaacuaguuuuuucucuuacucaguaugugauuugcaucaggcuguaguagguauuugugucaguuaagucuggaauauuuggauauuggauuucugggcuggacagugauggaugaacuguuuacugcuguagguugaagaauuuucuacugaaagaaaauugaauuguuuuuugcuacuggcaggccuaguguucuguuaauggaaggaugcagaccggagcuguuccuauucggccaucuugccagccuagauugaaagauuaaagauugcuagauugaaauaggcuuaaaaguagauguccaacugaauuuauuaaaagaugagagauggcacaguagcccgcgcacuugaaaucucaagaaaauauugcauagcauuuaaaaaauauuugcugaacauuuuauuuaaacauggaaagguauuuugcugccacacugauaguucagugaauugcacuuuuggaucuuggagaauggagagaagcagcuaggcaaauaauuggcaagaaaaguaaacaguuacagugcagcuuuguuuacccacucugccuaucugcguuucugaaauuggauuccuuggcucugugaacuaguuagccuuccuuuagagugcuuggaauugaaagcaugucagagagaacacagucacguauaucuuaguuggauguguguguccugucacuguuaggacuugguggcauaaaggaauuaauaaugagaagugagcugggaaugguuuaucaguggaaauaucuggaauagguuuuuaggucuauuugugucauggacauuucgaagucucauagucacaauguuaacauuuuuuauuuguggaacaaagacuucuuuauuuaauagauagaaccuugauuaugagaaagaucuaauuuuacucugaagguucuuuuaaagaguacuaccucugaggagcaucuguuuuguaaaauuugggggacauuguuucaccuaauuuuugguuauaaucugcuaauaaauuuuacauuuuauuauaagaaugaaucaggcacuggaauauggggauacuuuuuucucuaauuuuaacaguuuugcaagagucauuuauuugggaaaagugagggaaauaagggcaaaauuuagcaugucauccuuguuacugagggagcagaggaaguguuuuaagaagucacaugauggcuggcaagauggccgaauaggaacagcuccggucugcagcugccagugagaucaacguggaaggcgggugauuucugcauuuccaacugagguacccagcucaucucauuggggcugguuagacaaugggugcagcucauggagggcaagccgaagcagaguaaggcaucgccucauccgggaagcacaaggggucggggaacucccuccccuagccaagagaagccaugagggacugugcugugaggaacggugcauuccggcccagauacuacgcuuuucccauggucuucgccaccugcagaccaggagauucccucgggugccuacgccacaagggcccuggguuucaagcacaaaacuggguggccguuugggcaggcaaugagcuggcugcaggaagcccagggggccaaguggucuagcucaguggaucucacucccauggagcccagcaagcuaagauccacuagcuugaaauucuugcugccagcacagcagucugaagccgaccugggacgcucaggcuuggugaggggaggggcguccgccguuacugaggcuugaguaggcgguuuuccccucacaguauaaacaaagccgccaggaaguucggacugggcagagcccaugucauaaugacaggaucaaauucacacauauaauauuaaccuuaaauguaaacgggcuaaaugucccaauuaaaagacacagacuggcaaguuggauaaaaagucaagacaccucggugugcuguauuuaggagacccaucucacggacaaagacacacgcaggcucaaaauaaagggagggaggaauauuuaccaagcaauuggaacguuaaaaaaaaaagcagggguuggccaggcacaguggcucacacuuguaaucccagcacauugggaggccaaggcgggugguucaccggaggcugggaguucgagaccagccugaccaacauggaguaacccugucucuacuaaaaauucaaaaauuagccgggugagguugcgcaugccuguaaucccagcuacuugggaggcugaggcaagaaaaucucuugaauccaggaugcagagacugaggugagccaagaucaugccauugcacuccagccugggcaacaagagugaaacucugucucaaaaaaaaaaaaaaaaaaaaaaaaaaaaaaaaaaaaaaagcagggguugcaauccuaggcucugauaaaacagacuuuaaaccaacaaagaucaaaaaagacaaagaagggcaugguaaagggaucaacgcaacaagaagagcuaaccuaaauauauaugcacccaaaauaggagcacccagauucauaaagcaaguucuuagagaccuacaaagagacuuagacucccacacauuaauagugggagacuuuaacaccccacugucaauauuagaaagaucaaugagacagaaaauugacaaggauauuuaggacuugaacucagcucuggaccaagcagaccuaauagacaucuacagaacucuccaccccagaucagcagaauauacauucuucucaucacuacaucacacuuuaaaauugaccacauaauuggaaguaaaacacuccucagcaaaugugaaagaacagaagucauaacaaacagucucucagaccacagugcaaucaaauuagagcucaggauuaaaaaacucacucagaauagcacaacuacaugggaacugaacaaccugguccugaaugacuacuggguaaauaaugaaauuaaggcagaaaucaguaaguucuuugaaaccaaugagaucaaagacacaauauaccagaaucucugggacacagcuaagcaguguuuagagggaaauuuauagcacuaaaugcccacaggagaaagcaggaaagaucuaaaaucgacacccuaacgucacgauuaaaagaacuagagaagcaagagcaaucaaauucaaaagcuagcagaagaaauaacuaacaacagagcagaacugaaggagauagaaacaugaaaaacccuucaaaaaaucaaugaauccaggagcugauuuuuuguaaagagcuccugaaggaagcucuauuuuaacaaaauagauagaccacuagccaggcuaauaaagaagaaaauagagaauaaucaaauagacaauaaaaaaugauaaaauggaaaucaccacugaucccacagaaauacaaacuaccaucagaaaauauuguaaacaccucuacacaaauaaacuagaaaauuuagaagaaauggauaaauuccuggacacauauacccucccaagacuaaaccaggaagaagucaaauccuugaauagaccaacaacaaguucugaaauugaggcaguaauuaauagccuaccaaugaaaaaaagcccaggaccagacagauucacagccgaauucuaccagagguacaaagaggagcugguaccauuccuucugaaacuauuacaaacaauaggaaaagagggacgccucccuaacucauuuuaugaggccagcaucauccuguuaccaaaaccuggcagagacacaacaacaacaacaaaagaaaauuucaggccacugucccugaugaacaucaaugcgaaaauccucaauaaaauaccagcaaacugaauccagcggcacaucagaaagcucauccaccacaaucaaaucagcuucaucccuggauugcaaggcugguucaacauacgcaaaucaauaaacguaauccaucagcuaaacagaaccaaugacaaaaaccacaugauuaucucaauagaugcagaaaaggccuuugauaaaauucaacagcccuucauguuaaaaacucucaauaaacuagguauugauagaaaacaucucaaaauaauaagagcuauuuaugacaaacccacagccaauaucauacugaaugggcaaaagcuggaagcauucccuuugaauacuggcacaaaacaaggaugccgucucucaccacuccuauucagcauaguauuggaaguucuggccagcgcaaucaggcaagagaaagaaauaaagcauauucauaugggaagagaggaagucagauugccucuguuugcagaugacaugauuguauauuuagaaaaccccaucaucucagcccaaaaucuccuuaagcugauaaguaacuucagcaaagucucaggauacaaagucaaugugcaaaaaucacaagcauuccuauacaccaauaacagagagccaaaucaugagugaacucccauucacaauugcuacaaagagaauaaaauaccugggaauacaacucacaagggauguggaggaccucuugaaggagaacuacaaaccacagcucaaggaaguaagagaggacacaaacaaauggaaaaacauuucaugcucauggauaggaagaaucaauaucaugaaaauggccauacugcucaaaguaauuuauagauucagugguauccccaucaagcuaccugaaaaagagcccguauagccaagacauuccuaagcaaaaagaacgaagccggaggcaucacgcuaccugacuucaaacuauacuacaaggcuacaguaaccaaaacaacauggugcugcuacugaaacagauauauagaccuauggaacagaacagaggcgucagaauuaacaacacacauccacaaccaucuuaucuuugauaaaccugacaaaaacaagcaauagggaaaggauucccuauuuaauaaaugguguugggaaaacuggcuagccauaugcagaaaacugaaccuggacccuuccuuacaccuuauacagaaauuaacucaagauggauuaaagacuuaaacguguaaaaccuaaaaccauaaaaacccuagaagaaaaccuaggcaguaccaugcaggacauaggcaugggcaaaaacuucaaacuaaaacaccaaaagcaguggccacaaaagccagaauugacaaaugggaucuaauuaaacuaaagagcuucugcacaguaaaagaaacuaucaucagagcgaacaggcaauguacaaaauguacaauguacagaaaauuuuugcaauguauccaucuggcaaagagcuaauauccagaauguauaagaaacuuaaacaaauuuuccagaaaaaaacaaccccaucaaaaagugggugaaggauaugaacagacacuucucaaaagcagacauuuauauggccagcaaacacaugaaaaaaagcgcaucaucacugguuauuagagaaaugcaaaucaaaaccacaaugagauaccaucucacaccaguuagaauggccauuauuaaaaagucaggaaacaacaggugcuggagaggauguggagaaauaggaaugcuuuuuuugguggggguguaaauugguucaaccauuguggaagacaguguggugauuuccucaaagaucuagaaccagaaauaucauuugacccagcaaucccauuacugcguauauacccaaaggauuauaagucauucuacuauaaagacacaugcacacauauguuuauugcagcacuguucacaauagcaaagacuuggaaccaacccaaaugcccaucaaugauagacuggauaaggaaaauguagcacauauacaccauggaauacuaugcagccauaaaauaggaugaguucauguccuuugcagggacauagaugaagcuggaaaccaucauucuuagcaaacuaacacaggaacagaaaaccaaacacugcauguucuuccucauaagugggaguugaacaaugguaacacauggacacagggaggggaacaucacauacuggcgccuguugggagggugagggacuaggggagggauaccauuaggagaaauaucuaauguagaugauguguugaugggugcagcaaaccaccauggcauguguauacuuacguaacaaaccugcacguucugcacauguaucccagaacuuaaaguauuuaaaaaaaaaaaaagucaucugucagguuuuaggucguuuuuguucacgugugucauaagcuugcuaugguggauauuggcuagauacucuuccuucucaccucuuuucucauucacuuggguuuuucucuugugaaguauuuccuugcgguuaucaguguaggcacaaugaaaaguaacuuuuaguaauucauucaaauuuuaaaguucugucaucugcuuaacuaaauuuuuguuuuuguuuuucagcauugguuggaugguacaaaaagcaucaaaaagcaaguaaaaaguaagugcagacaaaauuauuugugggggggaaaggaaauagaauauauuagaaauucugauuucuaauaggauguaagaaaucauguuucagaugaguuuuuuagcauuuccauuuucuagaaauuauuuuauucugauacacugagcuacuccccaagucauguaggcuugauacuaaucuagauuaaacugcauuggggcuuaacuuuccaggagaaaaccuugcagcuugcaaaugggauugacuuuccccgaaaugcuuaaugguuauuuuuuaauuaguuguguuggaauuuuccuguuuggcaucugcccuaauauugaaaguauuuugagacuuugugauauuuuaaaauuaagaaaaaugaaacaauucacauaaaauguuagugucauucagagagagaauaccauuguuuauucauuauccaacuugacuuuuuaucagacuuauuagggcaccucaacucuugucucaaaauaaugagaccacugagauuauagaaguuagugaacuugcugaauuguauuugugugggaagauucaccaugagcaguuaauaacauaggcauucuucaguguagcagguuuucagggcuguuagguugcacagucaagacuuuuauuugaugcauuuggcucugaacuguuagaauuaaucuauagcugucuauucuugggaugagaguuaauaguaauaugauggcuugguacauuaaaaaacaaucuaauugaagccuaugaucuaaccugcaauaaugccauaaaaaccucaucuuuugucucacuucaguagauuuuugaccaguuuucuggcugaaaaguauuauuuaaguaguuuauuuuauuaaaaccuuuuuuuuuuuuaaaugacaguugguucacccuauugucugcaucuucgaguuaaguuuuauuccucagaaccaaauaaccuucgugaggagcuaacccgguaagaacaccaucuagaauugugccaggguuauuuugauaguuuugaaagacugucuuuauauuguuuccaauuuauagccagcuaauaaaauggauuccuguccccugguaacaagaccucaaauaauagaauuuuauucugggacguguuuuuuaaguguaugauucuuuuccuuuagcauuuucaaaauaaagaguugguuucuuagcauccuccaaaggugacuagugaguucuuuuuuuuaaguaucacucucaacucaggaauguuaacaggauucacauguuucaauacauugcaauauuauauuuauugauguugaaaauaaucuaucuuuggccacagggaguuuauucaaauuggcgcccaacuuucuuuacucauugaaaugccauugauuaaugaaaaacauuagauucugauugguuugaauaguuuugaauaaaccuuauguuguauauacuuauuuuaauguuauccugccuccuuuguauuuauucauggucucuauuauaaauucauugcuccauauacacauacuauuuauuaaaugaaaaaguugagcuuuugaguuccuuuagaaggguuuccuuuagaacaccuugacaaugagauaguagcuaucaucuguaguuauauccaugucuguaucccuucacauaacaaguagaugucucgcucugucaucuaggcuggagugcaauggcauguucucaguucaccgcaaccucuguucccccagguucaagcaguucucaugccucagccucccaaauagcugggauuacaggcacgugcucacacccccagccaauuugcguauuuuaauagagacgggguuucgccauguuggccaggcuggucuugaacuccuggccucaagugauccacccgccucgcccucccaaagugcuaggauuauaggugugagccacugcaccaggccuuuaauuaagaauacuucuaagaucuaguguuagaucaguagggugauuauaguuuacaauuacguauuuuacauuucagaauagcuagaagaaaauaauucaaauauuucuagcauaaagaagagaaaaauauuuaaggugauggauaccccacguauacugacuugauccuuacaaauuauaugaauguauucaauuauuucauguauccccaaacuaugcacaucuuuuauacauuaauacaaguaauuuuuaaugaaauaauacuucucaaguuagaaguguaagauuuuuuuucacagucgauugugcuguuggguuaaauuugugccuuucauuuuucuuagguauuuauuuguucuucaguuaaaacaagauauucucaguggaaagugaguauuaguuauuuaaggauaaaugcacauuuucgugagugguugaaaaauuauuuugaaaauaaguuuauaguuguaaaaaagaaauggucaacauaaaacauguauuauuuucauuugucuuaaaaugaagguuaugaaaucaacuugucuaacaaacuuguguuuuggucucagauuagacugucccuuugauacagcagugcaauuggcagcuuauaaucugcaagguaagcaauucuuauguugacuguuaagacucaaguauaaucuuuuuuguguguguuuuuaguuaaagaagauucuaauuaugugcaagaaaagaaacaacacuguuuuuguauaaacuuguaucaggguccaacucugacuuuuacuuguuuuagaacauugccuucuuuuucuucucuuucauguaauugcgcccuuuccaccuaaaguguugaaacgucauacucuaccugauaagucuguaaaugcuaagauugggccuucggcuaacuuuuuccuuaaaagaaaugcaguuauguaggagugaauuguuggugaagccauauagcuuagcaguccuuuugcuccaaaccuacauuuuguucagaaauaaccacagaugaguacauacauguuugugcauuguucagauuuuucccugcugcuuucuccccccgauuuuuuuuaguuccuuucaguuauuucuuuaggauuaauaauuuuaaaauuuuggaagacagggacuauauuuagauugguauauggggucauauucaguguauaucaguauauucuuuuguuuuguuuuuuuuugagacagggucucacucuuguccccaggcuagagggcaguugcaugauuguagcucucugaagccuugaacuacugggcucaaacgaucuuccugccugaguagcugggucuacaggccauuaggccuggcuaauuuuuguacuuuuuuuuuuuuuuuuuuuuuuuuuuagagacgaggucuugcuauguugccuagacuggccugaaaccaucuuccaccucagcccucccaaaguacugugacuauaagcaugaaccaccacacccagccuuaguaauauucuuaauagaugccaguuaauugucuuuuaacgauugcuaaauuuuuucauuuauucacuauaaggucagagguauuucuuuauggaagucuagaaagcaguuuucaaagguuaaguaagcacugaagugugaauacauuaagagaaagauauguaauuaaaaauacacuaccaaaaauaaauaugagauauauguguaugacuaauaugccagauuuacuuuuggagacuugucugaguauuaugaauuuuuguaagaaauuccuaagaaucuuucuaaucuuagcaguuuucauuaaugaaaugguuuuugaaggauuuagcaggaaauacauauaacuuuugaaacuuauguuuauagcugaacuuggugacuaugaucuugcugagcauaguccugaacuugucucagaguucagauucgugccuauucagacugaagagauggaacuggcuauuuuugagaaauggaaggaauacagguaucuggcguuugaccauacuuucuuuaaaaucaccacaacaguuauuucauauucauuuucuucuguuucuauccuugguauagaauuuauuuuauauuuauuguuacuuuaaaaaucauuguuuuaaauuucagaggucaaacaccagcacaggcugaaaccaauuaucugaauaaagccaaauggcuagaaauguaugggguugauaugcauguggucaagguaagcauuguguugugaugcuuuuuuaaaaauuuauucuuuggagguucgcagugacuguggaauuuuucaguaugagggagggcauggaguuugcauaagcuagcacuggguacuuuggauguaugguuaaaaaguuugagauuaaauaccaaaugacuagaaucucacagaaagguucauuauaagaaagaagagaagcaaccaacaucccuaacaagguacuugguccuuuuaagcuguuauuuuauuuuauuuuauuuuuuugcuauaaaaaauuguuuuaagcuuuugagccauuuguuauccuuuuuacuuccuguuauacgacuuacacugaguaggcucuguuaaaauaauucaggaugcaaaguugaagauuuauagcuuaaagacuuugauaaacuuuagaacagcuuuguagugauuuaaguuauuucuaguuuaacuaguaacauuuuuccagaaaggcgguuguauuaguucauucucgcacugcuauaaagacauaaauuuauaaagagguucaauuggcucaugguuuugcaggcuguacaggcuucucccucucaggaggccucaggaaacuuauaaucauugggcaacgugaagggcaaacaggcacaucuguacauggcuggcaggagggagagagagcaaagagggaggugcuacacacuuucagacaaccagaucuugugagaacucauucacuaucaugagaacagcaagggggaaguccgucuccaugauucagucaccucccaccaggccccuccuccaauacuggggauuacaauaugacacaagauuuggguguagacauagagccaaaccguaucagcagucuuuuccaaaauacaugauuuaagugguaaguauaauaugggaagaauguggaaacagcuuuguuuguagugggaguguaacuacccacuuucaaugaagauacacuuuaaaacucuaguguuucaaugacuagaaauaaaaauauaugcauaaauuuuucugagaauauuauuauggauacucuaauuguugaaaacaucucauauauuaauauuagccuguauauaauuaauacaauucaauacaaaaauaaaauuuaaaaguugugucaaugugaaaccuguuuuguacaaauaaagcuaacacauuuuucuccccuuaaauuaggcuagagaugggaaugacuauaguuugggacuaacaccaacaggaguccuuguuuuugaaggagauaccaaaauuggcuuauuuuuuugguaagcaagaguuauugucaaagauacuuacuguuguuuugguuuuuaaugaguaaauaaaguuaauacauaaacaaguuuggaaaucaaauaguuuugaaaaacuugucaaugaaagcaacugucuccugucacacuauuacgcaucauuauuccuacucuccagaggcaauuauuaaaacucuucuagcuguauuucccauuaguuucaaaguauaccacaaucuauaucuugauauaaauauuuauauuuuuauauguaucagauguucacaugggcacuuucucccuccauguagucaugucauugcuuuuaauauuuauuauuccacaaucccuuuacccccuauuguguaagaggaagauacuaauauuuuuaucccuucucuaagcugugcuccuuauacuguuccagcuuuuaucguucauacuuuuaaauuacauuuauguuuuacuuuuacaucaaggauagauuuuacuuggauuucuuggccauaauugaguccaucagauuuugucugguauucuaaaagcugagaaucaggguacuguuuacaauaagaugucucuaucagaauaguacagagccuagguguuuacuuuuguacacuagacagggacuguuagcgcaaagaccucuggcaucaaacucaaauucugacacauccaguuacuuuaaacauagcccacuacguauauuuuuagccauuucugcuuuauauaucccaugaaacugcacccuaacaucuacuggccauagauaaggcaagcucuguagauuaaaggaccccaaaaccacugcugccuuucugaauucucugacucagaucccucacacuuaacugcugaaugccauccccuaggcacuuaagcccccucucagguuccccucuuuacugagaguuuccuugcccuccuccccaucuggugguagccuugcagcugcugucucuggaaggucaccugcuaugaaggaccaccccuaucaggcaacccuuuccaaacacugcucgauaaagccuguucugugguacauuuucuugaucagcucggaaguccuggaacucacaacugguauuacauuuccuuucuuuuuagcuauuuguuuuuguucuagaguucuuggcuuccccaucucacauaccccacacaucccuuuaaauuaccugccuuugucuucuccucaagcuuuuuuaaguuaucaaggguuacauuaaaugguccuucuguucccuguggaacuguuugcugcacagguugcuuuccagcuuuuaucuugagacuucccuuuccuguguucucagcuaggguccugcgugguccucccaugguuuccuuuuucuuuguccucccugcccccgcuaacugccuaaguaaagaaaguaacugccuaagaaaaguaauuuguuugaaugcuuaaaugccuuaaaaugauuuuuuugucuuuuauucuuucuugauaauuaggcugaggauagaauuuuagguugaaaauuauuucccucaaaaaauugaaaguaguauuucuuuuuuuuuuuuuauuauacuuuaaguucuaggguacaugugcaaagugugcagguuuguuacguauguauacaugcgccaaguuggugugcugcaccgauuaacucgucauuuacauuagguauaucuccuaaugcuaucccucccccucccccaaccccacgacaggccccggugugugauguuccccuuccuguguccaaguguucucauuguucaguucccaccgacgacugagaacaugcgguguuugguuuuuuguccuugcaauaguuugcugagaaugaugauuuccagcuucauccaugucccuacaaaggauaugaacucauccuuuuuuauggcugcauaguauuccaugguguauaugugccacauuuucuuaauccagucuaucauugauggacauugggguugguuccaagucuuugcuauugugaauagugccgcaguaaacauacgugugcaugugucuuuauagcagcaugauuuauaauccuuuggguauauacccaguaaugggauggcugggucagaugguauuucuaguucuagauccuugaggaaucgccacacugucuuccauaaugguugcacuaguuuacagucccaccaacagugcaaaaguguuccugugucuccacauucuguccagcaccuucuguuuccugacuuuuuaaugauggccauucuaacuggugugagauguaucucauugugguuuugauuugcauuucucugauggccagugaugaugagcauuuuuucaugugucuguuggcugcauaaaugucuucuuuugcgaaaugucuguucauauccuuugcccacuuuuuggugggguuguuuguuuuuuuuucuuguaaauuuguuugaguucuuuguagauucuagauauuagcacuuugucagauggguagauugcaaaacuuuucucucauucuguagguugccuguucacucugauguaguuucuuuugcugugcagaagcucuuuaguuuaauuagaucccauuugucaauuuuggcuuuuguugccauugcuuuugguguuuuagacaugaagucuuugcccaugccuauguccugaaugguauugccuagguuuucuucuaggguuuuuaugguuuuaggucuaacauuuaagucuuuaauccaucuugaauugauuuuuguauaagguguaaggaagggauccaguuucagcuuucuacauacggcuagccaguuuucccggcaccauuuauuaaauagggaauccuuuccccauuucuuguuuuugucagguuugucaaagauuggaugguuguagaugugugguauuauuuccgagggcucuguucuguuccauuggucuauaucucuguuuugguaccaguaccaugcuguuuugguuacuguagccuuguaauauaguuugaagucagguagcguaaugccuucagcuuuguucuuuuugcuuaggauuguuuuggcuauaugggcucuuuuuugguuccguaugaacuuuaaaguaguuuuuuccaauucugugaagaaagucauuguuagcuugauggggauggcauugaaucuauaaauuaccuugggcaguauggcuauuuucaugauauugauucuuccuauccaugagcauggaauguucuuccauuuguuuguguccucuuuuauuuuguugagcagugguuuguaguccuccuugaagagguccuucacaucccuuguaaguuggauuccuagguauuuuauucucuuugaagcaauugugaaugggaguucacucaugauuuggcucucuguuugucuguuauugguguauaagaaugcuugugauuuuugcacauugauuuuguauacugagacuuugcugaaguuccuuaucagcuuaaggagauuuugggcugagaugaugggguuuucuaaauauacaaucgugucaucugugaacagggacaguuugacuuccucuuuuccuaauugaauagccuuuauuucuuucuccugccugauugcccuggccagaacuuccaacacuauguugaauaggaguggugagagagggcaucccugucuugugccaguuuucaaagggaacgcuuccaguuuuugcccuuucaguaugauauuggcuguggguuugucauaaauagcucuuauuauuuugagauacaucccaucaauaccuaauuuauugagaguuuuuaccaugaaggcuguugaauuuuaucaaaggcuuuuucugcaucuauugagauaaucgugguuuuugucauuaguucuguuuauaugcuggauuacauuuauugauuggcauauguugaaccagccuugcgucccagggaugaagcccacuugaucuuggggguaagcuuuuugaugugcuccuggauucgguuugccaguauuuuauugaggauuuuugcaucgauguucaucagggauauuggucuaaaauucucuuuuuuuguugugucucugccaggcuuugguauaggaugaugcuggccucauaaaaugcguuagggaagauucccucuuuuucuaucaguuagaauaguuucagaaggaaugguaccagcuccuccuuguaccucugguagaauuuggcuaugaauccaucugguccuggacuuuuuuugguugguagacuauuaauuauugccucaauuuuagagccuguuauuggucuauucagggauucaacugcuuccugguuuagucuugggaggguguauguguccaggaauuuauccgucuauucuagauuuuuuguuuauuugcauagagguguuuauuguauucucugaugguaguuuguauuucugugggaucggugguaauauccccuuuaucauuuuuuauugcuucuauuugauucuucucucuugucuucuuuauuagucuugcuagcagucuaucaauuuuguugaucuuuucaaaaaacaaccagcuccuggauugauuuuuuugaaggguuuuuugugucucuaucuccuucaguucugcugugaucuuaguuauuuccugccuucugcuagcuuuugaauguguuugcccuugcuucucuaguucuuuuaauugugauguuagggugucaguuuuagaucuuuccugcuuucucuuguggacauuuagugcuauaaauuucccccuacacacugcuuuaaaugugucccagagauugugguauguugugucuuuguucucauugguuucaaagaacaucuuuauuucugccuucauuucauuauguacccaguagucauucaggagcaaguuguucauuuuccauguaguugagugguuuugaguguuucuuaauccugaguucuaguuugauagcacuguggucugagagacaguuuguuauaauuucuguucuuuuacauuugcugaggaguguuuuacuuccaacuauguggucaguuuuggaauaagugcaauguggugcugagaagaauguauauucugcugauuugggguggagaguucuguagaugucuuauuaguuccgcuugaugcagagcugaguucaauuccuggauauccuuguuaacuuucugucucgaucugucuaauguugacagugggguguuaaagucucccacauuauugugugggagucugagucucuuuguaggucucuaagcacuugcuuuaugaaucugggugcuccuguauugggugcacauauauuuaggauaguuagcucuucuuguugaauugaucucuuuaccauuauguaauggccuucuuugucucuuuugaucuuuguugguuucaggucuguuuuaucagagacuaggauugcaaccucugccuuuuuuuguuuuccauuugcuugguagaucuuccuccaucccuuuauuuugagccuaugugugucucugcacgugagaugggucuccugaauacagcacacuggugggucuugacucuuuauccaauuugccagucugugucuuuuaauuggagcauuuagcccauuuacauuuaagguuaauauugucauaugugaauuugauccugucauuugauccugucacagcuaacaugcugugauguuagcugguuauuuugcucauuaguugaugcaguuucuuccuagcaucgauggucuuuacaauuuggcaugguuuugcaguggcugguaccaguuguuccuuuccguguuuagugcauccuucaggagcucuuguaaggcaugccucguggugacaaaaucucucagcauuugcuugucuguaaacuauuuuauuucuccuucacuuaugaagcuuaguuugguuggaugugaaauucuggguugaaaauucuuuucucuaagaauguugaguauuggccccuagucucuucuggcuuguagaguuucugccgagagaucugcuguuagucugaugggcuucccuuuguggguaacccgaccuuucucucuggcugcccuuaacauuuuuuccuucauuuccacuuuggugaaucugacaaucaugugucuuggaguugcucuucuggaggaguaucuuugugguguucucuguauuuccugaauuugaauguuggccugccucgcuaaguuggggaaguucuccuggauaauauccugcagaguguuuuccaacuugguuccauucuccccuugacuuucagguacaccaaucagacguagauuuggucucuuuacguagucccauauuucuuggaggcuuuguucguuccuuuuuacucuuuuuuucucuaaacuucucuucugacuucauuucauucauuugaucuucaaucacugauacccuuucuuccaguugaucaaaucagcuacugaagcuugugcaugcaucacgucguucucaugccaugguuuucagcuccaucaggucauuuaaggacuugucuacacuaguuauucuaguuagccguuugucuaaucuuuuuucaagguuuuuagcuucuuugugauggguucgaacuuccuccuuuagcucagagaaguuugaucaucugaagccuucucucaacucgucaaagugauucuccguccagcuuuguuccauugcuggcgaggagcuauguuccuuuggaggggagaggcgcucugauuuuuagaauuuucagcuuuucugcucuguuuuuuccccgucuuugugguuuuaucuaccuuuggucuuugaugauggugauguacggaugggguuucgaugcggauguccuuucuguuuguuaguuuuccuuccaacagcugcaggucuguuggaguuugcuggagguccacuccagacccuguuugccuggguaucaccaguggaggcugcagaacagcgaauauugcugaacagcaaauguugcugccugauuguuccucuugaagcuucgucucagagggguacccagccgugugagaugucagugugccacuacuggagggugccucccaguuaggcuacuugggggucagggacccacuugaggaggcagucuguccguucucagaucucaaacuccgugcugagagaaccacugcucucgaagguaguauuucauuuaguuuugcaucuggguguucuugcuagggacucucugagagacuugaguugaacaccuuuacgguugucccuugaugcgugaagaaccucaggcaauuaucuuccaauuuuuuggguguuaaauccccucauaccuccagcuuguccugugggcaaauguaacaugcuuccuggccuaagaaugcuuuaggcagagagauaaagaaagcuccuuuucugccuuuuuauaagguugucuugagaguuaauuaauacuuguaaagcacuuagaagaauacuuagggcagaccagguggcucacuccuguaauccccaccaaggcaggggcucaccugaggucaggaguucaagaccagccuggccaacauggugaaaaccugucucuacuaaaaauacuaagauuagccaggcauagcaugguggcacgcaccuguaaucccagcuacucuggaggcugaggcaggagaauugcuugaaccugggagguggagguuguagugagccaagaucacgccacugcacuccagccuuugugacagagugagauucuguuuccuuucuuuuuccugcuauuauuucuucauuauuguuuuaguaaagcucuuguaaaguuauguuuuacaucuauuuuauauguuauauuuaaagauuagucaaucggagugucacauuguuucgacauucacaauuuauggaaauacagaguucaaaugugugguaggugguuuggaauuuacaaguagggagauacaguuggaaagcgggccauaaagcgagguuaaaaaaauuaagaaguauuuccucuacccaaaauuccuguugaaaacagaguugaggcugguugcaguggcucacgucugaauuccaacacuuugggagaccaggguaugcggaucacuugagcccaggaauuugagaccagccugggcaacguagcgagaugccgucucuacaaagaauacaaaaauuagccugguguggugugggaguaaggcugaggcaggaggauuacuggagccuggaaguucacggcugcagugagcugugaacacacuacugcaguccacccuguguaauggagggagaaccuaucucaaacaaacaaaaagaguugaaaaccaucgucaguguuuuucuuuauggcuguuuuuuuuaagcuuuauggucguuccuaugucuaguuccuaugcugcugcucugcuuuaacacuggaacaauuuucccuagaccuaaagaaucucuuacaccauaaucgagaccuaucaaauacauagauuucauuuuccuuaacauuuuuaaugucugauaugugcaaccucaauuuugucugagauuugcuuuugaaauauguacuguguuuuucuguuuccugucuuuugaugggcauugcaaguuacguuuaccguccugucaauuuuuaguucaggaguuagaugguuaaauguauuugaaauaaaaacaauuuuuuucauauuuagagaacauuuguuuguaauuuggcuuuuauucucuuauuauauuauaggccgaagauaaccagauuggauuuuaagaagaauaaauuaaccuuggugguuguagaagaugaugaucagguaggaauaaaauuauauucuauuacuuguguaacagugacuguauuaugugguaacuuauuucucuaaaagagggaauguaccucauuguuuuaaagagccacagaaugcaaacaguauaauuaaugcuuuaaauaauuuccuuacuugggucauaccaugcuaaaaauaugguuuucugcccuuaggaugaaaaauaauauaaaagugucuucuuguuuccucauugaucguauaucugagguguauaaaaaauuacauuuaagugagccagccagucacccaggcuggagggcaguggcacugucauagcucacuguaaccuucaccuucugggcucaagugauccuccugcucacucagccuccugaguagcugggacugcaggcacaugccaccaccacgccuggcugauuuuuucauuuauuuguagagaugggaucucaguauguugccaagguugcucucaaacucuuggccuuaaguaauccucccaucuuagcuucucagcauguugagauuacaggaguaaaccauuguggcagaccaacuuuaucucuuuauuaacugaucaaaaagaucuaccuaauaauaauaaagccuuuugaauuaaagauuaccuuuguaucaguuacagugugguucuuaauugauacaugcuuggaugcaacucacaugcauuguucuuaaugcaagaagccagauuuaaaaaauuauguauugaaugacuccauuuaucugauacuuuagaaaaggcaagaagaauuuuacuuuaugcaaauuaauaaauuuuaacauaugcauacagauacagauaaaagcaguuugagcaaaauguuaacaguuguugagucuagacacuauguauauggguauucaguuuuucuguauguuuaaacauuuuuauaacgaugaaaauuuuuuuuuugaauccaguucuuucauuuuccucugcucaguaauuugacugcuauacuuuuccuguuuuaaacacacaaugggauacuaugcagccauaaaaaagaaugagaucuuuuuugcgggaccauggauggagcuggaggauauuauccuuagcaaaguaaugcaagaagagaaaaccaaauacuacaugcucuuacuuacaagugggagcuaaaugauaagaacuuaugaacacaaagaaggcaacagcggacacugggaucuacuugaguggggagggugggaagagggagaagaguagaaaagauaacuaacugaaagauaacuggacuuaauaccugggugaugaaauaacaugugcaauaaaccaccaugacacguguuuaccuauguaacaaaccuucucuuguaccccaaacccaaaauaaaaguuaaaaaauaaaaaagagugcugcucugaacacuaagguguauguauauuuagcuuuuguagguacugccaaaccucuuuccaaaguauuuaauacgaguuuauacucccaccagcaauguuauugguguuuuuuuucuuuuuugcuaauguuuggaauucugucuuuuucauuguagccauucuuguggaguagaaugugguuuuaguuuguguuccccuaaugacaacucugguuuaguacuuaucuguguaguuauuggauauguggauaucuucuuuaugaaaugccuacucaaaucuuuugcuuauuuuucuauuaggucaugugccuuuuagucauugaaaaaauucuuuguauguucuggauauuaauucucugucagauauuaguguugcaaguaucgucuacuccuuguuuugcccuuuuuccaccacuuuuauuuuuagaugacauauaauaauuguacauauuuauugcauacagagugauauuuugauacauguauacaauguguaauuaucaaaucaggguaauuagcguauccaucuuuacugucuuaauagugucuuuaaauaaccugaaaaguaccaaaaauuauaaaauagauaaccaucuuauuaaugaucuagauuuaacauuuuuuacauuuugcuucaguucucuuuuagagaaagauaaauacaauuaugugcaugaauaaauaauaccaacuaaagucuaacccccugacuaccuacccccuuucuucugguaccuggucaccaauuuuggaggguauuauucucauauauauuuuguaacuuuuuccaaauauuaacucauguuagaauuguuuuaaaaacuugcauaauuauauauauuugcagcuugccuguuuuaucuaaacguguaccuauguagaucuaacauauauauaugcuauuguguaauaugaauaaacaauagcacauucauucauucaucauuuauucauuuaucccucugcauaauuuuuuacauaugccucuauuuacuugaccauuucucuuuuuuuggacguuuaggguuuguaccaaguuuuacuauuauaaaugagacugaggaaauauacaucuucauauauaacuuuugauguuuaggaaauaauuuuccccagagaggcaguauaacuuaguuguuagagguguauguagauucuggagcaagacuaauguuuaaguucauuuccgguuuucuuucuuaauagcuuugugauuuugggcuuaauuucuuugagccucaguuuccuuaucuaugaaauggggcuaaugauaguaucuacucauugagauaauuuaugugaaauccuuagaaaaauuucuauaugaauguuaacuauuauaauuagacucauggcagugugauuacuaugacaaaaaugugagcauuuuuagggcuguugaugcauacugccagaucugauaugauuccucaaauuauaauuauacaguuaucccaaauaauggcagauaaaaucucauuuuaugucucucucacaaaugagaucauguaaguagaggggaauaacuccuaggaauaauuuuguauuggcugauaaaaugagcaacuugauuucagcucugcccuuauuauguugauacuauaaagagugucugaauuucagggagcacacuagauccuuuauucauggauguguuuguaucucagaaauaggagauaggacuguuugaauuaguaaucauccuuuuauauauacuuuucuuuuucagggcaaagaacaggaacauacauuugucuuuagacuggaucauccaaaagcaugcaaacauuuauggaaaugugcuguggagcaucaugcuuucuuccgccuucgaggccccguccaaaagaguucucaucgaucaggauuuauucgacuaggaucacgauuuagauauagguuaauuuuaauugcuguuuuaucugucuuucauugcauacaggccaaaaaauuuaggccaaucuucucuuuuuuacagauaugguaacuaagguauagaggaauaaggugguuugccagagucuuccauuggccaaaauaaaauagaaaaagugguauuguuauugguuauaauuucuugaauagaugcguaaacaguaauuguauaauggcuuuuauaucccucuggauguuuacuuuauauauuaacccacucccaguuuaucuauuuaacaagaguuuuauggacucuccacccaccacuggauaccauauagaaaaggguuucuugcacugaaugggauauuagucuggauaacauuugugguccuuuauaaaccugaaggucauuauucucaugacuccuuguuuguugucaugaguuagaaauguuuugguuuacugcagaguggauuauugguugugaguuuucugcaugccauggaaaucaguuaaagaaggaauggauuguaccaauaauguggccaguugauuguguggaguuaauagaaguaguacuguagucuacuuauauuaaaaguaaggaggcauuuucuaaacagaauuuaaauggaaaucaaggagaauaagacaguagucuuaaaaaacauuucuggaaaauuauacugaaaagugaauaucacaauuagaaaaaguaacugaaaauauucuuuuaauuacacacuuugcacugaggaauguagaugggaaagagagggaguuuccauaaaaggacagauauuucaaacuuauuuaauguguacuuaggugauaugcaugcauaugagaaaaauaaaaccaacauaaucuguugcauauuucacaaaagccgaaagaaugauaugguaaagagagagaucgagacuauuaguagcuguuccugugcgaugaaguuuaggaugauucuuuuaaggagaaccugaauguggacugucuuauuuguguguguuuauuacuguagaccuaaaauuucccuuacuucuguuaugccucauuuagugggaaaacagaguaucagaccacaaaaaccaauaaagcaagaagaucaacauccuuugaaagaaggcccagcaaacgauauucuagacgaacucuacaaaugaaaggugaagugcaacccucuuucaaaggauuauuuuuccuuggcaauuaauuaugugcugguguuguuuccauaagaggaaguuaccugaaucuccuccucaggucuguuccagucaacuaaaguacuuuucuggcagaaucaauuucaugggauacacagagaaaaauugccuguauuguuagcagagauuaaacuuuauguuaaucccaauucaaaugauagucugagguuauguucaguuuuuguauacaaaacuguuucuguagagcaacauauucucucccuuuuugacuuacagaucucauucuaaaacaucccuuaauccccuuaggaauuuuuaaaaacauuuuuauuuauuuauuuauuuauuuauuuauuuauuuauuuugagauagucucacucuguugcucagguuggagugcaguggcaugaucucagcucacugcaaccuccaccucccagauucaagugauucucaugucucagccaccugaguagcugggauuacaggcaugcgccaccacuccugacucauuuuuguauuuuuaguagagaugggguuuugccauguuggcugggcuggucuugaacuccugaccucaagugauccacccaccuuggccucccgaauccuaaaaggauuacaggcaugccuggccaaaacauugucuugugaugaauuuuuuuuaaguaaaauuuauuucauauuguauuauaauauuaaggauuguauuaaauaccauuuuaaaauauauucaucauuguuauacauagacauuuccuaauucauaauuguuacuugcugauuaagaucaguuauauaagaaaaagcacuauuuaccuugacaaauaaauuaaaccuuguguuugguuuuaaacugaauuugcauuaaaaugaauuugcauuaaaaugcaaauuuaauuuuaaguauuuccacugucagagucaucaccaguuguccaaaaacagcuguaaugaucugauguuuggcaguauugacuuuuuuauaaaaaugauuuauacucauaaguuuugguguggcuguaaauuaaauauacagcuauaaaugaauugugaugauuuuaaaacccuaaguuuccucuugguuuccacugaugauaauucauaaucagucagcucacucuggaggcuuacagauugguucuguuuaaaaggaggagauauauaugcauuguauugcuuuauuugaaaaaugaaaauaauugccauuguugccucuauggugugaaucccaaaacacuuuggugaauugaagguuuuuagauuuaugguuggggccaaaugugguggcucacaccuuuaaucccagcacuuugggaggccaaggugggaggauugcuugagcccaaaagcucaacucuuaggaguuugagaccagccugggcaacaguagugagacccaccccuaucucuacaaaaucaugaaagacccuuucucaaagaaauaaauuuaugguugugaaacauggcuuguaaagcaauuaguuaaaguuuugcuuugaauagugcagcaguuuaucauguaagaugaaacuaaugagguguuaucuuuuuucuucuguuagcaugugcuacaaaaccugaagaacuuagguaaguaauguuuugcaacuuaggaauugguauagaauuugggauuuauguaguugcuaucauuaaacaaauauuuaagaccuaucaaaaugucaaguuguccguaaagcaccagggauaugucagggaauaaaugaacauguaaugccagauaaaagugacaugaugaaaaauuaaagcaguuuaaggaaguaaagaauggggucgaggcagaugagccauucauaaagagaaugacauaccuuuguuauuggcaaguggcugaggaucuuaagauaaauuaugauccuuauacauaagaagcacaaaggagaaagguugauuugcaaauaggcaauuuucuuccugggauaaaucccacuugguugugguguauagaccuucuuuauguuauauguugcuggauuucauuagccugguauguuuuuggauuugugugucuauucaucagaaauauuggccuguaguuuucuuauaaugucauugucugguuuuuuauguaggguggguaauacuggcuuuacaaaauaaguuuguauauguucccuccucaucuauuucuugggaagaauuuguaaauaauggguauuaauuauuuaaauguaugguagaauucaccauuaaagccaucuuucucuuuaugugaaucuuaaaaauucuuaugagagaucuguucagauuuucuuuucuucucuuuuuuuuuguugggguggggguaggggacgugcagggccuagcucuuucacccaggcugcaguacagcagcuugagcauggcuuggcucacugcagccucucccuccuaggcucaagugaucaucccaccucugccucccaaguagcugggacuacaggcacuugccaucaugcauggcuaauuuuuaaauuuuuuguagagauggggccucccuguauugcccaggcuggucucaaacuccugggcucaagcaauccuccugccucugccucccgucuugcugggauuacaggcgugagccacagcaccaggcccucccggauucucuuuuucuucuugauucaguuugggaguuuguaucuuucuagaguuuuaucucuuuuaucugugguaucuaguuuguggggauacaguuuguauucccuuuuccuuuguauuucuaaaaguuccauaguaauaucuccuccuuccuuucugauuuuuaguauuuugaguuuuuuuuuuucuugcaaaaaaaaaaacuagucuagcaaaagguuugucaauuuuguugacguuuucaaauagaaaagcuuuugguuucauugauuuuucuguuuuucuguuucauuaauuuuugcucuauauuauuuuuuccuuccacuuuagguuuaguuugcuguuuuucuaguauuuaagguggaagauuagguuaucugagaucuuuauuuuuuaacauuuaaagauauuaaauuuccuuucaagcacugcuuuaauucaauaaguuuugcuauguuguguucuuguuuuuugguuaccucaauuuauuuucuaacuugugauuucuucuuugacuuguuugauuacuuaggaguguguugcuaaauuuccuuguauuugugaaugucaaaauuuuauuuuuuucuaauuuuauuccauaauggguagaggacauacuuuguaugauuucaaucccuuuaaacuuauugagacuuuuuuuauggccccuccauaugagucacccaggaaaauaguuuauguguacuuaagaagaguauauauuuugcuguuucugaguggaguguuucauagaugucuguuaguuuauuguguucagaucuucuguuucauuguucaucuuuugccuaguuuuaauccguuauugagaguggaguauuguagucuacaacuauugucuauuucuuccuucaguucuuucuguuuuuguuucauguauguuguggauuugggguagguauguauguguuguuaauuguuauauuauccugauggacuguuccuuuuuaucucuaguaacuuuuguuuuaaaguugauuuuauuugauguaaauauugccaguccaguuuucauaugguugcuuuuccaugauauaaccuuuucaucaagucuggaaguuuuuacccauuauuucucuagauauucuuuaugcugucuuucucuucuccuucuggaauucucauuaacauguaaguuguuacacuugaugguguccuacaggucucugagucuguucgcuucucuuuauacuuuuuuuuuuuuagacuacauaaucucacuugaccuguccucaagcuuacugauuuuuuuuuuuaaaccacuuaaauguuuguuucacuggcgagaguaucuacuuuuguuuucaaauuaccauucugaaggucuugcuucugauggcuccauuaauuaaauuuaauuaauuaauuaauuuuuuuugagacggagucuugcucuaucgcucagguuggagugcaguggcaugaucuuggcucacugcaaccuccgccucccagguucaagcgauucuccugccucagccucccaaguagcugggauuacaggcacgcaccaccaugcccaccuaauuuuuuggauuuuuaguagagacaggauuucaccauguuggccaggcugguuucgaacucuugaccucaugugauccgccugucucggccucccaaagugcuaggauuacaggugugaaccaccacgcccagccggcuccauuaauuuuaauauuacuuauuacaaugaggcuauaucuguggucucauauaaugcuuaauaauugguauguauuagagucuccuagaaugccuguuaaagauaagauucagaccauacccacaaaucuaauuuauuuuugaauuugucuguacucuuauauggcaguugucucacuagacuuuuuucaaaagaaguugguuauuuuuggauauugaguaucaucagccucaccuugaaauguccauuuuuuuuucacuuugaaagcuguuaaagccaguccgugauuagugauugacuauaauagcacuccgcuuucugaacaaggacuccccucaaguuucuuuagcugucaauaggcuguugaaaauaaauaaauaaauauaacagggaggaagugaaauuucugugaaacucucuccgugagauuuuuauuagguaaaaaaacaacauuuugugccuuuucugugcuguauacuuuuauuuuucuuggauuuauuuauaagcuauguuuuucagaaaaguagaguaauggcugggagcaguggcucaugccuguaauccuaacacuuugggaggccaaggcaggcagaucaccugaggucaggaguuugagaccagccagaccaacguggcaagaccccaucucuacuaaaaauacaaaaaucagcugggcgugguggugcgcgccuguaaucccagcuacucuggaggcugagacaggagaauugcuuuaacccuggagucggagguugcacugagccgagacugcgccacugcacucuagcccgggugauagagcaagacuccaucucaaauaauaaaaagaaaaagaaaaauggaguaauguuugagauuuuucuguaccuuugaagcuauuuuguuuauuuaauguauuaugucuugcuuuccugaaaaggaggcugggauauggaauauuagagcuuaaaguaaaaagugaguaccugcuaaaguuagcagaaauguaaacaaaguauucagcaaugguacguaguugaaaaauuaaggcuuuuauuugcaaaauaggagguuuuucuuuaagauguucugaaacacauuucugguaaaauaugaauauauauagugccuguuuuggaauuaugauuaauuuaacuuuaauggcuaaauguuggugucucuucauuagugaugcuuuugacucuggaaaacauagcagaaaugguauauuuaaggaaugguuuuuuuuuagacuaagcuuuuagaaaugagauguagugggggacccaacucuccugaagguuauugagcaccacccaucgcagugcuugagaaaaccugagcucagacuggcauguuguaugcccuuucacucuugcccuuccauuucuguuuguaugaacaguuuugcucuauugaaccauggaaaacaguacuguuugaaaaggcacaacuauuugaccugaaaaucuucucgaccuuguauucugcaguuuuguaaaaugcccauuugaauaacagauuuuuuaauuggcuaaugucagucauuuuucuuguacuguuuuggcucuuaacuauucuugugagucaugaauacuauaaaguauuuaagaggugauguuuuaaaggauaguugacauuucaauuacuaguacuucuuauacaggcuuaauaugcagucuugaagacaggaaagaggaaaagaaaaaaugguagaggaaaucaaaugaguagaagguauacuauguaaaagcaaaaauggucaguuauuguauguaguccuuuaaaaagggaagcuugaacuagguuaguaaugagaaauaauucaguaauuccuucauauucauggaagugaaagaauguauauaauuaucagaaaauaaugcuuucuguauuucauacaauuuaaaacaggaagcuaugguucaauuaacaucacuuauaaauauuuuguucucauguuaaucuuauugaucaccuacuaaaguuauuucuaguuaaaggaaaagcuucagagaauaaccaaggaacuguggacuaguaggucuaacuucuguaccaagcaggcugggugagauuucauuaagacuuaggaucauggguauucuaggaagagcaacaugguuaguaaaaagaaauugugccugauggguauaaucuuuaaaauugccauggcaguggaucugcacuaaauuguuuguuuuguguguguguguguguguguguguguguguguuuugguggggugggguuuuguuguuguuguuguuuuuugagacagggucuugcccugucacccaggcugcaaugcaguggcaucaucauggcucacuguagccucaaccuccugggaucaggcaguccuccugccucagccuccaaaguaucugagacuacuacaggcacgcacccucacacguagcuauuuuuuaauuuuuuguagaguuggaggucuggcucuguugcccaggcuggucucaaaguccuaggcucaggcaguccuccugccucggccccugagagugcuaggauuacaggcaugagccaccaugccucaccaauaguauuucuuugaaagguauuuuguuguuguuguaaucacuguuauuuguauuuugcuaauauuaacucauuuaguuguucuaacagucucaugcaaaugagcaacccaagguguacagaauagaccuagugacacagcuuggcuuugaacccagacagugauagugcaaguuauagugacucaacuuguaauugaucuguaguucuuaaaaaaauagaauauaaaauauguucacucuucauuccccagcguuuuagcagggccucucuucauucuuagguucuuaacugguuggcuuucauuaucagguagcgguuuuuugcucucaccuuguuagaaaggcuucuggauccucuauucagagguuguguuugagagcuuugccuguuuccucuuaguagaaugacauguuggcugguuauaaaauaauauucuugauuacugcuaugggaggccuuugccaaccugauaauugguagugauuuacuuuuaaaucugcucgggguacccgaaguauucuuuccuuauccuugaaguugaguggcugaacaauaggggaucgauugcauuucauuuucugucucauuuuccugaaacacagugcugucguuaaaucuguaaauuauuuucucacuuucaaggaauuuuuuuauauuuuugaauuauuuuuuacauuaguugaauuucuuacuucagggauaccauuuauccuuguuuuagaaugucugacauuaggaaacuuuuuuucucauuuuguugugaguuauaguucaucuuugaguuuuuauuuuacugaauuuuuuuuucuguuguucuguaguuucuggguuuuuuuuuuuguauuauagguugaggguuuuuucaagugcuuuuugugggaauggcgggguggggauggguacaaacugaacugaaaauuuuuuuuuuuugagauggagucucgcccugucgcccaggccggagugcaguggcacgaucucagcucacugcaagcuccaccuccuggguucacgccauucuccugccucagccucccaaguagcugggacuacaggugcccgccaccacacccagcuaauuuuuuguauuuuuaguagagacaggguuucaccguguuagccaggauggucucgaucuccuggccucgugaucgcccaccucagccucccaaagugcugggauuacaggcgugagccaccaugccuggccuaaacugaaaauuuuagaacguguuuauaagucauuuggagaggaagguguacacagagaaguuucaaacuuucuaaaccuuuuauacuaaggccuuuugaguuauaaaacgcugaguuguugccgacacuggaaaaucuugaggguaggaauauacaaaagaagugacagauaaguuuaugugggauuguguugcugucuuuguuaggccauccuugauagcuguuguccaaugaauaaacaguugugaaguauaccucuaaagcaugauuaaaauauagguguauggaaacaucaaaugagcaacuauagaaaagcaaguauuugccuauaagaacaaauguuuucagguaucugacauucuuaguuuuagguacuagcaguaguuuuauucuuuauuugaaacaaaacguuaauaucuuuaaaauaaauauuuuauuaguguauguguuaucuuacaaaaugaaguccugaaauuucauauaggguuuuuaauugauuuuuuuuucccauuacaguguucacaauaauguuucgacccaaaguaauggcucccaacagguaagacaauacuaagcuucuaaaacacuggaucacccguuaauuaugguaacaguaguaguauugauuggauuuucauagugguguauguaacccugcacaaauuaugugcauuuucuuuuccuuuucccuuaagugguucaguaauaacuuccgguuauuuuauucucuaagauuuuguaaaggaaaccggugcucuauaaaacauuuuaugucucugugaauccaagaacauaauuuaacugacuacuaauauuucauucauuaacuaucucuaagguguauauaaaauucaagcauuuguauacauuuuaauuguuggcuuuguaaauaguacuccauuuuaguauuuguuggugaagagaucuguuaucgaggcaaaauagauaauuuuuauaauuuuuguccaaaggcuugggggaugagaucugcucugccugugaguccuuccauuuccucugcuccugugccaguggagauagagaaucuuccacagaguccuggaacagaccagcaugacaggaaaugguuuguuaauuccuuaaacuaaaauaaaauauugccuaguuaauuguauuuggaauuccaagucauaaucuuaaaguacuuuaaauaugauugaaagcaaauuauucauauuugugagcuggaaagcuuauuauuaaauaaucauauugagauggggaaaauaaggauguuggugauaaagggagugcaguugucuaaaugaagaccaucagacagcuguccuuacuuauuauuuauuugaaacaaaacguuaauacauuuaaaauaaaucugcccuuauuagcuugaugugguagugguggaugauucucugcugaaaaagacaguagaauauuuucccagguccguaaggaaaguauauccacuacguguuauuccacacaacaugaugcuacuuugaauguguuuuucucauuaaagacgaaggguaaagucagaagcaaaacaugauuaaaaucugauaaagcaugagauacccuaaggagacugagagagaaucugaugacaggaaaaagauacuuuaauuauuuagacuuccagguucuuuuuuuagauuaauaguaaauauacaaauauggauacuuugugucuuauuggaguuaaucacuugaguuuauccuuucccaaauaaauauauguggcuuggugggggcuccuuggggauuauuugauucaguggucauguuggguguaucaccuguucaaguuauuugucuguuugugaaaugaauuuugauaauucauaggauuuuucucuuuuucucuugcucuuaguuuguuuaguaccugaaaucuaaugcauuucuguggugaucucaagguuuuggucagcuuucugugcagccaguucuuccuucauggugguggcucaacagugguuggugauuguuuucagucuuugcuauguaauuauuuuucacuguuauuuuggcuuaacuaacugcagggugccuugcucuugauacuuggguguauuuuuauuucaguuccaaauaacuugugauuaguuuauaagauugaguucccuucuccccuggccccauuuucuccuuuuuauuuucuuucuacauggguaugugguggugauacuuuguguauauuugugugcaucuggggacacacuuaaaaguguaaagagugaggcuuauaaaugucaaauuuauuuuugaaagucauuuuuagaaaguuucuucaauuucuuauggaaaacacagcuccuguaagcaguuauguuuuaucucauugauguuaccaccaaguucuguuugcaaggaaaaauaguauugagacuucagcuauaaaggaagugucuuugccuauuauguuaauauggagugagggucugauuaguugggauacuauauuacgacacugaaucuuugaguuuuuccauaugaauagguacauauuuaaaccuguuugauuugauuuguuagguacuacuugguuucuuugaugcauccuuuagaaagagcauugaauuuauuaaauuuuaaggaaaaugaaaaauuuggagcuguguguucuccuuucuuuaugugguugugcugagaccuccuuugcugaaauagaguaaagugaugcucuuuauaacauaauaagccucaguguaggucaacaagggcauggaacugaauauagagcuggcauguuuuggagauaauggacucucccgccuuaauuucauauguguucugcauuucauucuuuuuucugcaugcuuugauucuuguuaaugcuuucaaaagaauauaaagcaguccuccuuuagaaagugauaaaugguuaaaauuuggaaaugcuuccuauguuugaacaauugggcagaauaauggaccauucuauugcuugcagguaacuuucaaccaauuuaaucuacaccuacucccuguucaagucuucagcauuuuuuugcugguaucuuuuaaaugacaccauuauuagagcaaaugauuuggcauaucaguggcuuagaauaaucaaguauuuaaaauuucacuuuuugagaaacaauucauguauuguaaacccauaaaucauuuguaagcaacaacagaaacaaaacugaauaguguuuagaaaaccuugcauugguaggggagaacauaaaccuaauuuaguuuucuaaauuuuuagagaccauaacuugaggguugugauuuuugugagccaggucugaugaacaaauuguauuucaguuaaaagaaagaugauuuuguuauuaaaaaagccuuccaauuuuguuuugaaaaauuauuuuaguuaauuuauuuucaguuucccuaagggauaaaggugaagauuaauguuuugguugaguuagaaagauaacacuuauuaaaaauguauuuuugcacauauuuuauauuugggguggcauuuuccuuuguaguuauuuuaaauauaugcugcccuuucugccaugucacaagacuuugauuugcuuucuuucuacuggaggacucugaucaguucugaccaagaacugcauguaugcauguuucacucuuagaauucuauaggccuuuucuauagcacugugauaaaaggugccuaauaugcuuacuaaacuacuucuuggagaggguguaucaucucaucacauuaucuguaccuguugaauuucauuuugaggucuugugaacuuugauuauauaaggagcgaugauucucuauugcuaauugggaacauugauguaaaauuacauggccucugaagguagauuuuuuauuuuuagugcucuuucugaauuuuguuuccugcauuucaguucugugaaaucccauaauuugaggaagaauuuucacaguuuuccuuuuccauauaugcuuuuguccuuauguagaguucuuuuuucaaauauuugaaguuaaguagauuaugaauauuuuuuucuucugauuaaaaccccuaacaacauuucugcuuuuaauauuaguaacaacaucagggacagauacagagugucuugcuuucugagaaauuucuucuuuaauucacuuagcugacucagauuacuuacauguauuuccauauugguauuuuucauuacauguaacuuuguggauuucccccacuuuguuauucuugaauguuaucauugcauggaguagaugcugguaacuacucauagcagcagugcaugcuagucacauuaccuuuccccuuuauugucucuuacacauccauuuucuccuauuccuauugacuaacugugcuccccucccacuccccaaccauccaggcucucugcugccagcgacugcugucaacgugguggaaaccaguggaacacaagggccuugcccccaccccagaccgcacauagaaacuacacugacuuuguucaugagcacaaugugaagaaugcaggaauccgucaugauguucauuuuccuggccauacagccaugacugagauaugaguguugagccucuuaggcuuugggacucuuugucaugcaaguugaugguauacauuaucugguguuuauaaaggauuaaucacauuaggaguauuugggagaauuuacagugagucacuaguuguucagugcuguuuguaauugaauucuuccaugaaagggacaaggaaucaaggaagccauauagcaucaaugauaaugacaaauguuuguguugaaaagaguguguauaccauugugguuuuggaagaguuuucagaccuuaguauguucacacaucaccagacuguaucucaggagaagguuuguguuugugaacaaggugcccauuauucccccaccacaugccauccaaagagaucgagguuaaaagaaucagacacacuaaaaacacaguggaagcaugucuaggcauaauauaucagccuuuugagauauuuauuaaaaacuuguucuuauacacuauuuuaauaugucuaaagugacacauaccuuaauuuaagugccuaagauuuuaauuaauauaauuuuuaauuacaaacacuuuuacuuuuuaauaaacacgaauauuuuaacuuaccaaaagauuuagagaucacauuaauaauguggcucauguauagagaaaucugaaugguuaguuuugaaugguuaacugauuaacauucaguuaucauaacaguuaaccagugguuaacugaaugguuacauuacuacugaaugguucuauaaaaugaaaaacauauuuacuuugucuuuucauuugacuggcuuuucucuuucaucucauacaccugacagauuacccagguuugcaacagucucauaaucugauccuguauaaccuuuaaaauaaaauucugaagccaaaaccauaugauuuuuagauuguauuacuauuuuugauccuuuuuaaacuuuagaauuucaagcuccuugguuuaauuaauagaagugaauuagcuggaaaaaguccauuucugauaggaaaacauguuaagggaagcauuucuucugucuuuuuuuaguuuucuuuuauauuuuagaaaaauuuucaaauuuuuaaacuauguacauagaaauuuauagauauuuuauauuucgaagaguuuauaaugcuucaagauaaugaagcuucauuauaaacagcuuaacucauuuaaugcauccugcucacauagagguugguuuuauaucucaaauccuuccugccagacaaagauuaagguuucagagggcuuaauacuggacuauugguuuaauacugaaugguugguugcaguuuguccauagaagaccuaaauaagcagaacugacuaauauuuaaagaaugaaauuuguaggcagguuucaaucugaguuuaguauaauuauguguaagaggauggccacucaaaguauuuagcacauccucuaaauauaaauagaucuguaucuuaaauagcccggcucccaccucuuuaagcccaucaucguuuagcaagcuuaaaaauggccacuaauguauggcccuuauaguuguuuuagacuuuacauagcucagaugauaauugcuaaguauugucauggcugauuuuuuuucuuaaaagagaggaauuuggauuauaacauuuuaagcacagaagcucuggguugugccauucaagaaaagguuucauggguauguauaucauuaaaaaaaguacuguuucuauaguaaaaaccaaagaggcacaaugaaguuguaagauuugacuucacucacuuuaaaauuauucuuaaucugcaggacaugcucauauaaugccccauauauaucuuagcagauuguaauugaagaguaagaucuucaguucauauugaaaguggccauuucuguauuuauaauuugaguuaaucaguacuguuacauuuaagggaagauucaccucaugauuuuucuuuuguugaaaaccuuguuguaaagaauugauuugcgaauuccugaugagagaaacuggauuggagggguguuagggauggaggcagcgauaggggugaggaaaguaaagggcuaaggcuggaugguaguaaaauuaaacuugucuauuuuauagaaguucccauaugcuucagaauuucauaucaaauauugcaaauacuuguucuuuuuacugauauuugcaagauggauauauauguuguuuccagagcucucagguauuuauaaguagcucaaccuaaauuaaauaaauugucaccaaccuauuuacacucuacauuuuauuaugccuaaagagucagugaugauaaauucggaauuagagaaguaauaaccuccagaagcaccuuacugggucaccauccuuuugaucaaagggugucaucaguacagaacuuaaguauuaugucauuuaauuuacagugcuuuggcuaauuuuauuuaacuuaauuaauuuaacaucuugaauuagguugguuacauuuugacuguuuuuacagucaaggaaacuuguagaaacacagcaaagcuagugaccuucacacuuucacgcaugaacauaaaugagcucauaagaucaucgucucuuuuuguugcguuucaaaggcguuuaccuaucuuggaguaagaucuaacauuucugaccuugauaggauaaucauagauaacauacuuuuaaaugaauuuacagagaaaaauaaauuuuauuuguccuacuauguguauaauaugucuguuuugaaaagcaccuaguauacaaacacuaauauuguaauaccaguauaauucaaaucaucuuuuuuuuuuuggaggggaguuuauuuaaaguguuggccaaaaaauguuauuuauaacacuugguuggaucuuuuuuuaaaaauuucuuuucauuguuguucacuguucaaaagguacaucgccagguuggaucuuuuuauuuacuaauguaaacugaacaaguuugaaggugguuguccccuauuaguucaucgugccccaguggugggagcuauaguuguuugagccaugguacugucuuuggucagggcacacucuucauuucuaaaccaugguucauugcuuugagaggcuguuauuuuaguguuagucuuugaauauugguuugaaaauauuacaguuacuauuuuuuaugauugguauuaggacuuauggauuugcuaaaacaaaaucaucuugucucaauaacguuuucucucuuucccaccacauucuuccuuccugaauuuuaauauguguuauaccacaucaucaguuauaucuugcuuuccaggauuguugugaaugcuuguaugugagaugcuuuuacauaagggcuaggauuuggagauaauucugcgguggggaaacaacuuucucuccuuccuucuccaugccagccucuuccccuacccccauguauaaaaugugauuugucagauccuuucuagauacuaugaaucguggauuuagauaugguagucuuccucuaacccccuuuugcagaacauaaacauuucucauccucuguucauacaauuuuuuacuuuagucacaugaaaacauugugagaauggaaucuuguuccauuaacguuaaccuuggugguguagaaauuaggacaugaagcaugucacuuucaguguaaaauaugucaaggaacuucauuucuuucaucaauuccugacaauugcuaauguaguaaugcacuuuaguugcuuugagcacuuugggcuggugagaagggaaauacauagugucuuuguuaaaagaaugagugaagagaagagaaaauuuuaaaagaaauuggugaaaggaaaauaacuuuggcuuuuuuauuguuauuuuuauacugaaguagacaaacaauuguuccuguucuuccugaaggaauuguugucacaauuuuauuauuauuagauaauuaccuaagcuucuguguuacaagcuguggccucaguucuaggugguggugcuugagugaacauuuuacauuuuguuccugacagcuggccagcauuguguuuauauuggcauggaaaagagauaucugauucagagaacaguguuuuccaaggauugugacugaagacuuccuuaaugguguaauaauguaccuccucauaaaaacagguuugacagcuguagcucauuuuuuguuguugaaggaaguuuuauuuguuuuguuuuuaacuacuuuuaauaaagaauugagauccaguguaugauuaagauuuguaagaaauugcagauuccuuaauaaagcucgcaucuacagacaugacuaaucauugauaauaauaaaugcaaaauauuuuaaauuauuagggguagaguuaaaaaaugaaaaauaaaagguuaugauaauaggaagaugauugcuggcuugauuuaccuuguggaacuaguuagaggaguauucagauaaauuguggaaaacauuagaggaugcaaaauaccacuggaauuuauacccauuaacagagaagaguuucuuauuacaaaacuguauuuguagccccaccaauagcuucaggaauuauuuaauuauaaacuguagaaguuuggagauaagaccuguguuuaauaacucgcauuaaaucuuucuggggacaucaucagcaaaacucuuggauaauuagaaagaccugggaagauuggguucucuggaauauccagguuaucacuuugaaauuucacaaucauguuggaauaauaacauuaaaauauuugaguaguaaaggcauugaauaucagucugagucauccacauuugguaaggaggccuggggcauuuguugcagugaaagauuucaggagucuuguauugauaucucuuuuuuugauucaucuuauuuguuggacaccuaccagaguaccucauugggucuucuuuauacacagccacuuaucauuaugccuuuccacauacccuugaauuucuugacccucuuccuguuguaugcaucugguuaaauccaacucuguauacucugcauauagcuggugaaugugaaauacacacaaaauuuuugaguggucuuuaaauuuugaccacuaagcucaagugagccuucaaugcucccugauaccauauuacauuuccuuaaucuauuuguucuccuacaaugcugggcugacuuucuccucuuacaaaccacuuccuccucuuacaaaccacuuccucccuuccuacucuguucucagcugaugaccuugcuuccuacuuuauugaaaacauaagcaaucagaagaggucuucucuguacucccaccauuuuaucagugaacuuaccugcauuugggaauuuguuccuugcuuucccugcuguuacucuaggugaaccauccauacucuaaggcccagguccucacuagucauuuagauccucaccucaaguuacucaagaccaucauuugagcaauccuccguuuuguucuacugcaucgguuuucccuuucuacugaaguauucucaucagaacaaaaacuuccuaagauagcucacaucauuuaaaaaagaacucccuugaaucuaccucuuuuggcaauuccuccauuuuuuuguuucacagguagcaaaacuguuugcuuuguaagaauugucuauacuugcuaucucuucuuucucuuaaucucuugaacccauucuaaucaaacauugucccugacacagaggacuggguaugauugugcagauugcauacuguacaagagugccacauuuaggagaaugauguucacauaauuuaugacagugauuuuccagcagauggcacuaagugucuuguuccgaaaagauuaguguauuugacaauuuugcaaauuggaugugucuuuucagaggagcauuguuuuaauccauauaaaggcucugccuugaguuaauaguguuaugcuacuacuccaccaaaauagcuuuauuagaucacaaaugaccugcauauuucuaaucccacaguccaucuuuuagucagcuuaauuagcauucagaaaucgcucacuucacgaaauugucaucaccuagcuuagagaugucacuauuuuuuauugucuucuaaccucccuucuaacacgccauugucuucuaacaagccauuguuuuuaauccccuuugcuaaugccuacuuaucucuccaaccccuaaacucuguuuaaggaacuuucccguaacaauuuauucccuuuguaauaucauccagcauuaugguuuuaaaugcuaucuauacacacuggcaauuucucaguuuauaucaucacccugaacuuuuaaauuuccacacuuacauauccaacugccuaucugacaucucuacuuaggcaucuaauauaggcaucucauuuuaaauauucuuuauuuugagguaauguucagcuuacagaacaguuucagggauaguacagaaauucccacacccuccugcccuaccuuccccuauuuuuuuuuuuuuuuuuuugagaccaagucucacucuugccgaggcuggagugcaaugaugcaaucucugcuuacugcagccuccgccuccuggguuucagcaauucuccagccucagcuuccggaguagcugggacuacaggagugcgccaccaugcccagcuaauuuuuguauuuuuuaguagaaacggggcuucaccauguuggccaggcuggucucaaaccccuggccucaaaugauccugaucugcccgccuuggccucccaaagugcugggauuacaggugugagccaccgcuccuggcccccuguuguuaacacuccacauacauuccauaacuuguaccaauguuaauuucuuagauuuuguuuguuucacaaaaccuaagaaauuaacauugguacaauaccacaaacuaaacuggaccuuacucagguuucacuagucuuuccacaaauuuuccaggaucugacccgagaucccauguuacauuuaguccccuucagccugugacagccauuccauguuuuucaugguuggccagaugccuuguggaauauuucuugauuuggguuugugugguauuuucacaugauuaguuugaggccacggauuugggagaaaauacugcagaagugauauugggcaucccgaauuuaauauguucaaaauuggacaaauauaucuccugaccccugcaguuuuucccaucuuugugguuuuuguagcuucguaaguggcaguucucuuuuucguguugcuaagcgugucuugggcucuacuuuagaccugcugaaucagaaacacuggaagugagguccagcaaucuguuucacaugcccuccuggagauucugaugcauacugaaguuugagaagcacugacuuagaccagagcaccuuauagucaucuugacuccucuuugucucacacuccagauuucuuucagaaucaguaaauucugucaguucugucuucaaaauguauccaggucuacugcuuguuaccaucuuuacugcucccauccuguuuccauuuguugucagcccugcccucuuaccuggccuccuugccauugcccuugcuccucuacugucugguacuccuuucagcagcuguagugauaacagcagaucaugucauuucucugcuuacaccugccagcguccuugucucggaguaaaaccucagauccucacauugauagaaacaugcuuuuuccucccuuuaucuucuaucaauccugaccuugcuuacauccaaagacucaucuucuuauacuugcucaaacauaccaagcauguucucucaggaucuuuguacuuuuacugcuuccugaguauuccucccuucaaucucuuaugguucauuccggcaccaucagguuucuuauuggagaagccuuuccugaccacucugaaauaaucauguuccccgcccccugcccagucuucuuuuuauuuccugucugccuuacccugcuuuauuuuuucucacuccuuucaucuuaguauguguuuguuuguccucucuauacagauagucccuuaugaugauucuuaggauuuuucaacuuuaugauggguuuaugagaguauuaagugcauuuuugacuuacgauggguuucucaggacauaacccuauuggguaagucagaguguccguuuuucaacagaauguacgcuccguuaagggagagcauuuauuuuguuuccuucuguauccucagacacuccauauauauuauuugauugaaucaaugaauaccaagcaugucuuggcacaucuggugaugcagaaauagucaaaauacuguucuuggcuucaagaaauuuauacucaaacuguggagauaaacaguuuuacaaauaacugauaaagugcuaaauccagcaagcaagaagaguagaagugguugaaguuaagaaggcuucuuggcauuugcaucagguuuccagugaaacagaaaggagcuuugaauggauaaaucauuacgggcccagggaccuauaggaaaagaaaauucuaaaguagcuaagugcaagguguaguccaggaaugaugaaucagguuugaguaaagaguauagaauuuaugggaagguaucgugauaauaauagcuaauacuugagugcuucugugccagacauuguucuggagguacagcaguaaguauucacucuagcaaagcauccucauuuaauccuuaugaggaucuauaagguauucaggcuagugaagaaaugaaggcacagaacaaugaggcugggcuucaaacucaagacagcuuaguccuagaacccagccuuggcuacuguacugccuccauaacucuguaaagguuguugggguccagauuguagagaguaaaaaggaauguaauaauucuauuuuagggggcagugugaagaaugaauuccaauugguggaagacuggauuguauuauaaaaauaugcugccuccauucuauguaauuguuaaagaaucaggucaguuuucauguacuuuuacuagaggauaucagugacacuguugaguuuaaaacuuaagugucugagguuuguucccauuuuugugaaagcaaccaaaucauguauauauuaguaagugcacgcacacaugcaagaaccuaacuagauaaacaggcuuucagaaaaugggagugaggguaacauugcuuuucuuagcuaucauucacaacuuuaacaauaaauuacuccaaauuauggaaggagacaaggaaaacugcuucaguuuacacaggcaaguguccaugaaaaguaaggaaauagguagaagaaagaaugucuuuacauauuucuuuauacauucuugagagauggauaugaacuaagacauuaccaaagccacagauuaauaauauuauguguaacuacguuuaaaaaaauuuaaguguauaauucaguggguuuaguuuauucacaaagguguacaaccaucaccacuauuuaauuccguaacauuuuuauccccaaaagaaaccucuuuccuauuagcaguuacuaucaauuauuccuuccuacuagccccuggcaaacacuaauuuacuuuguguuucuauagauuugcccauucuggaaauuuccuaaaaguagaaucauacaguggguguucuuuugugucugacuuucacuugguaugguguuuucaaggucaucuguuuuagcauguauuaguacuugauuccuuuuaauggcuuaauaauauucccuuguaugaugcccaguguuuuauuuauccauugucaguugauagauauuugaauuucugcuuuuugugaaugaugcuaugaacauugagguguagguuuuguaugaacauguguucucaauugucaugguuauauccauaggagugaaauuauugggucauauaguaacucuauuuuuaacauguugaggaacugccaaauuguuuuucagaguggccacaccauguggguuccaguuuuuccacaucuucaccaacacuuacuauugccugucuuuuuuauuauaggcauccuaguugugaaguaguguauuguggagcuggaugauguugguauauuuugaucugcuuauugacuuuuugcuuaucuucuuuagagaaguaucuacagacaguuuccaacuuaauggcuugacuuaagaguuuucaacuuaugauggugugaaacuguuguaauuuugacauaauguugaaauuugaauuuugaucuuuuccugggcuguaauaugugguacauaagauauugaacacuuuguuuaaaaauaggcuuuguguuagaugauuuugucaaacugcaggcuaauguaaguguucugagcacaguuaauguaggcucggguaagcuauaaugcucuguagguuugcuguauuaagugcauuuucaauuuacauuaucaggauauaaccccaucaucaguugaagagcaccugcauuucauucuuugcccauuuaaaaaaucugguuauuuguccuuuuauuauugaauugugagaguucuuuauauauuuaagauauaaguccauuagcagauacauacuuuugaaaauuuuuuuauucugugcaguaugguugguuuuggagaauguuccguuuguacuugagaugaauguauauucuguuaguggagcauucuguguaugccuguucagucuuugguuuaugauacuguucaucuucuguuuauuuauugaucagaagauaaacuuaucuaguuuuucugcucauaaagugaaagaacuauuguugucuaucucuaaacuucugauuuagcuuuauguguuuggguacucugguuuuaguuauauguauguuuauaauuguaauauuuucuugaugauuuuccuuuugucauuguaaaauguccuucuuugucuuuagcaacaauuuuuaucuuacaguuucuuuugcuugauguuaguauagccacuucaucccuuuuuucguuaguguuuggaugguacauuuuuuccuuuuuauuucagucuuuuuguguguuagaaucugaaguguaucccuucuagacagcauacaguuggaucauguuuuuuaauucauuuugccaaucucugucuuuuaauuggacaguuuaacauuuacauucaguguacuuacugauaaggaaggacuuaugcuguuucauuuguuucuguaugucaugucuuuuuuuguuucucacuucuuccauuacugccuuuuguguuaaguagauauguucugguguaccauuucaguucuuuuuucuuucucuuacuauuuuauuuauuuguuuuuugagacggagucucacucugucacccagccgggagugcaguggcacgaucucggcucacugcaaccuccaccuccugccucagccuccugaguagcugggauuacagguguccaccaccaugccuggcuaauuuuuauuuuuuuauuuuuaguagagacgggguuucaccauguuggucaggcuggucucgaacuccugaccuugugauccgccugccucggccucccaaagugcuggaauuacagacaugagccaccaugccuggcccucucuauuuuaaaacauuguuuucuuaaugguuacccuggggauuauaauuaacauuuuauguuauguugugaucugauguuaugugauauguuauguuguguuauguuacguuacguuacguuauguuauuuuucgagacaagagucuugcacugucacccaggcuggagugcaguggcacgaucucaacucacugcaaccucugccuccgagguucaggcgauucucauaccucauccuccuaaguagcugggauuauaggaaugcaccaccacacucagcuaauuuuuuguauuuuuaguagagacaggguuuugccauguuggucaugcuggucuugaacuucuggccucaagugaccugcccgccucagccucccaaagugcugggauuacagguaugagccauacugcccagccuacaauuaacauuuuaauuuaaaacaaucuaguuuggauuauuuggacauuaaauaccaauuuaaugucaguaguacauguaaacuuugcuucuauagagcuuugucucccacuuugugcuguuuuucucuuacagaauaugucucugugcauuguaugcccaucaacauagauuuaaaauuuagaaaaaacauuuuuccaguauucucaucauuucauccagcuuucacaaugauucugcagugcgcuuuccuuuuccuauaugauugaaggagguaauugagucuucugcaccaaucugguucuuaaccucaaauuuaggaagauuaggaaaagccuuauacuggaaacuuaaacaugaaaauaauguuucuugccaaaagaaggaaaauuuucuuaaaaguaaugaugaauggcguuuuguuuuuugagauagggucuugcucucucuuccagucuggagugcagugguuugaucauggcucacugcagccucaaucuccuagacucaaguaaucucacuucagccucccaaguagcuaggacuauaggcacaugcuaccacaccuggcuaauuuuuuuauuuuuuuuuauuuuuuguagagauacagucuccucuguugcucaggcuagucuugaacuccugagcucaagugauccucccaccucagccucccaaaguguugggauuauaggcaugagccacuauaucuaccuaaauguaguaagucuuuaugcuacuacugaaaaaaagaaugaaugucaaaauacacuaguguguuugugaaaacaguaccaacugggaauuugcguaauauaaaaauccaaaaggauuuuuccauuuaaagcuucuacuagaaaauaauaaaaacaucuuggauguuacccuugaaaauauuuuucauuugcccuuaauuuuaaaaauuuauugugaaauaaauauauagagaaaaguuuauaaaaaauacaguuccaguuugaguaucuuucuucagguuaagaaauagaaauuaccacuucuuuagaaguucuucuggucucuuaauccaaauucaugccaacacucuaacucccaagugaguugccaggguucauugccuuccccaaugccuuauuccuaucucccuucuucccugcgagaaaccuggcuucuauuugguuaauaugugcuaaacaguuucagaauugcuauacccaugccacugucaacaacaaaucuaagugacauuuaguauuucuucaugguucuccuuuuuagacagaguauauaguugaaguauugcacuucaaauuuacuuggauuaguacccuuuccuccucagugugauuaugguauuuauuuggucguagaugaauuuuaauuuuucuagauauugccugacucuccuucauugaggauucugcauuugaccagcagaguaugagagugcuucuaccucucauagccucacugacaaaggaucaagaaagacugggauuuuugccaaucugaaaaacaauauaugguaucuaaguguguguuuuuuuccuuagagcuuuaucgagguacacuuggugcaauaaagugcaucuuuaaaguguuuugaguuuggacacagacccgugaaaccaacaccauaaucaagauucaugaugaauauguuccacguaguuuucauuuaaaucccucucaguagcauauuuguauguuuaagagccauuugcauuuuuuccauaaauugcuuguuccucucccccugcccccuccccauuuuuaaacaaggcuguuggccuuuuucuucucuacuuuuaagaagcuuuuuuguggauaauugggauauuaacucuguguauuuaagcugcaaaaauauauuuucaguuuuucacuguuuacuuuuaguauuuuucugugcgaaaguuuuaaaaguuuuuauauaagcagauugauccguuuuuucuuuaauaguuucuggaauuuaauagaguuuuccucacugcuacauuuuagaggaauucagcuauccuugccuccagcacuguauggguuaauuuucuuacauuugaaucucagauccauuuugaaacuugguuuaagauaggaguaaugaaaucuaauuuuguuauuuuccagauggcuuuccaauuaugucaaccucacuuuucaagaaauucaucauggugcugaggcaacuguauguccacauagaaaagaauaaaauuguacccccgucucagaccuaaauuuauuuauuuauuuauuuuuucuuuaacuuuuauuuuaagcucagggguacaugugcagaacgugcagguuuguuuacauagguaaaugugugccaugguguuuugcugcacagaucauaccaucaccuggguauuaagccagcauccauuagcuauucuuccugaugcuuucccucccccacacccccgacaggccccaguguguguuguucccccuuccuuguguccguguguuugcaucauucagcucccaguuguaagugagaacauguuugguuuucuguuccuacauuaguuuaauggcuuccaguucuauccaugucccugcaaaggacgugaucucauuccuuuuuaugacugcguaguauuccaugguguaaaugugcaacauuuucuuuauccagucugucauuuaugggcauuuagauugauuccaugucuuaggugcauagugcugugauggacauaugcaugcauguauuucuacaauggaaagauauucuuuuggguauaugcccaguaaugggaucagugggucaaaugguauuucugccucuaggucuuugaggaauugccacacugucuuccacagugguugaacuaauuuacauucccaccaacaguguaaaacauuccuuuuucuccacaaccucaccagcaucuguuguuuuuugacuuuuuaauaauagccuuucuccauggugugagaugguaucucauugugguuuugauuugcauuucucuaaugaucagugauguugagauuuuuuuuuuauguuuguuggccgcauguaugucuuuugaaaagugucuguucauguccuuugcccacuuuuuaaugugcuuuuuuucuuguaaauuuguuuaaguuccuuguagccucuggauauuaccuuugucagauagauauauugcaaaaaucuucucccauucuguaaguugucuguucauucugcugacaguuuuuuuuuguuugucuuuguuuuuguuuuuuguuuuugcuguacagaagcucuuuaguuuaauuagaucccauuugucaauuuuugcuuuuguugcaguugcuuuuggcauuuucaucaugaaaucuuugccaaugccucugucgugaaugguauugccuugauuuucuucuaggguuuuuauaguuuucgguuuuacauuugagucuuuaauccaucuugaguuaauuuuuguauaugguauaaggaagggguccaguuucaguuuucugccuauagcuaggcaguuaucccagcacuauuuaugaaauauggaguccuuucuccauuucuuucucuuuuuuuuuaacacaugccaaagauuuauuuaguuaauuaaagagagaaucagcaagacgguguaacguauccaaaggagaauuuaaaaacauacauaaauauaggcgaucagaaaaaccugcaaugaauuuacaaagagauggaaacaagucaauauccacaauuagcauaaucaaauacgugucuauuugagacaauuaauuugcauuucuuugggcaaaagcacuugcaugauuuucagcucaauauaauuuacauaauaaauuauauuaagcucaaagacaauaaaaagcuaagaaaacucaguagaguaugcuagaugaguaagcauuuuuaauuuuaaaaucuuucauaauuuuuccucuaagauuccaucuacaugacuauuugaccaguuuagaauacaaauaaauaugcuccacuguauuuauuguaaccucucaucuuggauuuuugaggaaaagaaaaacuucaauugucugagauggauaugauaaaaauaugugacaggguggugggcccaguggcucacaccuguaaucccagcacuuugggaggcugagguggguagaucaccugaagucagcaguucgagaccagccuggccaacauggugaaaccccaucucuacugaaaauauaaauaaaacuagccaggcguaguggcacguggcuguagucccggcuacaugggaggcugagacaggagaaucgcuugaacucaggaggcagagguugcagugagcucagauugugccacugcacuccagccugggugacagagcgacacucaaucucaaaaaaaaaaaaaaaaaaggaacaagaacaagaaaaaagaaaaaaaagcugugggcaaguagaagcaguuaccaaaaguuugcuaaaauggaacauacacccuaggauuguuuaauucuaaucacaauugaugugaacauagacauguaaacaggugcuuuuuuuaaaaaaaaccucucauuaauaaaauuaguauaaagaaagaaagaaacagaccaucuaggcuguuacaccuggaagcucaaaaaaacccauaaaggucuucauaugguauuguuugugguuaaagacuaaaauaaugaggggauugagaacuguaaguuuugaaaaacugcaagggaaaugggaaagagacuguuccagcuuuuucuucuuauugcuucuucaauuaaaauuauuuuaggccagguacaguggcucacgccugcaaucccagcacccugggaggccgaggcgggcagcucaccugaagucaggagcucgagaccagcccggccaacauggcgaaaccccgucuccacuaaaaauacaaaaaauuaccugggagugguggccggcaccugcaaucccagccacuggugaggauaaggcaggagaaucgcccaaacccaggaggcagaggccgcagugagccaagauugugccacugcacuccagccugggcaauaagagcaaaacuccaucuaaaacaucuguccaauugagaugguaaagccauugaagggacucuacuauggucugaaaguuugugcugcacccuuucccuccaaaauuuauauauuuuuuauuauacuuaaguucuagggcacaugugcacaacaugcauguuugauacguagguauacuugugccauguugguuugcugcacccaucaacacaucauuuacauuagguauuucuccuaaugcuaucccucccccacucccccucccgacaggccccagugugugguguucccugccuuguguccaaguguuuucauuguucaguucccaccuaugaguaagaacaugcaguguuugguuuucuguccuugugauaguuugcugagaaugaugguuuccagcuucauccaugucccugcaaaggacaugaacuaauccuuuuuuauggccgcauaguauuccaugguguauaugugccaccuuuucuuaauccagucuaucauugauggacauuuggguugguuccaagucuuugcuauugcgauuagugccacaauauacauaugucuuuauaguagcaugauuuauaauccuuuggguauauacccaguaaugggaucucugggucaaaugguauuucuaguucuagaucuuugaggaaucgccacaaugguugagcuaauuuacacuccuaccaacaguguaaaagcauuccuauuucuccacauccucuccagcaucuguuguuuccugacuuuuuaaugauugccauucuaacuggugugagaugggaucucauugugguuuugauuugcauuucucugauggccagugaugaugagcauuuuuucaugugucuguuggcugcauaaaugucuucuuuugagaagugucuguucauauccuuugcccacuuuuugaugggguuguuuuuuucuuguaaauuuguuuaaguucuuuguagauucuggauauuagcccuuugucagauggguagauugcaaaaauguucucccauucuguagguugccuguucacucugaugguaguuucuuuugccaugcagaagcucuuuuauuuaauuaggucacauuugucaguuuuggcuuuuguugccauugcuuuugguguuuuagucauggauuccuugcccaugccuauauucugaaugguauugccuagguuuucuucuaugguuuuuaugguuuuaggucuaacguuuaagucuuuaauccaucauaaauuaauuuuuguauaagguguaaggaagggguccaguuucagcuuucuacauauggcuagccaguuuucccagcaccguuuauuaaacagggaauccuuuccccauuucuuguuuuugucagguuugucaaagaucagaugguuguagaugugugguguuauuucugaggccucuguucuguuccauugaucuauaucucuguuuugguaccaguaccaugcuguuuugguuacuguagccuuguaguauaguuugaagucagguagcaugaugccuccagcuuuguucuuuuugcuuaggauugucuuggcaaugugggcucuuuuuugguuccauaugaacuuuaaaguaguuuuuuccaauucuggguagaaagucauuguuagcuugauggggacggcauugaaucuauaaauuaccuugggcaguauggccauuuucacgauauugauucuuccuauccaugagcauggaauguucuuccaguuguuuguguccucuuuuauuucugagcagugguuuguaguucuccuugaagagguccuucacaugccuuuacccagguauuuuauucucuuugaagcaauugugaaugggaguucacucaugauuuggcucucugucuguuauugguuuauaggaaugcuugugauuuuuacacauugauuuuuguauccugagacuuugcugaaguugcuuaucagcuuaggugauuuugggcucagcaguccuugagcccaggauaugguggucugauuguugguugcacagauauuucuaauucuucccuucauugcagacaaaguuuuguuuuuuuuucacuugaaacuuuaaaacucuaaacuuguaaauagaacuuuuucagccucuguuccugucuagaaaaccugguccccugguuucaaguagugcaucugacuguuguucaccgccuccucacaugagguguuuugguuuucauuuuccccagugcuggauuuuugacccuggugccuguuuucacucucagcccuucacgugcccccucgcuugagccacacugcauuacaaggaguugaucacuuguuuuagaaagggcugaauaucccacuugacuugucucuuaauuacuguauugauccauauaaagucaacuuuuccccauuucuagcucaucauuuauagauauaagaaccaucuuacuuguaaucauugaaacauacuuuaaauuacaaaaaguccacuucuaauuuaacaauuuccccuuuccccauucucaaaauguacaguggugcaguggugaauggggauggggaguguucgucccuuuuuuuuuuuuuuuuuuuuuuuuuuuugauacagggucucacuccuguugcccaggcuagaguguaguggcacaaucucgccucacugcagccuccaccucccgaguucaggugauucucccaucucagccuccugaguagcugggacuacaggcgugugccaccaugccccgcuaauuuuuuuguuuucaguagagaugggguuuugccauguugcccaggcuggucucaaacuccuggacuccagcaauccucccaccucggccucccaaagugccuggauuacaggcgugagccacugcaccuggccuguuuguucuuuuagucuuuacuuucuccccuuauucuuguggugcucacauugagggaugaagaauaaagaagaggaaagggggcgaagacuuacuugguugguucuuugguaauccagugauggcguaugugcaaaugcuugcucuuucgugcuucucauuaguguguuuucucagaggccaucauagaaccagucacuuccccaacacaggcaauauacuucauauuucaccucuuccgaaaccguucuucacuccccucauuucuggcucagcuccugcccacaaguacccuuuuacuauuuagaucaucugaccuugguacauuuuggaguuucauugauugggcuuaaaguuggacuuaacacuuggcccaggggaaguacaugcauucuuuuauuccucucaacuuuuuauuuuggaaaacuucagaccuacagaaaaguugaaugaauggugggugaauaaccauaugcccuuccacuagauucaccaacuuaauauguuaucauauuugcucgcauuuauuucauuuucuuggcuggcuaaugagaaucccaaugcagacaugacguuacuucauuccuauguacuuuugcaugaaucuccaaaaaucaaagauagguuuuuuuauguuauacucugaaaauuuaacauugauaugguacuguuaccuaauauacaguaccuauuaagauuuucccaaauguuucaauaccuuguauagcuguuuuuccuccugauccagcguauaauaaagauuucaguucauuuuucauguuucuuuaaucaugaacaguucccccagccuauuuuuuuuaccuuucauaacguuugacuuuuuuuuaaaggagucuacaccaguucuuuuguagaaugucucucaacuuagauuugugugauuguuuuuucgugaugagauugagguuaaacauuuuuacuaauguuuuguuaaggugauaucaccagaguucuuuguaaaaguacuuuuuccuguguaaucuguggagugucauuuuaagaccgaauggauuucuuauucccuaacagucuuuuacucuguaguuuuagcauucauugauaauuuuugccuguauccauuauuaacuugauauuuguaauauggugauguucuaauucugucauuucuucuauagagagaagaugguuuucuuauguaaagaacaacuuuccuuuuuucucccaccaucaaaagaaauaauuuauugucagcauagacucauguauuuuuucaguguguuauuaucuguuucuguaauuaugcauuuuguugugcagcuuguuccaaacucguccucuagggagucuaugcauucuugcccugccaaacaguggaaacaccgcuuguccaacugccggccuuuucccuccauugguaaaguuggccccaggcaacuuacugaguuuggaccucucauugcuaagggaggcacuuagcucaugggaaauauauuuacauaugcucccaaaugugcagauucauauguugaauuuuccuaagaacacucccugugccacccacaccugacauaugccugguaguuucuguggcucaguaaucccccaccacagaguaagaugccuuucuccacuuucagagguucuuuuagagccuccauuuaccugaugugauuuuacaaugccccauucuccuggggaaguaaggagaagagucacaguucuuuuuaguccuuugaauucucucacggaaugccuuuugggauuuuuuugucuuuucuuuuauggccugauguggugcucuaaggcucacuuuuaguccugugcaggucuuuagaauaugagauguauugguuugcuaggacuacuguuacaagguaccacaaacugaacuuugucucaguaagauguuagaagucgaagggcaagguguuggcaggguugcuuucuuugaggacucugagaaagacucuauucugugccucuguccuagcuucuggugguuugcuggcagucuuugguguuucuugguuuguagaugcaucacccugauaucugccuuugucuucacauagcauucucccuauguguaucuguguccaaauuuccccauuuuauaagaauaucagucauagcggauuagcugccuacccuacuguaguaucaccucauccuaacuuaacuauaacuuaauauaguaaguaauauauauauacgauauuaacuuauacuaauauauauacagagaguuccuuguaugcuuuggauaacuagccccuuaucagauacaugauuugcaaaaauuucccccccaauuuguggcauuucauuuucauaaugguucuuugacacugaaacauuuauaguugugaugaaguucaucuucaguuuuucuuuuauggauacuuuuggugucauaucuaagaauacuuuacccacccaaagucacaaagauuuuuuucuucuauauuuguucuaaaguuuuacaguuuuuacucuuaacacuuaggucgcuuauccauuuugauucaauuuuuguguauagugugagguagggucuaaaugaauauuuuugccuguggauaucugguuguccuaguaccauuuguuaaaaagccugucuuuucuccugauuuaucuugucaaaaagccuuauauugucaaaaguuccuuauauuccauaauauagacucucaauucuguuguugauuuacaugucugucuuugugccaguaucagccugucuugauuacuguggcuuucuaguaaguuuucaaauucaauaguguacauucauuuuugaaauuguuuuggcuauucuagcugcuuuggcuuucauaaaucuuaggauuggcuggucaauucuacaaaaaaaauccugcugggauuucgauagugaauacauugaauuuacacaucaguuuggggagaagccaucuucaauauuaaguguuccaaucugugaacauuaaaagucuauuuauuuagaucuccuuuauaaaugauuuucaguguacaagucauacauagccuuuauuaaauuuauuccuaaguuucuaucccuuuugauguuacugugaaugaaauugucuacaucaauuuccucaugaguuuacucauuuuucauguauagauauacaauugauuuuucuuauauugaucuuguauucugcaacuuuguggaacuuauuuauuuagguuauuuauuuaaccuuacuuauuaagguuauuuuuuucccuuagguuuucaggugggagggcagaccagucccuuucacuccauuuuggcugggaggagaagucuacucaaaggguugugagaaaugaauaaaaccauuugagauaaaaacuuuuccaugaaucuuauuccaacaaagaccuuguuaguauagucccucaguauccauggaggauagauuccaggaccucccugagauaccaaaauccgcagacgcgcaagugccuuauaugaaauggugucguguuugcauguaaccuacaugcaucuucccauauacuuuaaaucaucuguagauuacauagaaaaccuaauacaauauaaaugcuauguaaauaguuguuaaacuguauuuuuaaauguuuuuuuaauuuuuauuuuuguuuuauuuuugauucaugguugcuugaauucacagaugugguggaaauugcagauacagagggugaguaguguuuuaauuuuucaaguuaaauuucuuggucuaaguaaauuuucuauuuccauugcagcauuccucugaauauugauuugcugaauagcccagacuuauuggaagcaacgauuggugauguaauuggggcaucugacacuauggaaacaucccaagcacugaaugacguuaauguagccaccaggcuuccgggauuaggggaaccugaaguugaauaugagaguaaguaaauguuccauuauacaucagugauaccuuuuuaucuuccuuugaaauaagauauuuaaaucagcuucuccaauaauauuuuuuguacuaguucaacuuuuaaauuuaauucagaagaguuaugcccucuugccuuuuugacuuaagguaacacugaaauauuuaagauaacauaauugaggucauuaaacuugugugucauuuauaagacauuaaacauuuaagagucuucaaacuugcuuuuugcuuuuuuucuagaguggaaacauuuucuagggcauaggauugaaugaauauuugaacaucccauuagcuguuagaaaguauuuuguuauuaaugaggauuauuauugccuaggcccacaaaaagaaauaacacagaaagaauggugcuuuaaaacacacacacacacacacacacacacacacacacauuuuugaagguuaaaaggagacaguaaaucucucauugaaaaugucuauguauuugugaguuuaguuuuauaugaaagcauaacuuguuuauaaacagcaguuuccuguugaaucucacuguaaugcauguucauuuuaaagcagcuuguauuuauuuggcucuugaccauuugauuucuauuggaggcuaaaauuagccaccaucauuaaacaacucagaaaauugcccuaaguaugcuguugucucugagacuguagaauacaauaauauuuaguaauuuagaaauaaauguuagugaaaagucacacagugcuucugauuaauagaacauguugaaguaugacugauaaguggugcuaaaaauuuguguauuuccuaagaaauaacuacaaacaaauguucugguacaucaugguuuuuuuuuuuuuugacaucuaacguguuuaaauugugcuuguuagucucaggucagagaaauaauaauuuaacuuauuauauugguaauuucaaaguaauuuugauuuuuuaagguaguagucuguuauuagauuaagaaaauaucccccauuacuauuucucauguacuuucucuguaguaauuuauuucgaauaguccaguuuugacagccuugcccuggacuccacuucuuguuagcaaugcuugcucuuguucucacuuauaugugggagcuacacagggacauaaagaugggaacauuagacacugaggauuccuaaaggagggauggacugggaaagggcugaaaaacuuccuauugggugcuguguucacuuucugggagaugagaucaguagaagcccaaaccaugguaccacguaauauacccuuauaacaaaccugcacaugugcucccugaaucuaaaauuaaaauuaggcuggaugugguggcacaugucugcaaucccagcuacucgggaggcugagacaugagaaucgcuugaaccugggaggcagagguugcagugagcugagauugugccacugagcuccagccugggccacagagcaagacucugucucaaaaaaaaaaagaaagaaagaaagaaaaaauuaaaaaaagaaauuugcuuuucguuucuagaaagaauugagaccauagcaaagccaucaggauuuagauucagccagaaccaugacuaucuuaaugcagaguauuuccaggguuaaaaauaaaaacagucuccuuuauagagauggcaguauugauuuuauuuacauuccacuugauauccauuacacuaauucacaaaguuuaauuuuuucagugcuguaauaguguuguauuaguaucacuuauugaauacauacuuuuugcaaaauauauuagcuuaggauuuacaugguaaaaugaacuaggaaugcuuaaaaaaagaucaaaugaaauauaacucuccaaauauuuggaaaucugauauaucaaagaauuuguuuuauggcacuuuauuggugaaccuuggaugagcaauuugcaaguauggggaaauagacuguacaucaguaaggggaaguuuuuuaacuguuuaugcuguauaauagaaauagguuccuggccaagcacaguggcucacgccuguaaucccagcacuucgggaggccaaggcaggcggaucaccugaggucagcaguucgagaccagccuggccaacauggcaaaacccagucucuacuaaaaguacaaaaauuagccggccaugguggcaggcaccuguaaucccagcuacuuaggaggcugaggcaggagaaucaguugaacccgagaggcagagguugcagugagccgagauggcaccacuguacuccagccugggcaagagugagacuccaucucaaaaaaaaaaaaaaaaaaggguuccuaagaguuagugagcaccucauuacagaaaguauuaaagcggagcuugaauguugucaagguuguggcagaggaaauucuugcauagugugggaguuuaguucauaugaccuaauccauucagacuuauaacauuugcucaaaaucaaucagugagaauaauuagaacauuuuuauguuaagaguuuaaggucaucaaucuugauauccaauuguguauuuuauuuugguuguaaugucaaaauccugauucacauagguaaauaguuacaaaugguaacuaaaauagcuugugcugcauggcaggauguuccuuggacaaaauaguauagcagaaaaagguuuaacaacaacaaaaagaguauucaggauggaguaauuugaagcauaauaaaaccaggagauggcaauuaaguaaauggacaggaaagauuuugagaagaccaguguugaauuacuggugcucagcuuugguuguacuuaaaaucaccuggagaguuuuaaaaacuaccagugccagaauccuaccugaaaagauuuuguuauaauuauucuugggugagcccugggaaugagcguuucuugaaagcucuccagcugauuguuaacguguauccggggccuccacucaguuaauugauggccacuuuuagaagaucccuuugacccagaggauaugauuucaaaguuucccccucuuuucuucuuucugaucauauagaaauuauuaggcauucaaccuuuuuugucaaguugacaguguaaaauuuuaugcacacaucaaauuaaucucugcaaaauaagauuauuucaggacaguuaauuuuaaaagucuucauuuaaagaugaauuguguuuaauguauuauguuuucagugguuagaggacuuuguaauguauuuugccacuaggaagaacauuaugaagacaaaaugcuugucuugcgucacaccugaugguaccaauauauaauauguugaaucagugaacgaauaaauauauauucuucauuaguuuguuccacauaaauuuaguuuuaggcaguagucagggccaacgaacaaagauggcaaaguguugagguuagacaugagccuggguugugguuaugaaagaaaaggaucaugucacaaguguucugugccuuuugggucucuuggcuagguaaaccuucuuaaccacacaugcuagggagauuucacaucuacuugcuuuuuaggagugcugcagauauagggugguguuucuacuuaggauuaacucuuauucaaauuaauggacagauagcugguuauggaaagaaaauauauuuauuuuguguuuaucuggauuauuacuuuuaguugaugauaacugauguugagaagacaaaacaaaaccauacccucacacagcuagcugugacagccuggcagacugggguuauuuugccuuuuuuuuuucuuuucagcauuaaaagacaccucagagaagcucaaacagcuugagauggagaacaguccuuugcuguccccucgauccaacaucgauguuaacauaaacagccagguauucagauuuccccuguguauaccuguuacacaucuccagagcucccagaaauauuuucuuuccaaagacaguacuuucuuuuuucuuuagcugggaaaucugucugugcugaguucuuauaaaccuguuuucucauuuuaaagggugaaauauguagauguuuaggagggaagggggaaacuugcacagcaaagugaauuguaaggugauuucaugauuuaaaaaaaaaaacacagucaagaugaguguuaaaccuuuuauuuugauugacccagucuaguuggaagacuugcugaagccuuuugaaauuacagaaggauuuguuuuaaagagagcugcucugugguauaaacaagaaagagaauagaauuucagaugcuuuaacuucaucuaucauuccuuucucuccccuguccccuuugaauuuuuuuuguuguagggugggggauacauaccaauuacaccaaucaagcuucaauuuauaguuuggcuaugauuuucuuauuucuauguuaaguaacuuauagaaagagcuaaaauaaauugaaugagauggaaauuuuauaauuaaucauaucagcuaccagauggccccacuaaauggaagaguugauuuuagguaaugaccuggaaauggccuuuuuuuucccucuacauacagacaacugauaacaugaccaagaugaauuuuguuuuuguuuuaaagaggaaaggagaacggcugacucacgguguucuuccauucuuggauaacuaacuggaauuccuuuagagaccagcagagaguagaaagugauugucuucugucucgcacucgcacuguuaugauucaaacugucuuucgggauccaagccuuuuuuuccccuuucuuucuaauacauuuuuuauuagaaauagcuguuagaaggugauucaauuucagaaaggcuuuccauuuucuugacuuuucaguauucuaucccacuugucuguuugcuuuuacagugucaguuuuuuaaauauaucucuguaaaguaggggaaugcagggccagagacagaaggauaaauggaaaacuuuagauaaaagcuuuagaugauuaauaacuaauggaaauuuaguggaggacuggaaugacccuaaagaaugaagccugguaacacuuggggguagggaggaguggggggcggggauuguuggcugugcucagaguucauggaaaucuauugaacagcuacuuguuucuuuguaaaauguccugcuuaucucacuaugauauaacugauccucugaggcagagagucugcugcauuaguuuugaagccuugaaaagaugaggaggaguguggguucaggauaggagaguaaaggagcacuuuaggugaaggacagagugccaucaaagaacuuuuaggggaucauauagcuaggaagaauaacaauauuuagugaggguuuacucuaugccagacaagaauagaaggaaggaggggauggagcaagauggccaaauauaacccuccagugaucaucccccuugcaggaacaccaaauuaaauagcucuccauacaagaaagcaccuucauaagaaccggaaaucaggugaaccaucauaguaccugguuuuaacauuauaccaaggaaggaggcacugaagaggguaggaaagacagucuugaauggcugaugccaccccuccccuauggaggaguguggugcugagagagaaucugugcuugggagagggagagcacagugacuauggcacuuuguauuggaacucaguguuuguuggucugucugucggaauggaaagcaaugcagggcacaauuucgcuggugcccacagaggcugcauuuagaacagcccuagccagagaagaaucuuccauccuagcaauuggaaccugaguuccagcuagcccaccgcugugggcuaaagugcuguaagcuccuaaauaaauuugaaagauagucuaggccacaaggacuacaauuccugggcacauccugguacugugcugggcucagagccaguggaccugggguacacaugaccuagagagauacuagcuggaggagccaaaggagugcuugcaucacccucucccagucccaggcagugcagcuuacagcucugggagagacuucuuccacuugaggaaaggugagggaagaguaaagaagacuuugucuuguagcuuggauaccaguguagccacaguaaaacaaagcaccaagcagaguccuaaagccuccauuucaggccccaccucccaaugacauuucuagacauaccaugggccggaagggaaccugcugucuugagggaaaguauccaguccuggcaggaucugucaccugcugacaaaagaauccuugggucagugguuuccaggcaguacuugucauaggccuugggcaagaccugguaccaugcuggcuucaggugugacccagggcauuuucagcugugguggccauggggagagacaccuucugcuugaggaaaggagagggaagaauaaaaagaacuuugucuugcaacuuggguaacagcucagucacaguaaaauaaaguacugaguagauuccuacaguucccaacuccaggcccuagcuccuuagacggcauuucugaacuagcccugagccagaagagaaccugcagucuuacagagaaaugcacaagucuggcuggauucaccacuugcugacggaagaaccuuugggccuugaauaaacaugaguguuggccaaacaauagucaccacauaccucgggugagacccaguacuucacuggcuucacuggcaggucugacucagcacagugucaguggguagccacaggggugcuugugucguuccucccccaacugcaugcagcucacugagaagagagagacuuuaugggagaaagugagggaagagaacaagagacucugccagguaauccagggaauucucccggaucuuacccaagacuaccaaggcuguaccuuaacaagccugcaagagucacagccuuacugggcaugagguucccccuaaugcagauauggcuggagugaccaaaaacuuguaucacaacauucaguucccuuugaauaacuacaacggcuucuuaagacagauggguagaaacaagcccagacugcagagauuacaauaaauacccaacucuuuaaugcccagacauaaacaagcauccaagaucauccaggaaaacaugaccucaccaaacaaacuaaauaaggcaucagugaccaaucccagauugacagagagagauaugugaccuuucaggcagauaauucaaauagcuguuuugaggaaacucagugaaauucaagauaacacagaaaaggaauucagaauucuaucagauaaauuuaacaaagagauugaaauaauuuuuaaaaauuagcaggaauccuagagcugaaaaauucaauugacguaaugaagaaugcaucagagucuuucaaccacagaauugaucaagcagaagaaagaauuagugagcuugaagacaggcuguuugaaaauauagucagaggagacaagaaaaaaaugaagcacuccuagaagaucuagaguauagcuucaaaaggacaaaucgaagaguuauuggccuuaaagaagagguaaagagaugugguagaaaguuuguucaaagggauaauaacagagaaugucccaaaccuagagaaagauaucaauauucaaguacaagaaggauauagaacgccaagcagacuuaacccaaauaggacuaccucaagauauugaauaaucaaacucccaaaugucaauguuaaagaauccuaaaaacagcaagauaaaagaaacaaauaacauacaagggaaaugucaguguuaaagaauccuaaaagcagcaagagaaaagaaacaaacaacauacaaaggugcuucaguaagucgaagcagacuuuucagcagacaccucacaggccaggagagaguggcaugacauauuuaaagugaaguaaaaauuuuuauccuaaaauaguauauccauguuugaagauacccuucaaacaugaaggagaaauacuuucccagacaaacaaaagcugagggauuucaccagaccugucuuauaagaaaugcugaaaggaguucuucaaucugaaaggaaaagauguuaaugagcaauaagauaaucaucugaugguacacaacucacugguaaugguauguacacuaacaaauacggcauauuauaacacugaaauuguuguguauaaacuauucauaucuuuaguaggaaggcuaaaagacuaucaaaaauguaacuacaacaacuuuucuagacauaauauaguaagccauaaauagaaacaacaaaaaguuaaaaagcuggggguggggguggcgguuugaaguugaaguauagaguuuuuauuaguuuucucuuugcuuguuaauuuuuuuuuuuuuuuuacuaucaguguugucaucaguuuaaaauaacauguuacaagaugguauuugcaaaccucaugguaaccucaaauaaaaaagccuacaacagauacacaaagaaauaaaaagcaagaaauuuaaacauaccaucagagaaaagcacccuucacaaaaaggaaggcaggcaagaaggaagagaagaucacaaaacaaucagaaaacagauugaaauggcaauaauaaauccuuacuuaucaauaauaauauugaauguaaaugaacuaaacucuccaaucaaaacacagaguggcuacauggauuaaaaaaaaaaaagcccccaaugaucagcugccuacaagaugcacauuuuaccuauaaagacccauaaagacugaaaauaaaggguuggaaaaagauauuccaugcaaauggaaaccaaaaaagagcagguuauuuauauuagauaaaacugauuuugagacaaaaaccauaaaaagacaaagaaggucauuauauauugauaaauggucaauugagcaagaggauauaacauuauaaauaauauaugcaccuaaaacuggaguacccagauauguagagcagauauuaucagagcuacagagagauacaccucgguacaauucuagcuggagaauucaccccacauucagcagaggauagaaaauccagaaaaauuaacucaaaaaauuggauuuaaucaguguagaccaauggaccuaauagaacauuuuaucuaguggcagcagaacauacauucuuguccucagcgcacagauuauucucaaggauagaccacauguuaagucacaaaacaagucugaacauucaaaaaaacaaaucauuuccaguaucuucucugaccacauggaauaaaacuagaaaucaauaacaagagaaacuuuggaaacuauacaaccacauggaaaucaaacaauaugcuuccaaaugaccagugggucaaugaagaaguaaggaaauuuuuuaauuucuugaaacaaaugaaaauggaaacaaaacauacuaaaaucuaucgauacagcgaaagcaguacugaggaaaguuuauagcaauaagcaccuacaucacaaaaguagaacaauuucagauaaacagccuaaugaugcaucuuaaggaacuagaaaagcaagagcaaacuaaacccaaaauuaguagaagaaaagaaauaauaaagaucagagcagaaauaaaggaaauugaaaccaaaaaauacaaaagaucaauaaaauaaaaaguugcuuugugaaaagauaaacaaaauggacaaaccuuuggccagauuaagaaaaaagagaagacucaaauaaauaaaauuguagaugaaaaaggagacuuauaacugauacugcaaaaaucaaaggaucauuaaggauuaguaugagcaacuauaugccaauaaauuggaaaacauugaagaaauggaugaauuccuagacacaugcagccuaccaggacugaaccaagaaggaauccaaaaccugaauagaccaauaacaaguaacaagaucgaagcuguaauaaaaagucucccagcaaagaaaagcccaggaccugauggcuucacugcugaauuuuaccaaauauuuaaagaagaacuaauaccuauccuacucaaacuauuccaaaaaauagaggaggaaagaauauuuccaaauucauuuuaugagaucaguauuacccugauaacaaaaccagacaaagauaccucaaaaaaggaaaacuguagaccaguaucucugaugaauacugaugcaaaaaucuucaauaaaauacuagcaaacugaauucaacaacauauuaaaaagauaagucaucacguccaagugggauuuaucccaggauguaauaaggauggguuagcacauguaaaucaaucaagggugauacauuauaucagcagaaugaaggacaaaaaccauaugaucauuucaauugaugcugaaaaaacauuugauaaaguucaauaucccuuugugauuaagaaaaaaaaacuaaaaaaacuggguauagauggaacauaccucagcacacuaaaagccauguuaugacagacccacagcuaguaucaugccugaaagccuccuuuaagaucuggaaaaaggcaaggaugcccacuuucacugcuguuauucaguguaguacuggaagaccuagcuagagcaaucagacaagagaaugaaauaaagggcaucuaaauuggaaaggaagaauucaaauuaucaucagaugauacuauuuuauauuuggaaaaaacuaaagaaaaagaaaaacaauuagaacuaauaaauucaguaaaguggcaggauacagaucaacauacaaaaaucaguagcauuucuacaugccaacagcaaacaaacugaagaaaaaaucaggaaaguaaucccauuuacaauagccacaaauaaaaugaaauaccuaagaauaaaaauaaucaaagaagugaaagauuucugcaaugaaaacuacaaaauaaugguaugagauaucgaagaggacacaaaauuugaaagauauuccauguucauggauuagaagacucaguauugauucaauguccauacuucccaaagcaguuugccaauucaauuuaaucccuaucaaaauaccaaugauauucuucaaagaaauagaaaaaaauaaucuaaaauuuauauggaaccacaaaagacucagaauagccaaagccguccugagaagaaaaaacgaaacuuuagaacucauaguaccugacuucaaauuauacuacagagcuauaguaaccaaaacucaugguauuagcauaaaaacagacacauagaccaauguaacagaauagagaagccagaaauaaauccauacaucugcagugagcuuacuuuugacaaaggugccaagaacauacacuggggaaaggacagucucuucaauaaauggugcuaggaaaacuggauuuccauaugcagaagaaugaaacuucuaucucugccauauacaaaaaucaaaugaaaauggauuaaagacuuaaaucuaaggucucaaacuaugaaaccacuaaaagaaaauauuggagcaacucucuaaaacaucagucuaugcaaagauuucuugaauaauaucccaaaagcauaggcaaccaaagcaaaaauagacaaaugagaucacaucaaguuaaaaaguuccugcacagcaaaggaaacaaucaacaaagugaagagaugacccacagaaugguagaaaauaucugcaaauuacccaucugacaauggacuaauaaccagaauauauaaagagcucagacaacucaauaggaaaaaaaucugauaaucugauuuuaaaaugggcaaaaaaucugaauagacauuucccaaaagaagacauacaaauggcaaacaaguuuaugaaaaggugcucaacaucacugaucaucagagaaaugccaaucaaaacuccagugagauaucaucucaccccaguuauaauggcuuuuauccaaaagacaggcaauaaugaaugcugacgaggauguggagagaaaggaacccuuguacacuguuggugggaauguaaauuaguacagaaguacagagugccucaaaaacccaaaaauggaacgaucauaugauccagcaauccuacugcuagauaauaugcccaaaagaaaggaaaucaguauaucgaagagauaucugcacucccauguuuauuguggcacuguucacaguagccaagauuuggaaucaaccuaaauaucuaucaacagaugaauagauaaagaaaaucugguacauauacacaaugaaguacuauucggccauaaaaagaaugagauacuaucauuugcaacaacauggauggaacuggaggacacuauauuaagagaagccaggcacagaaagacaaacuugguauguucucauuuaugggagccaaaaaacgaagaauuaaacuugcggagauagaugguuaccagaugggaaggguaguauggaggguguggggaaaaguggguaugguuaauggcuacaaaaguauaguuagagugauagaauggguaagagauagcauuugauagcauaacagggugacuacagucaauaacuuacuguacauuuaaaaauaacgguauaauuggaauguuuguacacaagaaaugauaaauguuugaggugauggauacuccauuuacccugaugugaugauuacacauuguaugccuguaucuacauaucucguguaccccauaaauguauacaaguacuauguacccauaaaaauagaaaagauuuuuuaagaaaagaaggaagaauucaguauuguacuacuaauaaaggacaugugacuaccuugccuuaacucuagucaacuugaguagaaguugagccccccgaucugaaaauuuaaaauucaaaaugauccagaaucuaauacuuuuugagcacugaugugaugcacaaaggacaugcucauuggagcauuuuuuauuuuggauuuucguauuuggaaugcucaaccaguguauaaugcauauaucccaaaaucugaaaaaauacaaaaucugaaauacuuuuagucccaagcacuuuggaaaagggaugcacaaccuguauugugaaaaaguugauucauguuuuauuaaugugaugcauuuuuaauaaaggcugauuucucuaccucugcuaucaacaguuguuguuugcuuaaggaaugcaaauuaaucuuaauguuggccugacuaaaguaauuuuaggaagaaaaccuacugaaaauaaaauacgucauucuaaaguaaagcaugauuuguuggaugacuugcccuaagaacugagaaugucuuagccagcaaccuaaucuuaaggcucagacuagcacuacugacagcagaguugacaguguuguaagagcccauuguagagagaucacauccggccugcauuaugcaggauuuauacagucaccugacaugccuuauguacuguugguucaguucuaaaaauguguuuauugccuacuuuuuguaagauaaaauaaauacuguguggaauucgcagacgaguggaaugacaaguucuugacccucaggaaacuuuagcccugucuaaaucccacagaaguuaauauugcaaauggccaucuccagugaccacuuucuuucccaggucuauuaugcuaauugaauuuucagaugauaacagcugggaaguacaguuuuugaaagacaaaaucaggauccaugaaggcuuggauagauuggaaugacagacuggguuuaagaacauagacuuugacaaaucauaaguacagggcuaggguaggggacuagaauaucacagcagcauguauuuaaaaaguaagaauauguaaaugaaguaugaaucagcugccaaagaguuauguugucuuaauucaaaggguucaaaaggggagguucaacuauuuuuuucauuucuggauagcacucuaaaaaugauauagaaaaguggcaguuugagaagagaaggaucuguauggugaagggucuugaaacuaaguuacaauuugggauuauuagcuagaugauugccacguagaaaucucaggagagagcauguuaaccaucuuuagauauaugaagagcuauuaugugaaagaggaauuaaugugacuugcuuuuuaauggccucagggaagaguuaaggucaaugaauauguuagagguaugcagauuugaccuuaacacaggaaaguguuuccuaacagucaucugaccaaggaaguagcaaguuuuccagugugugauguuucucaggcuaagacuaaaaauuacccaccucuugaaguauuuuggugguuggauggacucuuguaacuuccaacuuugagaugccgugauucuaggaguugucaagauucuucucuuucuucaucccuccucucugcaacuuagucucugugcuuucuuuuuuaaaaaaaaaaaaaaaaaaaaacaagguaaaauauacauauauaauuuaccaucuugaccauuuuuaaguguaucguucagugguaauaaauacauuuauauuauuuauuugucuccuucauuauccccuuccagacuucgguuuucucuugaccuaugucugaaauccuuuaggauuuaugaccuaucaagaucuauagauuuuugaauuacuuccuuccccuuaauuuccuaaggcaauccagaauguucuuuaucuucaaauuuuauuucaggaaucaguuuuucuuguucuuugaugagcaguacuuuguuuuaaaagcauaaaggaacagaaucucaacugcauucagcgaggacagugggugcaauuaaggcaugugugagcuuuagcaacuaguauuuuugggcuaaaagaugaaaaguagggcaugaagucuauucucuugaccagagguuggcagauuauuuuaguaaauauuaguaaauaguaaaggaccagauaguaaauauuuuagucuugcagaaccucguagucucuuucacagcuacuuagcucugccaguuguagcaugaaagcggcacagaggaaugaauauggcugaauuccagcaaacuguguuuauacaacaggugguuggccagauuugcccuuuggguuauaguuugcuacaauuuuagguuaggcccuacagaggcuguuccuuuuaaauccagagcucuucacagauagaugacuuuaagaauugcuuaugccugaaauaagauauggcugcuuaagacacaugauuuccugauugucugcagaugaacuuucaucagucuauuuccuauuuccauauaacuauagugcaucagaguugauuauaguauauuuuuaaaauaucuaggaggaaguggugaaguugacugagaaaugccuuaauaaugucauugagagcccaggauugaaugucaugagaguuccuccugacuucaagaguaacauuuugaaggcucaaguagaagcagugcauaagguaagcugccuuugauagauagcccuggugaagugaaaugagcaugggauguagagaguugccuuccccaacucuaaauucuaaucaagcuagauuaauggugcagucagggaguuaaaaaauaagaguaaagaugcucagggggauacgaaggcuaaaaaagccaaauuuguauagaagugagccuucaauguuugccacuuugauagccagaaagccuugugauuuuuaaagccuuauuucaguauuaaaucuaugauucuaggucugucuuuauccauccacuauuccccacaacccaucuacccucaauuuggcgauauguuuauguaauuagcaaaaagagugagguacaaggugaagaguuggcugugccauggugaaggauggaggggguagggacuagcuuccaugagagaugcggcagccuuguucucaaaaucagcuuuuccuuggcucuccgugacuuucaaacuuacauucuguccuaaaaccaggacagaagccugccucacuaagucaguugucaacuaggauuucaaauucaccuguuauggagaagaugcaguuuacccauccuguccucagguacaagccuugaagagaccugauuggacuuuaggaauauuguucauguucuuuuuccauuuucuccccagaauauaaacauguuuuacaacauauuuacauauaaaauaaauauaaaauaugauaguauugacucuagaaucucauuucuguucuaccaccuacuagcuuugugacuugggcaaguuaguugauuucucugagccacaguuuaauuauguauaaaauaggauaaugguaguaccuaccuuaagcuggguuguaaaggugaaauaagauaauuaaaggacauggaauagugccuggcacauaaugagcauuuagaaaguguugacccucaauaguuauaguagcaguaguaguaauaguuauuauuugcuauggucugaaugguugcauacccccgcaaaauuuuuauguugaaaccuaauccccaaagccaugguauuaacagauggggccuuugguagagcccccaagaguaggauuagugcucuuauaaaagagccuggagggaacuuauuuaacccuucaaccaugugaggaugcagugagaaggcgccaucuaugaggaaugggcccucaccaagcacuaauucugccagugccauaaucuucuguuucucagcccccagaacugugaggaauaaauauuuguuauuuauaggccacucagauuauguuguuuuguuagaacagccugaauggacuaagaaaucauuaccuuacauuucaguuaucauuuuggaucuuucuugacuugaggaauagagaaguaacaugaguaacccuaaaguaaagggauuugauuuuauagugaaaagaccuucucaugaagagaaauccaggaucaaauaccuucauugugaaaucuacuaaacauuuauggaagaaauauuagcaguucuacaaaguuuuucaaaaagauagaagaggaaggaacacuucccaauucaucuuaugagacuagugucaccccaguaccaaaaccagaaaaaaaauacaagaaacuacagaccacuacuccucuugaacauuaacuuaaaaguucuuaacaaaauauauucaaaacuuuauaaguaggaucauacaucaugaccaaguaggguuuaucuuggggaaaauguugguuuaucauucaaaacccaagauaguucaccauauuaaaaaauacauaaaauugucucaauucauguagaaaagcauuucacaaaauucaacaccuguucaugauaaaaacucucagcaaacuagcaaaagaaugaaacuccuucacuuugauaaagagcauuuaugaacaaaaucuacaacaucauaauuaaugaugaaagccacauccacugaaauagcuaaaauuaaacacugaccaucccugugcuggugaugauagagcuccuguggugcacauacauugcugguaagaacauaaaauuguauaaacacuuuaaaagaguuuggcaaugcaucagacauacacauaucaucuaacccgcaauuacauucuuagauauuugcccaagagaaaucaaaacucagguuaacacagauguuaguacaugaauguuccuagcagcuuuauaugaaauagcuaaaaacagaugauugugauguaucuauacaaugaaaugucugaauaaaaaggaauaaauuagugauuuguacaacaacaugagugaaucucaaagacaucuccaugcugcucuaaagaagcagauggaaaggauagguacugugauuccaauuauaugaaacuguguaaaguauagaucaucauuuaccucaaauaaggguuuuuucaugggauuaugugggaagccucaagggaauauugaggcggggagugggggagauaguagaaauguuacaugauguuggcuaaacacuuguaugccuuuaaaaaaauuuauuaaacuguacuuuaaaaaaaauuggugcauuauugaugccaggugcggugccucaugccuguaaucccaccaccuugggaggcccaggcagguggauuacuugacaucaggagaguucaagauugacugaccuacauggugaaaccaugucucuacuaaaaauacaaaaauuagccaggugugguggcacauaccuguaaucccagcuacucgggaggcugaggcaggagaaucacuugaaccugggaggcagagguugcagugagcugagauuguaccacugcacuccagccugggggacagagugagacucaaucucaaaaaaaaaauaaaaaaugggugcauuauugagaaccaucuaguaagauugugugaauuuguauaccaaauaaaaaaaggaaucuuugauuauuaauuuagguaugggguaagauuguacuagguacacugcugguauuuccauagauaagguaugauuaccucuuauuuuaauuaaagcaaacugauauuucuguuguuaccagaaagaaauguaaauuucuuguuacuuuaguauccucaauaaagauuuacuuuuuuuaauauuucauuuucuuagguuacaaaagaagauagcuuauuaagucauaaaaaugccaauguucaggaugcugccacaaacagguacaguucuggguagacugaauuaaauugauguucuuaucuaucuuugucuuuuuuuucuucucagucugucaccacaugguuucaggaugucugucugaaagauagcuugaauucacucuauuguauccauuacagaccacuuaguaccuaguuuuauauuauuugaagauguuccuaauuagucucccaacauucccauuuaucuucaacugauucgaaccaacagagcagaaaccgucuuaaagauaugugugaucuuuucagucaccugguaaggaguguguauuauucucuuacaguaaacuuucaugucauccuguuaucacaauggccuuguucuuaucaacuuacuugccauggguucucacaguaauguaguuaacuuucuuugcugcucccuccaagucucuucugcccuugcucccuuuaaugaguauuuuggcauuuauuugucuuguuaguuaggcuuuuauuccaugcuuuauggccauugacuuucuucaccacugugaaucuaauguucugugcuuaguguuaaaaaauguugagcaaauaaaugcuguuucuuuuuuuacuguucaaaacugauucagucaaggaauaugauugugauuaaucauauucaguuccagauaccgcagucaacauggcaccacacauaguaugcauaguguauagcacuuuauauuauaauaguuaguacucagcaaaaguacuaauuggugaucaggguaaagcuagaauuacaacuugaccuuguaacuaaugcuaauugccaggcacggugucucagaccuguaaucccagcacuuucagaggucaaggcaggaggaucacuugaggccagcaguuugagacuagccugggcaagauagugagauccugucucuacaauuaaaaauaaaaaauuagccgagcauggugauccacgcuguaggccuagcuccucaaaagacugaagagggacaaucucgugagcccaggaguuugaggcugcagugagcuaugaucgcaccacugcgcuucauucugagugacagagugagacccugguuuuuuuucuaaggggccaggccgugguggcucacgccuguagucccagcacuuuggaucgccugaggucaugaauucaagaccagccuagccaacauggugaaacccgucucuacuaaaaauacgaaaauuagcugggcaugguggcgcacgccuguaaucccagcuacuggggaggccaagacaggagaauugcuugaacccaggaggcagagguugcagugagccgugaucgugccacugcacuccagcgugggcaacagagcgaaacucugucucaaaaaaaaaaaaaaaaaaaaaaggaaagaaaauucugauaaccacuguuaguaauaacauuuuuaguacuauuguuauuauugaagucuuucagaauaaaauuuuuuguuugccaggagaaggguaaugggaacaggacugcccaauguucaucagaaguuucauugaacucuugaagcuggaaagagccuagagcauacaugcagauuuauuuuucuaaaugccuguucauauuuugaagaaucuauuuuuccccuaggauuucaaaugcauccuuugaaauauacuagguucuuauauaaacauggguguauuucuagaucuuuuccuucucuuuuaaucuauuuuccccaugcuauacaacacuguucuguuuuacuguaccuccuuuuugaaaaugcaguauuuuaggcacagagacacuauggagaaguauauaauauacuguauauaguauaccuguauaccaaauaucaagcuuugucacaucuuaacauuuuaccauaauagauuuagaucauuuuucuuucuuuuuuuuacugacauaauucacauaccacaaaauucacucuuuaaaaauacacaauucaguaauuuuacaaaauugugcaaccauuaccacuauaauaaauucuagaacauuguuugagaauguucuagaaacaccauaggucuagaaacuccuuacccucacuccuuacccuuuccagaccuuagguaagguagaaaccuucauacucacuauaauacucauccuaguucucauauauacucauccucauucuaccuuaccuaaggucuucauacucacuaggaugaguauuauagugaguaugaagguuucuaccuuaccuaaagucugcaaacacuuuacccauuagcagucacuccauauucugcuucuugcccagcaccuggcaaccacuaaucuacuuugucucuguggauuuaccuacucuggacaguuuaugucaauggaauuauacguguccuuuugugucuggcuucuuacauucaacguaauauuuuccagauuuguccauauuguagcauauguugguacuuugucccuccuuauggcuaaauaauauuucauuauauagauauacaacauuuauuuauccauauaucaguugauggacauuugaauuguuuccacucuuuagcuauugugaacaaagcuagacgugaauauuugcauacaaauuuuuuuuuguaaauauacuuucaguucuccuuaguauauaccuaggaguaacaccauuucuccucagucauaugguaacucuauauuuaacuuucuuaagaacugccaaaugucuuccaaaauggccguaacauuuuucauucuuaccagcaauguaugaggauuccaauuucuccgugucauugacagugcuuauuauucuccuuguuuauuauacucauccuagugaguauaaagugugucucaucucauugugguuugauuugcauuuaccuaaggacuaaugauguugaacauccuuucguguaugucuauuuggagaaaugucuauucagaucauuuauuuuuguaguaacagcuucauugauaaauuugauucaaauaccacacaauucauccauuuaaagugugcaauucaauaguuuuugguacauuuuuguacauuuaguacauucuguauuuaguacauacaaccaccaucaguaacaaauuucagaauauuuucgucaccucaaaaagaaauccccugcucuuuaacuguaaccccaucuacccugcacugccuuuccccuaacccugaggaaguacuuuucuacuuucugucucuauagauuuaccuaucuggacauuucauauaaaugauacucuguaauaugaggucuuuugugucuggcuucuuucacuuagcauaauguuuccagggucauccauacuguacuauuauguaucaggacuuuauuuccuuuuauggcuguauaauauuucauuguauggauauaccacaguuuguuuauucaucuguugauagacauuuagauuguuuccaccuuuugacuguuaggaauauugcagcuaugaauagucauguacaauuuuguguuugaacaccuguuuuucaguuacacaucuagaguagaauuccggagucauacgguaauucugcuuuuaaccuuuuaaggaacugccaaacuguuuucuacaaccacugcaccauuuucuauuucucccaguaaugagugaggguuuuuauuucuuuacacucucaugguauuucacuguacuuuuuuuuuuuuuuuuuuuugagacagggucuugcucugucacccagguuggagugcaguggcacaagcacaacucauugcagccucaaacuuaggcucaaacgauccucccaccugagcuuccuuaguagcagggacuacaggcacaugccaccaugcucggcuaaguuuuuuuucauuucugggagagacaaggugucacuguguugcccaggcuggucuucgaacuccugagcucaagcgagccucccaucccagccuuccaaagugcugaaauuacaggugggagccaccacacccagccucaguguacuuuugauuugcauuucucuaaugauuaagaauguuggggauuuuuucauguguuuguuggccauucguguaacuucuuuggauaaaugucuauucaaguccuuugcucauuuuuuauuuuauuuucuuauuuuuuagagacauuauugcucaaucacccaggcuggaaugcaguggcacaaucauagcucacuguaaccuugaacuccugggcuuaagugauccuccugccucagcccucugaguagcuaggauuacaggcacacaccacccugcccagcuaauuuaaaaaaaaaaaguuuauuuuauuuuauuuuuuuagagauggggucucacuaaguugcucagacuggucucaagcuccuagccucaggcaauccucuuaccuuggcccuaaaaaguguugggauuacaggugugaccuacugugccugcccaccccauuuauuuuuauuucuuuuuuuuuucuaaucccaugacagauuacccauuuuuaaauuggguuuacuuuauuguugaauuguaggaguccuugauugaauaucaauucuuaauacuagacucuuaccgaauacaugauuugaaaauauuuuuucccauucuguggauugucuuuucacuuucuuagugaucagccuuuugaugcauaaaaauucuuuguuuugacgaagucuaauuuaucuacuuuucuuagguugucugugcuuuuaguguuuuauauaagaaaccauugugaaauucaagaucauaaugauuaacaguugcauagcuuuggcuagaacuuccaguauaggaaacauauuuagaucuucugucuauuuucaguuaauuuuuucagcugggcaugguggcuuaugccuguaauccaggcugaugugggaguauugcuugagcccaggaguucgagaccacccuggcuaacacagugaaacccugucucuacucaaaauacaaaaaauuagccgggugccuguagucccagcuacucgggaggcuaaggcaggagaauggcgugaaccugggaggcggagcuugcagugagccgagaucacgccacugcacuccagccugggcgacggagcgagacuccaucucaaaaaauaauaauaauaauaauaaugcagaaaaaaaccuauuagaucuaauaaacucagcacaguugcagaauacaagauaaauacacaaaaaucaguuguauuucuauacacuagcagugaacaguuugaaaacaaaauuaacaacuauguuacaacagcauaaaagauuuaaaaaccuaggaaacaauuuaaccaaggaggcaaaagacuuguacacugaaaacuacaaaacaccacugaccucaugauccacccaccucggccucccaaagugcugggauuacaggcaggagccacugcgucuggcccuuuuuuuuuuuuuuuuuuuuuuaaagacggagucuugcucuugucacccaggcuggaaugcaauggcgcgauuuugguucacugcagccucugccuccuggguucaagcgauucuccugccucacccuccugaguagcugggauuacaggcaccugccaccaugcccagcuaauuuuuguauuuuuaguagagaugggguuuuaccauguuggccaggcuaaucuugaacuccugaucucagguaaucggcccgccucggccucccaaagugcugagaugacaagugugagccaccacacccagcugguuuuuucugcauucuauaagauuuucuauauacaugauuauggcaucugugaauagcgauaguuuuacuuccuuauuuccaguugggaaguuuuuauuucuuuuucuuaccugauugcuuuggcuagaacuuccaguacaguguugaacagaagagacaaaaacugacauucuuauuuuauuccugaaagggauaaagggaaagcuuucagucuuucaccauugaguguuguguguauguuuuucauauaugcccuuuaccauacuguggaaauuccauucuauucuguuuguuuuuaucaugaaaaaguguugcauuuuuguuauaugcuuuuucugcaucaguugagaugcucaucaauugagauuuuuuccuucuuucuguuaauauggugugguuuucugauguugaaccacucuugugaacuucuagaacaaauccuacuuggucauguuauauaagcuuuuuaauauucuucucgaugcaguuugauaacauuuuuuuuaggacuuuuguauauauauucaucagggauauuggucuguagguuucuccaacuccuggccuuaagcaguacuucuaccucagccucccaaauugcuggggauuauagcugugagccaccaugccuggcugguuuguaauuuucuuacaaugucuuuauuugacuuuggugacagggcaauaguguuggccucauagcaugauuuaggaaguguuccuucuucugcuguguuuuggaagagauugagaaggauuauuguuaauucuuuaaauauuugguagaauucaccagugaagcuaugguccugggcuuuucuuuguuggaaaguuuuugauuacugauucaaucucuuuacuuguuguaagucuauucagauuuuccauuucgucuuaagucaguuuugguaauuuguuuucaggaauguuugcauuucaccuaggugauuuaauuuacuggaguaaauugcucauaguauuuucuucaaauccuuuuuauuuguuuuuuacugagagguuucacccuuuuuaauuucugauauuaguugaaucuuuucuuccucauaagucuagcuaaauauuugucaaucuuguugaucuuucaguggacuaacuuuuggauuuaaguuuuucuuaaguucuuuguuuuucuaguuccuuaagguguaaaguuagguuauugauuuuaagaucuuauuuuuaaauguagggauuuacagcuauaaauuuuauucugagcguugcuuuugcugcauuucaaauauuuugguauuuuuuucauucaucucaaauuauuuucuaauuucccuugugauuucuuccuuuauuguuuuuugagaauguuuuauuuaauuucuguauuuaugaauuuuccaguuuuccaauuaaguuauuuauaauuucauucauuaugguaagagaagauaugugguaugacuuuagucucuuuaaauguauugagauuuguuuuguggccuaacacaugcagucuaguagagaauguuuuguauguucuugagaagaagguacauguacauucugcaguuauuagguggaguguucuauauauguucauuagggcucauugguuuauauuauuguuuaauucuauuuccuuauugaucuuuucucugguuguucuacccauaaugaugaauggaagugaaauauuuaaauaucaaguuacuauuauagaauugucuauuuuccccccucaguucuuuacauauuuugcuucauauauuugggucucuguugauaguucuguauauguuuguaauuguuauaucuucuugauggauugaaucuuuuaucaauguauaaugugucucuuugucuuuuguccuuuaucuuuugauuugaagucuauuugucugauauuaguauagcaaccacagcugucuuuugguuacuauuugcauugaauaucuuuuucugucuuuucaguuucaaucuauucacaucuuuggaucauagugaggcuuguagauaacauacagauggaucauuuuaaaaaauucuuucugccacucucuaccaucguaauuuuacuuuaauccacuuacaucuaaagugauuacugauaaaggacuucuuccauuguaguauuuguuuucuguaugucuuuugucaauuuuguuccucaguuucuccauuacugucuucuuuguuuaacguuuuuuuuuuucaugagcauaccccuugauuuccuuugcauuuccuucccuauauguauuuauuuauuuauuuauuuuuugagaccaaguuucacucuuguugcccaggcuggagggcaguggcacaaucuuggcucaccgcaaccucugcuucccggguucaagcgauucuccugccucagccucccgaguaguugagaucacaggcaugcaccaccaugcccggcuaauuuuuuuuuuuguauuuuuaguagagacaggguuucuccauguuggucaggcuggucucgaacucccgaccucagguaaucugcccgccucagccucccaaagugcugggauuacaggcaugagccacugcacccggccccuucccuauauuuaaaaauuuaucccuuagugguuauuuuggaaucaaauuagcaucuuauacagccuaguuugaauuaauacuauauauagcuucaauacucugcaaaaccuuuguucuccuguauguguguguuucugccccuuuauuuuguuauugucacaaauuacauguuuaugggccaggcgugguggcucacgccuguaaucccagcacuuugggaggcugaggugggcagaucacgaggucaggagaucaaaaccauccuggcuaacauggugaaaccccgucucugcuaaaaauacaaaauauuagccgggcgugguggcgggugccuauagucccagcuacucgggaggcugaggcaggagaauggcgugaaccugggaggcggagcuugcagugagccgagaucgugccacugcaguccagccugggcgacagagcaagacuccauaucaaaacaaaaaaaaaauugcauauguacacauugugggccuauuaaaguuaauuuguaauuguuuuauguauuuaucguuuaaauaauaguggaauaaaagagaaguuauacccaaauuguaaaauacuuacuuuuaugcuuaccuguuuaauuaccuuuaccaguaauuuucucuauuuuucuuuauaugguuucgaguuacuggguaguauucuuuucuuucagcuugaagauucccuuuagcauuuuauguaaggaauaucuaccuguaagaaacuuucuuggcuuuuguuuaucugagaaugucuuaauuucgccuucauucuugaagguuaguuuuguugaauauagaauucuuaguugacaggguacuuucuuucagugcuuuuaaauaugucaucccauugccuucuggucugcaugguuucuaaugagaaguuggcuuuuacucuuaugaggauccuuguacaugaugagucguuucugucuugcaacuuucgagaaucucucuuuguuuuugucuuuugacaguuuaauuaauaugucuguuggggaucucuugaguuuauccuguggaguucauugagcuucuuagauguguagauucaugucuuuuaucaaaccuauugaauuuucaaguauuauuuauucaaauaaucuuucuaucccuuucucuucuccuuauagaacuccuguaauacguauauuaauaugcuugauuaugucccacaaguuucucaagcucugcucauuuuuuucauuauuuuuucuuucaccuccugauacugaauaaucucaguuaaccugucuuuaaguucacugacuauucugccugcuugaaucugcuauugaaauccucuagugauuuuuuuauuaaaaaaaaaaaauggagacacagaagcugggcagccuccauggggcuuccacacacuggggcuugcuuccggcccccagcgacuccaaggggaugagugaauuuaacuggcaaggagcaaucugcugucacccugggccucuggaauccuggcaggaagaggccccacgaccaccacggacacucgaguugcagggaaagcugcuuagagaagugguggggcagcaagccagcugauguggagcccagaggguuuggugcaggagcaucuauuguggagcauggccaaggacagccaucccccuagggucaacuugcucccauaggaaacuuuagcccgaggagaacuaucagaccugaacucugcagggcgaucuuguccaucagguagggcugcucugaacugagcaccccuuggucugauggucccccaggaccccagccuggccauaccugcuugccgggaagccucuggcguccuuggagccagcauccuggcuuuugcacuggcagacugugccugacuugcagagaguuccuguagggcgguccccacggccaugcaccagccugcccacucccuccccacacuucagcuucccccuggggcuacagcagugccccacaucgcuuugcuagcaugugugugcaugggcuggcuuuguuuccuugccccaccagugcaccuauguccaugcacccugcccugccacugcugcagcaggagggcaugucucucccgugucccaucaacugccacugcagucacaaccuuggcaagcacagggccagccagcacuguggcaggagugaaaauaggcauggagaacagcagauucucccccaucacgagcaaccaccccugccugcagugcacagagaaagcacacagaccuguauuacauaacaguaaaggguucaguucaacaagaagaacuaacuauccuaaauauauaugcacccaauacaggagcacccagacucggaaagcaaguucuuagagaccuucaaauagacuuauacucccacacaguaauagugggagacgucaacagcccacugauaguauuagacacaucaucgaagcagaaaaucaacaaagauauucagggccugaauucagcacugggucaaauggaccuaauagacaucuacagaacucuccaccccaaaauaacaauauacauuccucucaucacugcauggcacauacucuaaaguugauuacauaaucgaacauagaguauuccucagcaaauguagaagaacugaaaucagaacagccacucucucagacuacagcacaaucaaauuagaaaucaaaacuaagaaauucucucaaaaccauacaguuacauggaaauuaaauaaccugcuccugaauggcuuuuggguauauaauaaaaauaaggcagaagucaagaaguuacuuguagcuagugagaacaaagauaugacauaccagaaucccugggacacagcuaaggcaguguuaagagggaaauuuauagcacuaaaugcccacaucaaaaaguuagaaagaucucaauuuaacaaccuaauaucacaacuaaaaggacuggagaaccaagagaaaaccaaccccaaaacuaacagaagauaagaaaaaaaaaaauuagagcugaacugaaggagaucaagacacaaaaaaacacucaaaaaaugaggcugggcauagugacucaauggcuguaaucccagcaguuaggaagguggaggcagacggaucacuugagaccagguguucaagaccagccugaccaacauggcaaaacuccaucucuacuaaaaauauaaaauuagcugggcgggguggcgcaugccuguuaucccagguacuucagacgcugaggcacaagaauagauugaaccugggaggcggagguugcagugagccgagauugcagcacugcacuccaaccugggaaacggagugagacccugucucaaaaaaaaaaaaaaaaaaauccaaaaaaaccacaaaagaucaaugaauccaggaguugcuuuuuugaaaaaauaauagaccgcuagguagacuaaugaagaaaagagagaggaucuaaauaaacacaaucagaaacaacaaaggggauauuaccacugaccccauagaaauacacauaacuaucagagaauauuaccaaacaccucuaugcacauaaacuagaaaaucuagaagaaauuaauaaauuccuggacacacacacucucccaaggcagccaggaagaaauugaaaccugaacagaccaauaaugagcuccaaaauugaaucaguaguaaacagccuaccaaacaaaaaaagcccaggauuagauggauucacaguugaauucuacccaaugugcaaagaagugcugguaccauuacugcugaaacuauuucaaaaaauugaggaggagggacuccuccauaacucauucugugaagccagcaucauccugauacgaacaccuggcaaugacacaacaaagaaagaaaacuucaggccaguauucuugaugaacaucaaugcaaaaguccucaacaaaauacgggcaaacugaauccagcagcacaucaguccaccacaaucaaauagcuauaccccugggaugcaagguugguucagcauaugaaaaucaauaaaugugauucaucacauaaacagaaauaaagacaaaaaccacauuauuaucucaauagaugcagaaaaggcuuuugacaaaauucaacacugcuucggguuaaaaacucucaauaaaagaaguauucaaggaacauaccucaaaauaauaaaagccaucucugacaaacccacagccaacaucauacugaaugggcaaaagcuggaagcauuccccuugagaacuggcacaagacaaggaugcccucucucaccacuccuauucaacauaguauuggaaggccuagccagagcaaucaggcuggagaaagaaauaaggggcauccaaauaggaaaagaggaagucaaauuaucucuguuuccagacgacaugauucuauaucuagaaaaccccauagucucagccuaaaagcucauuaagcugauaaacaacuucagcaaagucuaaggauacaaaaucaguguacaaaaaucacuagcauuccuauacaccaacaauagucaagcugagagccaaaucaggaacgcaguccuauucacaauugccauaaaaagaauaaaauaccuaggauuuucuugguuuccagggaagugaaggaucucuacaaggauaacuacaaaacacugcuuaaagaaaucagagaugacacagacuaauggaaaaacauuccaugcccauggauagaaucaauauuggcugggugcaguggcucacuccuguaaucccagcacuuugggaggccgaggcggguggaucacgaggucaggagaucgagaucauccuggcuaacacagugaaaccccgucucuacuaaaaaaaaaaaaaacagccgggugugguggcaggugccuguaaucccagcuacucgggaggcugaggcaggagaauggagugaaccugggagguggagcuugcagcaagccgagaucgcgccacugcaccccagccugggugaaccuagggagacuccaucucaaaaaaaaaaaaaaaaaaaagugacaaucaauaucauuaaaauggccauauugcccaaagcaauuuauagauucaaugcuauuucuguuaaacuacugauaacauucuucaccgaacuagaagaaacuauuuaaaaauucauauggaaccaaaaaaaagcccaaauagccaaggcaauccuaaggaaaaagaaguagcuggaggcauuaugcuaucugacuucaaacuguacuccagggcuacaguaaccaaaacugcauguugcugguauaaaaacagacacauagaccaauggaacagaauagagagcccagaaauagugccacacaccuacaacuaucugaucuuugacaaagcugacagaaacaagcaauggagaaaggcuucccuauucaauaaauggugcuggcagacuggauuuuuaaaaugugguauguacacaccuugaaauacugugcagccauaaaaaagaaugaaauagaaugaaauuguguccuuugcagaaauauggguggagcuggaggccauuauccuuagcaaacuaacacaggaacagaaaaccaaauacugcguaaagugggagcuaaaugaugagaacacguggacacauagaggugaaaaacagacaguggagccuguuagaaaauagagcacaggaggagggagaggagcacaaaaaauaacuaauggguacuaggcuuaauaccuggcugacagaauaaucuguacaacaaauuccaaugauacaaguuuaccuguauaacaaaccugcacauguaccucugaaguuaaaaaaaaauuauacuuuucggcuucaaaguuaauuccuuuuuauaauuuuucuuaauauucuauauuuguugguacauuguuuucuugguuuccuuuacuucuuuguccacagcuuccuuuaacuuuuuaaaauauugaugcacuauagauguacuuuguuucaggguacaugugacaauacguuaagcacuugggcacuuaggucaguuccauauuuugacuguagugaguagagcugcaaugagaaugagaggcagaugucuuuuugauauauugauuuucuuucuuuuggauguuuacccauuaguggaauugcugaaccauauggucauucucuuuuuaguuuuugaggaaccuccauacuguucuuuaaaguugcuguacuaauuuacauucccaccagcagcguaagaggguuacccuuucuauggguccucaccagcaucuguuauugccuaucuuuuuuauuaaaaaaccauuuuaacuggagcgagaugaugucucaucauaguuuggauuuacauuucccugaugauuuugagcauuuuuucauauaccuuccccuacaugaauuuguugcacuucuuuccuaagcccuuucuuugaaaauccugccuguaccuguacagguccuacaugaugugaauuuaucuuuuucuuccuagugcuguguuaaaugagaauaaugugccccuccccaaagagucucuugagacucugaugcuuaucacaccugccgacagugguucuguucuaaagguaagaauacuuuuacuucuuaaaauuuuugccaaagacaguuuugaauugaaucuugcaguauaaccaagggcaucuagugauuacugagugacacugggacuuaagaugugagaagagcagccgagcacaggggcucacaccuauaauuccagcacuuugggaggccgaggcauguggaccacuugagcucaggaguucaagaccagccugggcaacauggcaaaaccugucucuaccaauaauacaaaaaauaagcugggcaugguggcaugugccuauggucccagcuucucaggaggcugagacagaaggauugcuugagccugggagguggagauugcagugaacugagaucacacuacugcacuccagccugaguaauacagugagacugucucaaaaaaaaaaaaaaaaaugugauaaaagcauugagccacaguucucuagggagaauccuguugccacacuacucacaagaggaucuuaggguuucuucuccaguuuguauguacuuuguuuauauuuugggggugguuuugaauguuggcuaugcuuucacucauuuccuuuuaagauacaguguugcaugcaaauagggacuaagugcuucuuagaugaaagaauuaagggaucuuuuugaauuaguaguuucauuuacucuagggcauggguccccaauuccugugcuucggaccgguacugguccauggccuguuaggaacugggccacacagcaggaggugagcugcagacaaccauugucgccugaguuccaccuccucucagaucagcugugguguuagauucucauaggagugcaaacccuacugugaacugugcacacgagggaucuagguugcucacuccuuauaaggaucuaaugccugaugauuugagguggaacaguuucaucucaaaaccauaccccacccccaaaccugguccuuggaaaaauugucuuccacaaaacugguccuuggugccaaaaagguuggggacugcugcucuagggaauguaagcugugugagagacaccuguuuuguucauugcuguaucccucaggcuggucucaaacuccugccuucaagcaauucuacuaccuuggccucgcaaagugcugggauuauaggcagccuaagugucuccaauaguaccugguacauaauaggcaugaaauauuuguugauugacacaaacuuuuugaaauaacagggaccuaucacuaucacuaauugcacugcagcauaaccagcucaucccaacuucugccuuuucuguauccacucgcuaaacccuuaacaauucagaaaucauagaaacccaguuuauugccaaugaauguuuuaauuugcaaguuaaauuaaaaauugcccuugcaugaacacuuaccauuugucuuuuuuauugcauaauguacaucuguuguaauuugccaaauaccucacaaaaaggaaaaauuaaagaucacuuguauucucacuacucaaugaaaguguauaguugguauuuagguauauaaguaucuuucagauuuuuaggguuaaagaaaaaacccaaccuaaaauaucuucaaucaggcauuucuuuucugcugaugaaaaucugaaaagauacauugacuaaucauuggaaaucauuaagcagaaccugagauguuuuugaagcagagaaggacauuuaguucaaagauuuauugcauauauaguauguaccagacaacuuguuaagcauuaaagauucaaaaaugaaugaaugaaacauggucucagcuuaacugcauauagucuagugggagagagaaucguaauacauugugguagacuugcacaagcuguuauggugcacuuaguccaggcagcagggugggaagaugcgagaggagagaacaguuuuucauguuuuugugauuuaaauuaaguugcacguugaaauaugaauaggagauucuccaagaccugaaggcauauaagcagaaauggaaauguguaaauggguggcuaagugugguggcucaugccuauaagccagcacuuugggccaaggcgguaagaugguuugaggccaggaguuugagaugagacugggcaacauagggagaccccgucucuacaaaaaauuuuuuaaaaauuagccaggcauaguuuggcaugccuguaguccuaucuucuugggcagcugaugugggaggauaguguaagcccaggaaauucaggcugcagugagcuaugauuguaccauuacacuccagccugggugacagagcaagaccgugucccucugccccccccccccccaaaaaaagaaagaaauguaugaaugaagggcucuuuuuuguugugugcuaugcccuagguuccuauuguuuauugccagauuggcauuuuaucuuuuguuguuuuaaaauucucccagacccccucccucacaguagagaauuguguccuuuauaagguacuucaaauacugguuaaacaaaaaguauuaacauuuauagggagagaguucauauuguauuauuuuacaaacagaagcacccauaagucuagauaaaggagcauuuggaauuuaggcaccuccuuuauccaguaucuccugugcugaaccuguuacugguuuuuuuuuuuuuuuuuuaaguucaaaguaugauauuaccauacagaguaguaccauucucaucuagucuaaaaguuaaaaggcugggcacaguggcucacaccuguaaucccggugcuuugggaggccaggguaggaggaucacuugaacccaggaguucaagaccggccugggcaacauaagugagacccugucucuauaaaaaaaaaauuggcugggcaugguggugcacaccuguagucccagcuacuugggaggcugaggugggaggauugcuugggcccagcauuuuggggcugcggugaguuaugcuugugccagugcacuucagccuggacagggcaagaucuugucucaaaacaacuuuuuuuuauuuuuuuguauuuacuuuuuuuuuuuuuuuuuuuugagauggagucuugcucugucgcccaggcuggagugcaguggcgcgaucucggcucacugcaaccuccaccucccggguucaugccauucuccugccucagccucucgaguagcugggacuauaggugcccgcaaccacgcccagcuaauuuuguguauuuuuaguagagacggaguuucaccguguuagccaggagugcccggcuguauuuacuuuuuuaaaauuuguuuugaggcagaaucucacucugucauccaggcuggaguacggugguguaaucuuggcucacugcagccucugucuccugggcucaagugaucuucccaccucagccuccugaguagcugggacuacagcugagugcuacugugcccagcuuagcucaguuuuuguaaagaugaggucucacuauauugcccaggcuggucucaaacuccugggcucaagggauccucccgccuuggccucucagagcgcuaggauuacaggugugagccacugcauccagccaaaauaauuuuuuuguaauuaaaaagaaaaaguuaagagccagaauagucauaacccuacccaaguuuugucuuaccaaaggagaauagcuauuugaaaauuuacauagcacuucagcuuuuucacauccugauuguaguauagguuucccuccaugcagaaguggaaucauuaacaaccaugauuuaugagugucccuguguauuuaaaggauuaacacuaaucaggccugugucagaauuauaaauugagaggauauggaaaaaacuuaacaucugaugauaaaggggucauuuaacaauucuagauuccugucuuccauaggaagcuacagaugaauuggaugccuugcuugcaucucuaacugagaaucuaauugaucacacaguugcaccucagguaaauaugcuuuaaaauaguaugauggaaagaaauuucuguuuugaaaaauguuccugcuagauuccaguuuuuuccuuuuuaauaauucaguuaaacuuuucauuugauaagaguuuauguuuuaauaaccacuuagcauugccucucuguccuaaaauuuuaccacuuugaauuuguguaucacugucuacaaaucacaugucucuauaagccuuuuauaauucaacaucauauuaaaugagagaaaacauggggauaaagcaguuucuugagacaauaaggauauauuuaauuuuuuaaaaaguuuuauagaaagaugagagcguaagaauggcauugaacauaucaaucauuauuacagucuggaagauacuguauuaaguauaguugucccucaguaucugugggggauugguuccaggacuccccuuggauaccaaaauccaugcaugcuuaaaucucauauaaaaugguguaguguuugcauauaaccuacacauauccucuaguauauuuuaaauaaucuagcuuaccucuaauaucuaaugcaguguaaaugcugguaaacaguuguuauauuguauuguuuaggaaauaaugacaagaauaaaagccugcacauguucaguacagacacaaccauccuuuuuuucccuccaaauauuuucgauuuacaguuguugaauccacagaugcacaacucauggauauggagggccaacugaaacaguuccuucccuccagggaugagagagauagaaaugacuaacuuugcuggacacgguggcucacgccuguaaucccagcacuuugggaggccgaggugggcagaucacuugaggucaggaguucaagaccagccuggccaacauggugaaacccugucucuacugaaaauacaaaaauuagccgggggugguggugcacaccuguagcgccagcuacucgggaggcugaggcaagacaauugcuggaaccugggagauggagcgugcagugagccgagauagcaccauugcacuccagucugggcgacacagugagacuccgucucaaaaaaaaaaaaaaaaaaaaaaaaaaacagaaaugacuaacuuuguaccuuaugagugauaugacgagaauugcuguaggggcuagaugccauccugaaggcuuggaaauacacaugauacugaauguuugcauagaucauuaauucucaaauuuuuguguauaucagaaucccuuggaggggacguuaacacacaagauugcugggccccaccuccaaguuucuaauuuugguauaucuuggguggggucugaaaaguuguguuucuaacauguucccagguggugcagauguggucugggaaccacccguugggaaugaccagcuuagauuaauaaacaaagacuuuaccaaggauaagaauuaacugcaaguguggaaaagucugucaaacuauuuuuuguuuacuauuauuuaugauauuuuuucucucuuauuuccugcuguuaacaugcaucuaaaaaguauugguaggaaagucagauuuuguggguuuuuuuuuuuugagauggagucuugcuuuuuugccaggaguagcgugaucucagcucacugcaaccuccgccuccaagcgauucuccugccuuggccucccgaguagcugggaguacaggcgcaugccaccaugcccagcuaauuuuuguauuuuuaguagaggcaggguuucaccauguuggccaggauggucuugaucucuugaccucaugaucugcccaccucgcccucucaaaaugcugggguuacaggcgugcgccacugcgcccagccuguguuuuuauucuuuuggugguuaucuaauuuacuaauaccuggacuuacauuaguuuuuucuuaugaguauguaaggccaccaaugcaaggacuagucuaaauuacuaguaaaauggguggguuuccuuaguuuauaauucuacacauagaugaccuauaauagaaaguuaaacauauaaaaauaauguaucaaaggcccugugaaccaggagcaauauggguguuuuuauugcgcuuucuucaugcauacaugauaauuagagaaugaucuguaucuaaacagauuauuuuucuguguacuuucuuguugcucuuuauuuggauuagucacaauccauuguucaggcugcuaccaagaaggcuaucauuauuuguaauuaauuaacugaaauuucagaaaauaaaauguuaaacugaauacugggugugagguaggggcaguccuauuaagugaacugaaaguaguaauagauucuugaaugguaaauuuuuagauaagagauucucaaaauuaugacacuuucuuaaguggugagggauagcaucuguguuguauaacagaaaagggucuuggauuuagaaguccaugucagcucaaggaacaccauuaagaauuaagaauugcccuccuagaauggauuucauaauagauguaaguaaguauuauaaguaugaaaauaagucagucuuuccaaaaaguaaauacauacauauaaaauuauuucaggugucuuccacauccaugaucacaccccgguggauuguuccgguaaguucauguuauuugugauuuuucuucuggcuacccuuucaggguaaggccuaaaggauuacuagguucuuuguuuuuccuuaaaaacaugaggguuguuaucaaagccuuguuaacugaacuuaacuuaauggcuucaagcuaguggcuuacccuuucugguuguaaauguuugucaggaugcuggcagaaacaaaaguaaaagucucagaugaagaauaguuaagaaaaacaaaacaaacagucauaauuaucaaaaccaucuucguuaaucucauagucauuagugaagcuugauuuggagcugaagugcugaccaggcagguauuguuacccuguauuuaguuguguguguaucucccacagcagaguggugccaugucuaauggacuugcgggaugugaaaugcuuuugacagggaaggagggacaugguaauaaagauggaaucucacugaucucucccccagcgccauucuugguagaugcugugaccaggugagaaaauuauuucucauuugcaguucuuaggcaucuguuaggaagaaaaaaauaauaaaacuuauuaucucuaaagcagcaaugucaauucuucccuaacugaacuauauugaaauggggcaaaucuuuuuucuguuuguuauuuaguguaguggcuuuuucuugucaguagcaauuuucuacaaaacuguauuagcguuucuuuaucaagucuuugcuaaagauguuaacaggcuuaucuuuguaauaguuguuuuaaagucaauuuguauuguuucccuuuacgcuuuacuauuuauuaugauuaugccuacuguaauagugaugaaugauggugcccgucaacacaggugaagaggugcaguauaaguggguaaguuaggauacuccuagggugagagcccugagaugccuuuaccaauacauguugugagcucauuucaaggcguugcuugcuacagacagaaacuagacucaaaaacuagagcuuuuuguucagcaucugguucuucaacuuuugauuugcuagaaccauaacugcaccuguuuuacaaaagauuuagaauugccuucacuccuaccucagaccuuuuuucugaauauaucccacauuucacauauccuccuugaaaaugugggucgguugaaauacaugcuuuccuaauuagagaaagguaggaugaauuauuagagaucauuaacuugaaagaaauucaguuuaauuucaaaauugucuccacaguguucaaaguagcauauuacucagcaaacaaacacuuauugaaugucugugauguaccaggcauugacugauaucugacacuaaagauaacagugaacaagacagaugagagaccuacauuugggaagcuuacaucuaguaaaagagugcuuuauacaaauguaauggauuauuuuucuaagcauuuguaugccuaauaaugaucacuguaaaaauagagcugcacacagagaacccgacgguaaugcuuuguaauugaauuuacacaauaaaaugugagcucuuaaggacuuucacauuaaaaauuacagaugaaagcagagcuuaucucuuucuuccuagaacucauggaaaggaguaauaaagggcuuaaagacauaaaaauuacaaauaaaccaauggaacagaauagagucuggaaacaaacucauauguaauacaguuuucugguuuaugaaaaaaaugaugaugcaaugcuguaaggaaagaauggucuuucuuuuaguaaaucagcuggacagauuaguugucccuguggggaaaaaauaauaaucuugacccaacuccauaccauucacaaaaauccauucuggauggauugcagaucuaaauaugaaacaucagauaauaaacuuauagaagaaaacaugagugaacuuacuugugaccuuagaauagacaaagaucuuuuaaacagcucacaaggagcuuuagucuuacaggaaaaaaaucacuuggauuauaucaagaaauuuuguucaucaaaaaauguaauuucaagauauuauggaaggggaagccacagaauaggagaaaacauuuguucuccaucccuccuucugucucucucucccucucucacccccuucccuucuccuuccuccgcaaccucagucuuaacuuuguauggcaaaggacccacucauaucuagaauuuauaaagaguuccuccaaauaaguaagcuaaagaugauagcauaauagaaaaaugggcaaaaagcuugaauaggcaguucacaaaccaauauccaaauggccaguaagcauucuagacagugugcaacuugauuaguccguggggaauguaaauucaaacuaccaugucacagugcuacauuaucaccagaauggcuaaaaugaaagacacauaguaccaaguuuuggugaagauauggggcaacugaaacucuguaaauuggaguaaccacauuggaaauagguuuggcaacaucuacuaaagcugaacauauucagugauucuauuuuuauauaaauacccaauggaacugugaauauauguccaucaaaagacauguacaagaauuuuuauagcaccuauauucauaauaguccaaacugaaaaccuuccaacugcacauuagcaguugacuagauaaauauuagaaaagagcagugaaaauuaauaacuacaacuaaaauguagcaguauagaugaaucacauaaacauaauuguauuaauugucuacuucugugcaacaacuuaccacaaaacuuagcagcuucaaacaauacacacuuauaaucucauuuucuguggcucaggaaucuggauguagcugagcuggguucucugcuucagggucucucacaggcuacagucaaauauuggcaaaggccagguuuucaucugaaggcucaauggaaggagaggcaccagccagagcucuuggcaggauucaggaucugaagaccuguuagacuaaggaacucaguuccuagcuggugauugccaagaagcugcccucaguccuuaccaugugggccucuccaaaguaguuccuuacuuuauucuagcaugcaaacugagaaagcaguagagucugcuagcaagacagaagucacaaucuuguauagucuaaucacagaaauaacauccuuuuaccuuugcuauauucuguuguugguuaaaguaagucacaaguccuuuccacacccaagggcuagagauuacauaggagugugaacagcuggagauggagaucuuugggguucaucuuggaguuucuccacuguaauaaggauaaacaaaaucaaguucaaacaggagcacaacucuauaaugguuacccuugaugugcuagugaauagaagagagcccaaaagcagcuuugggagugcuaguaguguuccguuucauauucuacaugcugauuacagagguguauucaauuugcaaaaaguuguucaagcuguaaacucaugccuuaugugcuuuaauauauagauguuauaguaauuuuuaaaaaugaugacugggucccacccaucuccacagauuuagauuuacuuugcagcguucucugugugauacuguguuucaaaggcaucaaaucaugaggacaaagaacaggaaaggagacaucagcaauuaagagaccucaacaaguuuugggaagcagcuaaaugauaagugguaaccaguuuagcagaguggaguaaacuaaaaucuaagccugaauaggggagggaguagaaacaaaauaaaaagcaagccaguucacacugcagaacccugaaaaggcaacgaaauuguagguaccagauacuugugaagaugggguacaaaguggagcugagaauauggggauugguugaaaguauuuaugcccauuucacucaucugccaucccacuacccuugcccauuuuagcauaauucugaaguuuucccucgggaggagccaggccagagaggcucuggaucuuggaauuuccauuuggaguaaggcucuagacugaacacgggaagacuaacucaaaguccacacacugaagggugaaauuuccaacguuccuucuuuucucaguuuccugaaugcuguuagcuaaguauaaaugucugaguugaaaaagaggcuuauucucuggagaagccaaccaaccaaagagaaaaaggccugcacauacauuuuuggauccucugaugaaauugccaggaaucugccaaauaaucaccagggagcccauucguugaugaguuuugcccauauauacacaggucccagacacauuccagagcuuuucuuugaaauacaaagagagcuaacgauugucagauaugugaggaaagaccagaacagguaaacugaaaaacaaggaaauaaaggcaaugugaauuuugacaaauagaaguaggaaaaaaaggcaauguaaauaacaaaagaaaaggucacaaaaucauaguaucugaauuuagagcgaagauacuguauccaugcaacaauaacaggaaacuuaaaaaaaaaaaaaggaaaacaagcauuuuuagaaauuauuaacuauauuaaaaaugaaauccaaagaguguguaaaagauaaaauugagacaaucucccaaaauguguagaauagaaagaugaaaacugggagagaaaagaaaauuggaggauuggccuaggacguccuauauaugaaucauaggagaucuagaaagauuacagucaauggaaggaggaaauugucaaagaaaggaaucaagcguucucagaacagaggacuugaguuucuagauuaaagaggucuguugaguacccagcacagagaaugaaaauagacuacaccaaggagcaucaugaaucuuuaggaggucaaaguuaagagaggauguaagucuccagcaaaggggaaaaacggaguacguacaaaggauugguaaucagaauggcagcagacuuuacugacagcuggagauauuggagcagugugcuuucugaauucuggagggcaauuucucacccagaguuuucccaaacuaucagugaauucccaaacuaucagugaagugugagauuagaauacauuuuuagacauacaguuucccuaaaauauauacuuuccauguagccuuccucaggaagcuacuggaagauguguuccaucuaaaguggaagauauguuccucuuuuuuauccaaaaaagaagucaugggacccaggaggcaguagagaggugcagggauuuacccagagaaaggugaagggagguuccaagaugguagcugcccagugggucuagaaaggauccuguccagauucaaaaaggaggauauagaguugcagaaaggauuuugccaagaaaaacacaaacaggcuccccacccuccaguuuuuaaaaaauuauauuacaugucugaauguacugagaagagauccaugguuuaccugagagguuagggauagaugagagauuuguauagaaaacugagaaguacucgggaggcugaggcaaggagaucgcuuaagaccgggaguucaagaccagcuugggcaacauacugagacuucguuucuaaaaaacaacaacaacaaacccacuaagccaucacgacaacaaaaaaaugaggcaguuauucaguccagggaaaauaaaaguuacauaaaacaugaaauauacugauaguugugaaaauauuuacauaauuacaacaaacacugaauuuuaacaucaucaaaauuggucauauagcugugcugaaaagauaagaaggcaggauuguggggcuggggagaggguggaagaaagguaagccuucacaguccauaggaggaagucauuguauaaacaccucacccagaacagucagaacuuuggggggucgugaggcagaaucucuggagacagguuuguuuaaacauuggcugcugggcuccacccucauagucugauucgguauaucugggguggggucuaagaauuugcauuucucccaaauucuagagaccccacuuugagaaccagggacacagaaaagugaaggaaaauaccaggaaaagaaucaguugaaaguguuugucccucaaaguaggaauagagagugguacaggugacucuguuucauuuauaaaucuuguuaccacuuucaacauuuuaaguuauguccuuuguauuauguacuuugauaucguuuuacaucuuuaaacuuuuuuuagagacagugucucucuccauuaccugggcuggagugcagugucaugaucauagcugacugcaaccuccaauuccugggcuaaaacaacccuccugccucagcuuccugaguagcugggcuacaggcauauaccacccucaccuggcuauuuuuguuguuguuguuguaaauacgucaucucacuuuguugcccagacuggucccgaacuccuggucucaguggauucucccaccucacuaagugcugggauugcaggcgugcgccaccuuacccagcguguuuucaguuuucaugaaaccaaaucagaugucguuacuuccuugcaucuaaacucacgcaguucacugacagcagaaauucacgagcccucaugcagagcccaugagggcuucuuuuucacacggcucuaacaaaauagauuaacugguaggaacacagacacggccauguaggaauauguaaagaaacacagggcugggugcagaggcucaugccuguaaucgcagcacuuugggaggcugaggagggcagauggcuugagcccagaaguuugagaccagccugggcaacauagugaaaccccaucucuacagaaaaauacaaaaauuagccaggcauguuggcacaggccuauagucccagcuacuucuacuuuugggaggcugagguggaaggaucauuugagccugggauguugaagcugcauugagccaugauuaugccacugcacuccagccugggcgacagagcaagaccccgucucacagaaaaaaaaaaaggagcagcagcagcagagaacagccugaguguguugcccuugagcucagcacagcacuguucuugauacucauacuaacccugacucauuaagaaaugguuaaguguguguuuaacauauuugcuaagaaggggaaauugugcugucuuuauauuuuauuucaaaaugaaauaagcaguguuuauccagaaauuucccuucuauggaauaucucauugccagguuagguguuacuacauauugacuuaggucuguaaucugcuguacccucaaaaugcucuguguggcacuaauggagacaugaauguccuccuccaaaccccagggguucccugaguaacccauucucucuuccuuucagcucuggucccauuuuggcagaagaagcuguccugaagcagaaguguuuacugaccacugagcucugagggccuguagcuggaauacgcaucucuccagcauuccguccugggauccguuucagcuagaauauguuggauucaggagcuuguccauuauuuguagguaaaaaaagcugcacguagauuugacuucaacuccguaaaaaagacagcuguauuuuccguccaacuggaauuguugaaucacacugcauagcugcccaaaagagaguguuuggucuugaacuuucuauacuuuuauaaauguuacaaauucccgaaagaagggaauuucuuuuucugggguuuccuucaaacucuuggcuccaccuagcgguucuauuuguucauaacaacuucauaacaagccugccucugguagucaacagccuuuugaaagcuauuuccaucuaguaucagggugagagcauccuugaucuggcugccuguuagagaaauugcacuuuuccugacuuaccuagaaaucaagaauuuaggaaauuaauguggacacuauaaaggcagacuuagggccaacuuuuuuuuuuuuuuacaauuauuacaacacuaaagagaaguuuagaauauagagaguuuuuaaaugucucccauucuuuugauuucuuacuguacuggcuaucuuaauauuucaaguuuacaucaagauaaacccugagaagaacuacggagaaaucaaauaaaauccugucauauuuuuuucacccugccuuuccacaggaagcacucacaggcaccacacacguaucauguaacuuaucagugggguggguuacuguugaagagacccuggggcauuuaccucaggcaucugcacuccuccgagcccgguggagaaugcaggcugcuguagucucagguaaugaaggcacagcacagcaguacuccacauuguuuccuauuuggacauagacuucauuuccuuucaguauaagcugaauaaauuuagagcuuucaaacuggaaaaaaaaaugaaacaaaacaaauacaccaagaccaaaauaggcaauaggaacaggggugaagggauguuguuucuuaaauaccuaccauguaugaagcuauacacagcauauaccgaaagaaccugcauugcacuaggaauucuguguuaguuuaaaagagaucucuaaaacuuccccaucccuuugggccuguacaaagaaauucuggauguuaaaauaauauauacucaucacagaaaaauaaaguauagcaauguccaucuguaauucuaauacccagaaauaacgcuauuuagcuuuauaauuuucgaaugaacaagguaaaccucgguugccauggggaagaaggaugauguggaaaccauauugguaaaguuguuaaucccucguuauggagaacugaucuuaagcuauaccuccuggaauuugcuuucuaguuuucuguccugcaauauguauauaauuaagcacuaauuuguacugcuuagcauaaaagaacauccagucuuagauccuuaaaacuucauggauuggacuuuccugggcuccuuauaacauaaucguguguccaggcaaacgcacacuagugucugacuggaaagcucaggaauuuuaaucuugcacuguuucccagggagcuguagugauuggaacccacguuugcacaaaacauuuuugcagaaggaaagucaacacuucuugcuggcugccuccccuuagccauuaugcuaaaaacagcuucugaguuucacugguggggcucuugccaguucuuaauuauaggacauauuuucucaaagcugaaggugacaccuagaaccaggggcuugacccaggacaugauggaaugagcaucaaauuuucagugucuuggcaaccguagauguccuacaggguuaccguugugcugcucaccacagagcagcugaggcauuaugccuuggaagaccuaaaucucccauccaguucaggaggugacaacauccuuauuuuaaacuuccuaaaauuaggaauuagguaguuggacauagucugugaccuuuaugucguuggauaccuguauucuugacaguuagaauauugguagggacuuuguuaaaauucacuugaauuucaagcucagaggaaacuuugucucaugcccugacaugaaguggcaaacacggaaguucauacuugaaugcugaauuggccccgacagauuaaaugcguguuggggauugguuuccugucauagcugcugcugcugccaugcgcagagcugcuguaacagcucuuccuguucugcuccccugagaacagugugguggggagaggcagggcugagguggucuacgaauguggcagguagggaaggggagaugucugucucuugagaagagagaggcaugugugccggcauccuugauggguucaaagagaaagguuggagaugauagugggugagaagcaggcuggugagacugggcugagguuggagaaggggcagccgggggcacugcugaggguuugccgugcacgccucggacggagcacggugggguggcggggagcagauagugcugccucccugcgggcagacaggagaggaaccucaacucaguccauuucauagcccugauaggggaagugggaguugacaggaugguuuaaaauaagacgugaagguuucaguuaccugcucuagacuuugccugagaacuuguaaauuaaucagugagaccuaauuugugacaugucaguagcaucaucuuuugacacacaggaggucauggucauuucauuccuacucuucaggagacacugcugaacagaggaaugauucuguuccuugugugcuuacuuccuuaacauuuauacauuguuuuaagaaaaaacuuuuaaaaauauuucuuauagucuccuaacauuugucucuagccuuugccuuuguacaaucacagauauccuauggagauuuaaggaugaaagcccugaguuguucuuggguucuuggaucuggacuacuuguuaucuuaugcuucucacuucuggcuaaaacuugcaccucuucuucucuuagcuaagccccaaaaugaagauuuccuucagaagucuuguuagcagaauuauuuaucagucacagagagaaaaaucugcuauuuuucuaaguaagagucucgagaagcagaguuuuugucuugucauugagaggagucagcagucuuguucuguaaaggaccagagaugguaaauacugucccacucagcucugcuggcgcaguacagcagcagcagccccagcacagcuguguuccugcggaguccccuuuacaaagccgcugaccccugaugugaaacuuuguagagcagcagaguggcugcgugaaacgggaggcuggcagguccucagauagguucugcaguguuaccugucacuuggaggcagccaacacuucuggacauugcauccuuauucacacauguggcagcugaacgaggugcuguugugggugucucagcucugagggucuuugugagcucccacuguugugggugucucagcucugagggucuuugugagcucccacuguugugggugucucagcucugagggucuuugugaguucccaccaacuuuuaauuauucaugcccuugaccaugugguugcuuggagaccuggggucuucugcagacugaagaagacacauuucuagauuauuuguccuuuuuauccucucaaaaauuuaaacacuguaccucuucaguggucagaagaaaguuggaaacuuuuccuacauauuaggcguuaguaugaggacauuuguuugaauuauagaaauuugcccugagcugaacuggguuguguuaacacauugguagagcuaugauuccuucccaguucuaagagauacgaucuguaagucccuaugucaccacauugcuugagaugaucauucaguuacuugucaggauuucuccucuucagagagauuuuuuuuuauagcacagauuccuuugccccuuuuaucuccuuaucuggauaugauaagugguuaugagggucucacuaacuauuuuguguuuaccuuuuauauguguaaaacuuugcaguagcauuuaaaguguaauuuauuuuucuaucaagugcacuauucauuuaguguguuccaguuuuauaugacuuguauuagaaacacugcacugaguuguuuguacacugaaaugagaacucuagauguaacucuauucaaauaaaccuucgugagacauucaug

SEQ ID NO: 191140 - RNA, 217831 nt, Homo sapiens
ccugcgugucccucugcgcuccgacuggugcgacuucucccugcgcuagcgaggcaggguuuuggccucgccucucgcgagaucgccuccuguugcugccgccgccgcuccuggccacugacuggcggcgccugcgcagccgccauguucgguugcuaugcugcggccuaggagagggggugugcuugagggaggaggaagagauagaggaggaggagggggaggaagaggagguggagaaggaggggggugacugagcuccucuugcacucucacacacaaacgcugcccaggauuacccgccagcucacgccgcgcagugcgcuuuuccgcuccucgcgccccaccaccaacauuguucucucaggacuccugggucccaggggccggaauugggccugagcgggagaggaaagagacuuggcuuuggccgcggggucggaggauuggggccaggcccccucccccacgcacuuuuggggguguggauuaucucaucccugcagggagguaggagaggucgccggcugcccgccucccugccaccuccccagcggcgccggcccgcggcugcccagcagcaugagguggugcuggcggcuccgggucguggcgcgaccgcugcggcggcggcugcucggggggcgcugagguagccccccggagcggcacggaggacgcgcuucuccucugcgcgccggggccucgaggcuuuuuuucuccagccgagaggacgcggcugugauauacgaagguaagagguucuccgguccccgccggccucucggcccugcacguugaacgggaggcucuuaccugcauguguggcuccugggaggugagccagguggggcaagccggagguacgaggaugauuugaaaggaaggaaaaaaggacaaaaacaaacaaacaaacaaacaaaaaaacgcuuucuuuccuuucuuccugggaccucugcuuuugcggggguuauaguuggaaucucuguuaugggucagcgaagggccaagggauggaauaggugcggagauggaauguucccaguaccuaaacucuagguaaagcuuuggaaucuugaguuuuccauugcugguagaauuccuuuuuuuuuuuuuuuuuuuuuuggcucauaugagcgcuucuugcacgcugcaugagccaacuauuccuaccauugaaguuuuaagccuguuaugauucuaccaguauauaccuguauuugggaaucuguaguugagccaaaaaaaaaaaaaaaaaaaaaguugagauguggguaaacagugaugcauuucgcaggguuuccauaaaauggaacagcuuacaguugcacaggugauguguggauguuucugcaaaacuuaggguggaagauuuuaugucugggcuugcaucauguagugacaucaguauguacaaggacgauuuguaggauuuuucaaaacgccuguucuaggauaacuuguuaugcaucugcaauaugccagcugcuuuucgaauaagagguuucaguaauacuaaguuucuguguccagaucuugggcccaguugaaacaguacagcugauuggucacauuuaaaacauauuuauggagaaagauaaaaggccaauguguccgacuugcaaaagacaauuagaguagaaagaagacuggaacaguaaaagccagggcauuuuuaaaucuugguuuucugaacuuuaacgugccagaggaaaaaaauuuuuuuucaauuuuaagggggaaggagauggccuuaaaauaaaggauuguucagagccuaaacugugcuuaauggaauagagcuagguauaucaucuaaaucuugaauuugacuaauauaaauucagcuuucuuuuaaagaaaaaacucguaagcagaaguuuguguauucuacagaaccucuucacuagcucguaagugugaucauuuuguggacaucacuguuuuuuuguuagaauaaauuuaugcuccaauuaccacaaaagcaauuuuuaugucucuucgcauuuuuuaugguacacauaucuuuguuacauuuugcauugaaacacgcacggucccauaguaucauaaucuucagugauuuauaagagaaacagucuauuuuguacaugggaauguuugucauguugccagucuguuuuaaaaauuuggcaagagguuuuuaaaauccaaggaggcaccacuauuuuguaguuuuuaaaaauauuaauugaguagguccauguuuauuaaguuagaaaaucacgaguuccucaaaaguaguaauagacgaggaugugauuuuucuuacugcccauuuucuaacaucuuagcuucagagcuguagguauugaauugagucaaacuuguguuuuuuucuuauguucuaauuaaauaucuuuuaaaaugucccuaguaacauuguuacuuuaaauuuauaacacccaauuucuaauuuaggcuaggcauaaaaccagcauugauugaacguacuugcuaaaaauacuuucugggucggauguacuuagaaugcagccucaggaaauuucauuugaacuauucugugaccaguguacacuucauuauuguugaaggacuuuuaaaaaaaguauagaucucucauacucgauuuaaucaguuugagcauagaugccuaacuuuaaaaaaaaaguauaauaaagugggauaguaauacaauuuacgugagaugguaauaaaaacuuuucagcuuuuuuuuuuaacuuguaugacuucguuagguuguuauuaaacugugauuuguauuuuuaaaauaguuuugucuguuaaacauaauugagguguacaguacaguauccauuguuaucuguuuaguauuuauuuaugacuuacaaacucuaaaagcgggaucagugaucaugguuuuuaguaaguugucuuuaaggagcaaaguaagagacuagcagaaaauugcaaggagguuuguuauugagaguacuucugccccccgcuugagaguuaauauggccacuuuuaaacaagaaaaguuuuccagaaacguggaaaucuuguuugguguauguuuaggggcaaauguuuuaaaguuuugccuaaauucuuaguuagaaugcaaaauugaucaacucccuaggaaugguuauuguggcuaaauaugaauuguugcuccuauguaaaauuuaguuauugguagaaguuuacuaacugaguugaauuuuguuguuuuccuggguuauugcauguuaugaaguuuuuuauguacuauaauccagauuuguuaaauuugccaguuuacuagaauaagcugugaagccuugaaguuuggcuuagcauucugaaaauccuuuuuauuguuugccaggaaagcacuguaggaaggagguguuaucucuucauuuaauauuuaaugaguaguauagaugaugagauaggauauaauguagaaauaccguagaaucuucuuuauugauaugaaaguaccauugucuaggaacagcauaauuucuuaucuuuugcaugaauggggaaaaagaggaggggaaauuuauuagacucuuucauuucauuagagauaucuucccucacauucauucuucauuucauuauucuuaaguagaaacuuuggaagagagaugcaaguauuugaauuaauuaguaagaacaaaaugaaaauuacaucguauagacuaucaugaggaaaauaucaauuuggguugguuauuguguuuguauuuuuuaacaaggagguuauauagaguaguagaaagaaaaaaggacccagaggggaagaguguuaauauuuauugucuguuaagugucagauccuguauaaggggcuuuucauguugucccacucaccaaguaugcuuuaugagguagguauuauuaauccccuguccucucccugccaaauagaagcuaagggaaaugaaauaacuugucuaggcucauacuucuaguaaguggaauucucuaaaacuuauucuuuagaucgguucuguccaauuaaacuuucugcaaugauggaaauauucuuuuuuccuucaacuuuauugaaguauaauugacaaauaucauagaaauauuuuuugcacuguuaguuaugguagccauuaaucauguguggcuauggagcacuuaaaaugugacgagugugucugagaaacucaauuuaaaauuguauuuaauuuaaaucaauuuaaauuuauagccagauguggcuaguagcuauaguauuggagagcauagcuuuaggucugacugcuuagaaaaucugaguuguaguauuuaaucuuccacugguuuaugcauggcauugggcaaguuguuuaguucugggcuucagucuaaucuggugugaaaaugaaggggucgccacuaagagauuaucuccaagguuccuucuugccugaaguucugugacuguuauuaaaacauacaguagcauucaauauucacaagcauuaugucugaaaggauccccuccccaauaugcucacccauuaccuaaagauuucuguuuagucaguuucucuuuuugagaagcguauguauaaagcacacauaaaggauaguggauuauuccccaccuccccaacuguucggcaaaaacauuguguaacucaaggcaguacuuuaugauggaacaaaguuugaaucuuuaaaggccauauuuuaacaugccaccuucccguuuaaaaauauauaggaguuccccggugcuuaucaaauuaaucccaaauuuaccugcuugaccuugaagacuuucuaccaacuucaucucauuaaccuuguuucucauucgugcuuaaaaagaaaauagucuuguuuuuuccuuuguccucguuuccauaauuuaaacaucucugucuccaauucaugugccuccucuuuaaaccuuuuucaaaauucaccuguuucuggaagaaugcugcuuaauccacucacaaggaucaguuaaugaauccugguaauaaguacccuaagguuaauauaugcuuguuuagauauaguuuaauaucuucuuaagcuuuuuuuuuuucuuaaguuuuuauguuaccuacucuguuuccuuaauuuucuuagguuaaaaaaauuaaaauaggaauagcgucuuuuguauugucuuaugaauuuaguucauuuuucaacaaugcuacuuuuaaaaguugcuaauuuuuaaaaaggauaaauacuguaacaacguuuacccuugaucaccaccauaauagcuauuuuuuguuucuuuccagguaauuguucauauuuaaaaaauaaaguugugugguagagagaauuuugagaggaauauaaugggaacauuguaugguggaggcugugcaauguaggggaaagaucacagacuuuggagucaaaucugguguggaaucuagcgucaaaaaccucgggcaaacugucugauuucugagucaggagucaaaucugguguggaaucuagcgucaaaagccuugggcaaagugucucauuucugagucagguggucuugaauuguggggauuaagauacuauauguaaggcaucuagcgcugugcuuuaaauacaagagaugaucagucagugauaguugguauuauuuuuucauuuuucuauucccaucuucaugaauauuauuuauuuauuuuagcuacccaaagccaccaaggucaaugaauauaauuuaagugauuaguuaaacauucaggugauauaccauaacugauuuagacauuuacauuuuguuaagcgguuuuuuguuuauuuccucaguuuaaaacccuaggacugggauaauggucaagugucaugaauauuucugugccagaucucucucuuacagaaguaccuacagugguuguucuuguuuugggaagaaaaaaaugcuaauuuuauaauuguauuucauuguuuuaauuaauguaauuugaaaauuuauuuggugaugauguaaugaacauuccuuuauauguuaagcaaacauuugaaaugcccauuguagugggagcagugguauaaagguaaauaagacaugauucuuguccuugagcucaaauucuagggugguaacacaugucaacaaacaauuaacaauucauagugacaguguaauaagaucuggggaaaagaaguggcauuugaauauggucuuggaggaucauuuggaauugaucuggguagagagaacagcauauagaaaaagucaaaguaugaaagaaugugugguguguuuggagaaauguaaguugucuuguuggauaugucugucucugucugggugggugugguugucuguuccugugugugaaucugugugugugugugugugugcgcgcgcgcaugugcguugauugcagugggaaaugaagucuugugaggguccuuguguuugggcaaugagugggaucauuuuaagaccuuuaaaauagagcuucccaacuggugugccaugaaugguuuaccaguguuucggagagcaagauacccuuguuuaaugggaccugggcauaucagaucccccuccccacccugccccaggaugguuucuuuuggcuuugaauagcauuuguggcuuaucccaacgugcuaagaaauuauuauuuucuuuguugccaaguugggaaaaggauugggaaaaccacuguuuuagagacuguaaguauuagaaaguuuaugguuccuacucacccuuggcauccacuauggaaucagaaauaaauaucaaauccuaaaguaagcuuaagguaaacuuaagaauucuuaagucaccuuccucuuucucucucuuuuucccucccuuuacccgcugccucccccauuucacugguguaugcgcaugugcgcgcgugugugugugugugugugugugugugugugugucugugugugugugugugugugugugugaaauaucucuuuggugcccuugcguuacuggugcccuaaacaugcauuuagucugccucuugggaaaucagcauuaacauucaggaacaauuuagagguauuuaaauaagggaugauaagauuagaugcagguuuugaaagguaacuccugacuucuagauaaugaugcaaaguuacaaggauaaugcaaggaugagguuagaaauggagcagagagaccagaugcuguugcagugguccaggggagggaugauaggaaccagaaauagggcaauauagauaugagauuagaacugaaaacugaguaguuucacuagaccugagaguccauuuggacauggggggaaagaguugaagaugaugcuaggauuucuucuuuggcagcuucccuucuuuagcaagggaaggccagauuauuuuuauugagcacuuccagugagccagguauuuugcuagacagcgaaguugucacgaguucucauuuaacauuuugaaauaauuucaaaccuaaugagaaaucucaagaaaaguacaacaaagagcuccugaaucgccuuaaacuaauuuuuaacauuguacuagcuauguaccguguguauacacagcucaagaugagccuggaacaccucgugcuuggcucaguaaggccuuuuccagaugccccaaguggucaccuuggaauuguguuuagcccuuucccuuuuucuacuguaucuaauuggauccucaaauuucagugaaacaaccucaucaucucucauuucugguccuacauuuuaauccuuauuucuccauuucaggggaaugcaccauuucuaauuucauuuggcuuuuuuccugaauuauuugagagcaaguugcagacaugaucccuaucacuacuaaauauuuuaguguguauuuagcaaaacaggacaaucuccuacauaaccgccaaaucaggaaaucaacguugauauaacacuaccuucaggucgaaccuagaugccauucaaauuuuuccaacuaucccaguaguaucucucuuuucuuuuugguccagcauccaauucagguucacacauugcauuuaauugucacaucuuuuaguuuccaucaguuuggaaugauuccucaauauuucccuguccuuuaugaccuugacaguuuuaaugagcagaguccuuuuuuucuguuacauguuuuccucaacuuaaguucauccagugguuccucaugugcagaccgagugcauuguuggcaggaaugccauagaaauaaugucgugauauucuuaguacaucacuaagagacgugcuguauaguccugcuacuagcgauguuuaacuuugaacaccuguuaaauucaagucugcuggguuucucuacugugaaguuaucguuuuuuuccuuuuguaauugggaauucuuaugugagaagauaucugggagugugucaauagagcugaaggcuguaaccacgagccuucaggucugaugauugcuaccugaaucagccacaacugugaaaguugucaccuacauuuauuaguucauauucuacugaaagaagauuuucuccuucuucuccauacauuuauuuauucauucauuuauaucaauauauacuccuggauuuguuucuguuuagugguuuauauuaguuacugucauuuuaaaauuucauuuuguuggucaaauugucccaaauuuggccuuuaaguuggcuccucuaucuccuugaccugucccccuccuugguguauuuccuuacuuucuggccuaacaagauguuccagaugaucuuaauacucuccuaucccagcucugaaaucauuuauuuuuccaaggaauccugauuuuauuuuacuuuuuuaaguagagaugcuauuuaggaacugagauccgaguguucaguguguucauuucugcuggcaugucaucacuuuuagggggauagagcuaggaaauacauauauguauacacacaucugaaucuguuucuaugccuauguacagguauuuuauaaguucacacugauacaaccaauuccaaucuaacaucucaggauucgucuagccuuuucccuuucuguauuuguaaaucucuucuccagcagugauaaauugguuccuauuaucuccucaguguauuuacuuauuugcucaauccccuuguaugugccagucuuccgaccccgcauuaguugucuccuuucuccuugcuugccgccucugaggccuguggcaugggguccucagagcuugcugucagguccauguaggaaagagaacuucucauuuaaucuuuuuccccucauuuaaucaggacagaaauuuguuagaaaggugcuauucccaguuuuaaaaggagaacagagcugaaauucaaaaaggucugugucuuuaggcauguuacuguguaaauagcugaguaaauauuuugcauucagauucgucugauacugaagcaucuuuucucuccuguacugcauagccucugaguaucuguggaauccaaaguggcaggauuuaagguuguauagaugguagcugaagcaaugggugggacugucacugcuuaugaaguauauauaaaguuaggaagaggcacacugacagagcuccuaacuaccaucacugaaagauuaagggcucuccgaaaucaagaagccagugaagaagacugaaagaaagguugugagagaggagugugguuguguguuagaugauggugaaguaaggaauuucaugaagcugccauguugcugagagaaaaagagaagaccaagaggcuuugaauuugacuguuggaaaguuauugauaaucucagcuaguugguuuuccaguguguucaggcgagcugccuguaucagaauuauggagauacuaaugaaaaauaugaacuccccaggucucaucucagaccuuauagauucuuaaaagggggaguggggagccaggaagugguagccugggaaaaucugcugaaaugcuaagguucuucugagguguacuaguuugagguuuguugcuuuagcagaagaguuauaguggaagaguguaauaaacuaaauugaggaaaccaaguguacaaugaauauagaugagacagcucuucgagaaguuugccauagagguaaaagaucucaggucauggaagaauaggggacagcaucaagaaaaauaccuuugcguuucaaggguuacauacaccuuaacauuuguugggauuaagagaaggaaacuguaaugguuauuuuaaaguuggguaagcaaaacuaauuagcaacaccuacuaucaaaaaaaugcccugagugaacuuugauauguaucugggauagcugccugcucccauuuuaaaugccaucuuuugguaggucuuuggaguaauccaagggucauuguuuauuuuguuuuuaguuaaauuuguaucuuguguuuuuguuauacaguuguguaaagagcuucucuuugcucauuuuuauacaaacacgaauucuaaguauauucuuguauauagacgagucacuagcaauacaauuaaaaauuacguccaaaauuggaggugacuuuagagggaaauccaauccagggcuaauuuaauguauucuuugagcaccagcuagguacuaggcacugugcuuggcuguggggauacagaauugaauaagacaugcucuuuaucaucaagauuauuguucuuucuucagaggaacuugaaaucuaguguauagcuagaaaugguacagauaagucauagauaacuauguuagucuacaguaaaauaaguacagauaagucaauguuuaauuaauacagcaguguauauuaccauaauucucagacuugucauuuuaaaauuguauuuaaauuguauuuucguauuugaauuggcaauauggcuacaugguucaaguuucaaaauaauauaaaaaggcauauaaugagaagucuugauaccacuccuucucuuuccuguucuguauagguaacuacuuuuauuuuuuguauauucuaugguauuuaugcaaauagaaacacauauaaagauuacuguuuucccccuaccuuuuuuauguagaagguauuuacuauauuaaugcuuuguaccauaauuuuuaaauuuaaaauauaccuuggagaucauuugacuucagcauauaaaaagcugucccuuucuucuucuuuuuaaaaaauauaguaguauguucuauuguauagauauacuauuaagcuaacuaauucuaauuauuuaaacuuuaaguuuuagacccuuuuacuuguguaacccauuuccuuucaccucuuucuguaugaacuagugcucccugaagcauuuuacauuaaugaccugccugacuuuucuguaucuaaagggucuaacuuuuuuuuuuuuuuuuuuugagacggagucucgcucugucgcucaggcuggagugcaguggcgcagucucugcucacugcaaccgcuggcuccuggguucaagcgauucuccugccucagccucccgaguggcugggacuacaggcuuuuaaaaaucuugucagcuucugcuuuuacucaguagaaaucaguuaccauguaacaagucugauuaccuugagacucccaugcugugaggaagcccaaacucucacaggagagaccagaaggccauguggaugaguacuucagugaggacacaugaaagugaugccuucuuggacuuuccaucccagcccagccaucaacugaauguagaugagugaaugaucccaaaugaugccagaugacauccagugcagcagaagagcugccuaaucuagcuuuuacccaauuccuggccagggaauugugagacauauaaauccuuauugucugaaaauaaauaaauaaauaaaaguagguuuauuugagugcagaucuguaucuguucugcucuguccugguuuucuguguuaacaauguccuauuuuuaaauuccuguacuccaaucuuguagcuggagcucucugcuaucuacuguaagcauugccugcugccauguuuccuuacuguguuuuuccgugauugcugggauaccaccugcuuaucugaccucuacaaugcuaaagaccugcuugccuggaucacugcuuauugucugguacuguaagcucuggauacuauuuucuaacugccugucucuauugccucucaucaucauuagcgaguuucccucuucuccccuaauuuucccuaucacagcccuaucagcccuugaguuuuaguuugucaaugugaaacuuggcaaaacuucugaaauuauuugggaugauuuaaaaucuucuugauguuaguuguuauaaguccauuaugccuugucuggacucuuguaguagucuuuuuaagugcaguuugcuauaguuuugcccuuuauaaucuccuuuacacuguagccagagugaucugacauucauaucugaucagaauucuuuuguuaucucuccaucucucuauaaaauaaaaugaaggaguuuuccaaggggauuaaaguuauuugggaaauaucaguuuuuaagauaauauuauuuuuguguguuucuuuuuuagauacuuguucaugaaagcaaaauaucauuacaaaugccaaggacuuccaaauuguuucauuugcauugaaauaagggaaaucuuucuaauuuaucuuacuguuuccagccuagcacaaauugcagucaguuauaguggcuuacuacaagaagcugcuagggaaaauggaaugucuucuuugggaagggaucgugauuugaaaaaguucucuuaggugauucugauacugugacucauuuuguaucuggcuauuuuuauggcuuuugaucuguguuaucauaauuguuuaugaaaagaauuucguaaccaacaguuuguuauaugcaauucugaaauucccacaucccuaaaaagcccaaaaguuuuguuaacuaauuuggcaaccaaacuugacuuauacugaggugagacuacuuagucucauuuauuccacuuacaguguacauucuucagauucucuaaagaaauuuuauuuuauuuuuauuuuuugaggcggacuuuugcucuguugcccaggcuggagugcagugccaugauuuuggcucacugcaaccuuugccuucuggguuccagugauucuccugccucagccuuccaaguagcugggauuacaggcucacgccaccacacccagcuaauuuuuuauauuuuugguagagacgggguuucacuguguuggccaggcuggucuugaacuccugaccucaagugauccaccugccucggccucccaaagagcugggauuacaggcgugagccaccgugccuggcccuuaaagaaauuuuaaauagcaauaugguugaauacagggugcugcccuagaaucaagaauguuacuuaauguaagguaucugugccguaucaccugucugugucccagauacucugaaauucaaaacacuucugaaaguguuuugaagcuagagaucuuagauaugagauuguagaacugaaccaccaacuuccuagcaauggaaagaagugguacuuuguuuucuuuuguauuucuuuuuggugguaauguaguugaacauuuuuucauguuuauuaauuucauuucuuauauucuucaaauuuuuuguucauuuaucugcuagggugaauaguuuuucuuacuaauuuauaauaucguagauacuaauugguuuucuguucauucuaaguuuuuguaucuagcauauugguggaaaaugcuacaaguugaaaacgcacauacagcugauguuugaacaacauggauuugaacuguguggguccacuuauacguggauuuuuuuucaauaaauauaucggaaaaauuuuuggagguuugggacgauuugaaaaaaacacagaugaacuauauagccuaaaaauaucaagacuuuuuuucaauuaagaaaaaaacuggcugggcgcgguggcucaugccuguaaucccagcucuuugggaggucaaggcagguggaucacgaggucaggaguucaagaccagccugaccuacauggugaaacccugcaucuacuaaaaauacaaaaauuugcugggcgugguggcgcacgccuguaauccuaacuacucaggagacugaggcaggagaaucacuugaacccaggaggcagagguugcagugagccgagaucgcaccacugcacuccagccugggugacagagcaagacucugucucaaaaaaaaaaaaaaaaacuaaaaaggaaaaauuagaugucaugaauacauaaaauauauauagauacuagucuacuuuaucauuuacuaccauaaaauauacacaaaucuauuauaaaauguuaaaauuuaacgaaacucacacagaccauacaugguaucauuugcaguugagagaaaugugaaaaaacauaaugaugcaguauuaaaucaacugcacaaaauuaaccaucuuacauaauguauuacuguaauaauguaauaaccaccucuauuucuagugaguucagguguuggaaguauccauuuaaaaugccaugugaugcuaaucaucuccacaugaguaguuugucucuccaguuaauugccugucacaauaaaaagugaucuuuugugguucuugaguauuuuuuagcuauguuucaucauguuuagugcaaaucauaaaccuugaauaacaccauggaacccauaugaaaugcagcuagugaugcuggaagugcucccaaggagagaaaugucacaacauuacaagaaaaaguugaauggcuugauauguaccauagauugaggucugcagcuuugguugcuugccauuucaagagaaaugaauccaggauaaagaccauuuuuuuguuuuguuuuuguuuuguuuuuaaaagaaaucugugaagcuguugcuacagcuacaccagcaggugcaaaaaucuugcacuuuuugugaaauaccuuuuuaucucacauugaaaaugcagcuuuuauauuagugcaggauugcuauuagaaaggcacacguauagacucuaauaugauuugaguaaaagcaaagucauuauaugaugacuuaaagcaaaagaaaggugaaggaucuaaagcuggagaauuuaacccaauccaaggaugguuugauaguuuuagaguuuggcuuaaaaaaugucaggauaacagcagcuucugccaaccaagaggcaacagaugaguuccuaggcacccuuaagaaaaucacugagggccaggcaugguggcuuaugccuauaaucccagcacuuugggaggccgaggcgggcagaucacgaggucgggaguucgagaccagucugaccaacaaggugaaaccccgucuacuaaaaauacaaaaauuaggcaugguggcaugugccuuuaaucccagcuacucaggaggcugaggcaggagucgcaugaaccugggagguggugguugcagugagccaauaucgcgccacugcacuccagccugagcaacacagcgagacugcuaaaaaaaaaauaaaaagaaaaucauugaggagaaaagauaucugccuaacagguuuuuaaugcagaugaaggugcccuauucugaaaaaaaaaaaaaaaaaaaaaaaaaaaaagccacaaaggacauuuauuaguaagagagaagugagcaucaagauuuaagggaggaaaagauaggcuaacuccacuguuuugugcaaaugcaguccgguuuaugaucaggacugcccuuaucuauaaagcugcuaacccccgagccuugaugggauaagguaaauaccagcugccagucuauuggucauauaacaagaaggccuggacaauaacucuuuuucuggauugguuucauuugugcuuugucccugaagucaggaacuaccuugccaguaagggacugccuuuuaaaguucuuuugauguuggacaaugccgcuggccacccggaacccugugaguuuaaccuuauguugaaguggucugcgcgcucuuccaaacacaacauuucuaauucagacuccagauugauuaguccuaaggaccuuuagggcucauuacacaugauacucuauggaaaggauugucagcauuauggaagagaacccugauagaacaucauggaagucuggaggauuacaguauugaagaugccauuguuguuauagaaaaagcugugaaagccaucaggccugaaacuguaaauaccugcuacggaagacuuuguccagauguugugcaugacuucacaggauuuacaacagagucagucagggaacucauaaaagagauuguggauaucuauaucuauaucuauaucuauaucuauaucuauauaucuaucuauauacuuuuuaaagguugaggaugaaggguuucagguauacaucuugaagaaauucaagagcuaauuagacaccacaccagaggaauaaauggaaaauaacuugauggagaugagugcuuccaaaccaguaccagaugauaagcaagaagauguggaagaaacaguaccagaaaauaaauuaacuauagacagucuggcagaaggguuccacuuauucaagacugccuuuaacuucuuuuacaacauggacccuucuaaaauacgggcacugaaacuaaagcaaaugguagaagaacgauugguaccauaauauaaagauuuauuuauuuauuaauuuuuuugagacagagucucaguccguugcccaggcuggagugcaguggugcaaucuuggcucacugcaagcuacgccuccuggguucacgccauucuccugccucagccuccagagcagcugggacuacaggcgccugccaccacgcccggcuaauuuuuuguguuuuuaguagagacggguuucaccaaguuagccaggauggucucaaucuccugaccuugugauccgcccuccucggccucccaaagugcugggauuacaggcguaagccaccgcaccuggcccauaauguaaacauuuuaagugaaaguuuuaaaaagcccaacagaaauuacuauguauuucuguaaaguuacguggagugugccugccucuccugcuuccccuuccacuuccuccaccucuucuaucucugccacccagaaacagcaacaccaaucuuuccucuuccuccuccucagccuacuuaaugugaagacagugaggaugaagaccuuugugaugauccacuugcacuuaaugaauaguaaauauauuuucucuucguuaggauucuuaacauuuucuuuagcuuuaugguaagaauucaguauauauaaugcauguaacauacaaaauauguguuaauugacuuuguuauugguaagauuuccggucaacaguaggcuguuaguagugaaguuuugggaaagucaagaguuacauggagaaauuagacagugcaggggucagugccccuaaacccugcauuguucaaaggucaacuguauuuauaugguaaaggagaugaucuugcucuuuugcucaaaauccuuuaacggcuuccauucuuucuuagaguaaaagcuaaaguuuuuacuguggccaaaaaagcccuacauggucuguggaccuggcugucucucugaccuuaucuuugaccacucuucuuuuucauuuuucucaaggcacacuggccuccuuuuuguuccuggcacuggcagacuuguuccuacuucaggucuucauguuuguucuuccuucugccuugaacacccaccuuucucccaaguguuccaggcagauggaguaugcacauggcucacucuuuuacuuuuuaagucucugcucaaaagcaaauuucucagccauggcuuuccugagcacccuauuuaaaauugcuuuccuacuccuacauggcuguucuccuuugcuuaccaccucacauuauacuauauauauuuuuuucuuuccucauuauaauggaagcuccaugagggcaaggaccuuuaucuuguuuuguuugucgauauauucauguugcuucuuccugucuggcacaaugugagguacuuaauagauauguugaacaugggagggguuagggaaaaguagaggaacauuuaucuaauugccuaacacauggacacuugauucgagccuuuaguuauaaauauucugcuaauucugguguaacuagaguauuuuauauauauuuauuuuagagauagggucuugcucugucuccuuagcuagaaugcaguggcaugcucacagcucacugcggucucaaccuccuagccucaagugauccucccaccucagccucccuaguagcugggaccauagguguguuccaccaugcccagcuaauuuuuuuuuuuccccuaagagaugaggucuuggcauauugcccaggcugaucuuggacuccugggcucaaaggaugcucuggucucagccucucaaagugcugggauuauagaugugagcuacugugaccacuggaaacaguugcuuucugaaggaaguauaaaaacucuauagagaccggcauucuuuuuuuuuuuuccucuaaaaaaaugcacuaaaccucuaacuaauaaaauauuuuuugcuagggaagagaggaacaauaaagcuuuaaauauaauaccacauacacuauaagacugccucuuuuuagacaaaaauaaaaauauucucauugacugguaguacuuaugaaagauuggcuuuauuguuggaaucucauagggaggagaccaaaggacagaaauuuagaaaauggagagggagagagggaaagaacuagcuggcugcuucuaauguuucuaguacuuagguaaugaacuguagauaggagaaagaguaguucuuugacucacuaaauuaauuaauauacgucuguuuuaguaaauaauuucacugaauuauuuaguuuccaucccuaacuagacugagcuucuugagggcagagaucuagaugugugcauauguguaucucuagcaucuagcacugugucuagcaacuaggagcuauucacauacuuacgugaauaaacagguauauugaaggcauagguuuagagaacucuguagggccuuagugggucgggaguguguuucuuucuugcacgcacaguacuuuaaaugcugaaauguauaaauaggauauagugaguuguaaaagauuaaaauaaguuaaauaaaaaaggaaaagccuuagguaaaucaguuugaugcaagaaauggcacaaauuagauuccuguauuuaauauauaguuaauauaaaaucuauuuugacauuguaauucuuuauucuuaucaggucgguaacaauugaguagaggacauacaaaggacauuuugaaaaugcugucuguacaucagugaaucccaguguagguccaguguuacgcauuccuguuucagaugauugauuuugcacaugauuaccaggaauacuuuguugucguauaccauuucuuaaauaagaagcuucuuauuuaaguuguugcauaaugacuucuauauaaauguguuugguauguguaaguacagagagagaaauuuuagagcaaaaccuguugcuacauuugaauuuuuuuuccuucuacaggguaucaguuuuauaguucauaguuuugguagcacuauccuaagggaaucuggcccauucuguugccaaguucaguucacauggcuugagggaaccuucuuuguauacagcguuauaacaauaagcuaaguuaguccauuaucuuauacuaccagcauuugaauuuauaauuacauacaaaacauuguguaauaaacuaaguugguagcaaagcagaugguccaguugggaauauuccauuucaaauaaguguaaagaauugucggcugggcgcgguggcucacgccuguaaucccagcacuuugggagcccgaggcaggcguaucacgagguuaggagauugagacuguccuggcuaacacggugaaaccccaucucuacuaaaaauacaaaaaauuagccgggcauaguugcaggcaccuguagucccagcuacucgggaggcugggguaggagaauggugugaacccgggaggcggagcuugcagugagccgagauugugccacugcacuccagccugggcaacagagcgagacuccgucucaaaaaaaaaaaaaaaaaagaucagcuaucgaggauacuuuuucgguggguaauugauugaugauuuuugauaacugugguuuuauuguguaugcauuuguuaaguauaaaagcagaauuugaaauaauucuuuuauuuuuuguuuuugagacacggucucucuuugucucccaggagaagggcaguggugugaucuuggcuugcugcagccucgauuucccaggcucaagugauccucccaccucagccuucuggguaguugggaccacagucacucaccaccacuccuagcuaauuuuuuguauuuuuuguagagacaggacuucgccauguugccuaggcugguuucaaacuccuggacucaagaacucugcccuccuuggccucuuaaagugcugggauuacaggcaugagccaccacaccuggcugaaauaauuuuuuuuuuaacucuuuccucacaacuuuuuauuuugaauaauaucaugccuauggaaaaguaguaagaaugguauauugaacaucuguauaaucuugcauagauucauuaauugauacuuugcuuucuugcucucucuuuauauguacuuugaaaauuucugaacuauuugaggauugcagauaucaugaucauaacacuuaaccuaaauguuucagcauguaaucaugcaucuuuugguaauaaacacauucuucuauguagcaugaucacacucaggaaauuuagcauugacacaauaauauuaccuaaaacucagucuguauuccagauuucuccaauuguucaagcaagucccuuauacuuucuacccuaaccccccgccaaauccaugauuggaucaagagcuacacauugcaguagguuguuuuaucuuuuuaaaucuacaacgcucccccauccuuuuacaucuacuccucacauuuucgaagaauccaggcaaauuguuuuuuagaauguuccucaauuuggauuugucucauuguuuuaguuuuauuucaucacuagauucaaguuaaacauuuuuggcaagaacacuauauaagguguuauguucucaguauaugacaucagggugucuaugauaccaguuuuggugauguuaaauuugauuauuugguuaaggugggauaugacagauuucuccauuguaaagauaucguuuccccuuuguaauuaauaaguaauuuauggggugauacuuuuggauuauguaucuuguuacccaacaacucucacccagugauuuuagcauuuguuaagucuugccugaaucaguuauaguaacuguaaaauggcauuuuucuauuucuguucuuccuucuauauuuaucauuagauauuauuuuuaaaaaguuauuccucucccucacuuaaaaacauuagcaucacucuggacuuauggauuuuuauucagaguauuauaaucuauuauuuauuuuggaacuuaaguuguuucauauuuccugauaggaguuucuuuaaacugccucucuuuuucuuugacuaguccucaguuagauuuugagggcuuacuuccuuacuuaccaguacaagacauuuagccucaccuuguauuuuccuugccccagcucugaaaucagccuuuuuucuccagaguccuaauuucuuuuagugaggaauaguauauaguagguuaaguauauucaguguuauuggaguauuuugacuucuagguucuaguggauaauuuuuuaaaaaugagauuaaccaaugccucuaauucucauccaguacugcaaccaucucugaugccauaucugaccucuuguguccuguagccagacuccugguucucaacaauauuaauauuuauucauuuguucaauccuauaauagacacaaaauaguuucagaauguugcaucaagaccacugucaacaacaaacuuuauaaaguucggaguuuuuuauauuucuuuugauuuaucuucaguguauucugcugugguuagcaaacuguggccugugggucaaaucugaccaccaccuuuucaguauggccugugaacuaagaaugcuuuuuaaguuuuuaaguucuuuuaaaaaauaaaaaauauuucaugacccaugaaaauuacaugaaauucagacuucaauaucugaauuuagaauacagccauacucauucguuuacauauuguuuauggcugcuuucaugcuacauagguagaauuaaguaguuauaccagagaucuuaauggccuguaaagccugaaauauuuucugccuggcuccuuacugaaaauguuugucaauuuuaauacuauuauauuuaacaauuacuggaaugcuuuuuuuccugcgugauuguguuauauauuauuagauucauuuauuuacucaauuuuagggagaaaggaauuuuuuuuaaauguuggaaauuggcagugaucgaauuuuagaauuagaaggauauuuaguguuccuguagucccacacuguccaguaggauaaccacuagccaaauguagccauuuaaauuaaauauaaaaaauucuuggcugggcgcgguggcucacgccuguaauccuagcacuuugggaggccaaagcgggcagaucacuugaggucaggaguucaaaaccagccuggccaacauggugaaaccccgucucuacuaaaaauacaaaaaaauuagccggguguggagacaggcgccuguaaucccagauacucaggaggcugaggcaggagaauugcuugaaccugggaggcagagguugcaacgagccgaggucaugccacugcacucuagccugggcgacagagcgagacuccgucuaaaaaacgaaaagaaaaaaaaauucuuaaguuauaugagucacauuucaaauguuuagucauccuauguggcaugguuccuauauaggacaguacagauuauagaucacaaaaaguucuaucauuuuacagaugaggaaguugagguucagaaaaaugaagugacugcuccaagguaauagauagacaguaacagauuuagagugaaucaguggcuuacuagauauuacaguuguugugacauuuguaauagaaaagaaagaccccuguguuaggcuaugaaacccccccaccccccuuuuuuuuuuugagacgaccucacucugucauccaggcuggagaucagugguaugaugauggcucacuacagccucaaccccccaggcucaagcuauccucucaccucagccuacugaguagcugagaccacaggcauguaccacuacucccggcuaauuaaaaaaaaaaauguguagagacaggaucucccuauguuccccaggcuggucuucaacuccugggcucaagggauccuccugccuugguauuacaggugugagccaccacgccuggcugaaaucccuuuuuuuuuuuuuacuaaauuccagaugagugcaucauaguaacaucgaaauauuuguauuuugagagcuuaaugauugguugaaaugggugcccuguuuuugcugcuuugcacucauuugcauucauucauuugaguucaguuuucacucauucguauucauucauuuuugcaguaaggacguuuuuccauuuguacauugauuuaggaacauaggaagcuaucgggaaagguuagaaaaacugggguaugcuaaguaaaacaacaacaaaacuauugauucucuguccagcuguaauccuuuuccuguuaaugucaccaacauacaugagcaggguuauucucucauuugugagcccuuacuguaacaaaggucucaguauaugugauugugacuucuuuuccccuugauuuucuggggcaaguguugagguggagauugcggaaauaauauauugagugcagugaaucagauugaagauuagcaaaccuuacaaauaguaaugugucuuuuucagugauaccuucaauuaguuuaggugcuucugugguugacuuugaaaauaacaaucagaauaauuucagcaugaagaaauagaaaucauuaugauaugguggaaaucuuugagauuagacagaucuggauucaaguacuacucuauuacuuuugccugcguaaccguaggcaagccacuuaauccuucugaggggauuaacaaaaggaacugucauuguuuuaagaauaagugacagaaugugagauguuuaaguuauuguugcugcauaaccaugccaacauuuaguagcauaaguuaaucaccauuuuauuauuuacaggaucucucagugaggaauucaaacaggguacaggagugagagcucuuuucuguuccacagugucugcuugcucauuggcaauggcuggggguuggaacacuuggaggugggggauccacuucgcagauugcuuauucauaugucuaaugacugaaggaugggcucagcugggacuguugagcagagcacuuauguaugguuucucuauauggcuugggcuucuuaacagcauguuagaagcuggguucugaagggaagcauccugagagugaguguuccaagggagcuagauagaagcuaaagggcuuuucugauguagucuuagaagucauauagcaucacaucuacuguacucuguuggucaaagcaauuacaagucucaagcuucuucccccaccccuccuuccccagaaucaagagaggugauguagacucccuuuuuuuuuuuuuuuuuuugagacagaaucuccugggcucaaucagucuuccugccuuaaccuaccaccaaguagcuggggcuacaggugcacaccaccaugcccaccuaauuuuuuuuuuuuuuuuuuuugagacagagucuugcucugucgcccaggcuggagugaaguggcgcaaucuuggcucacugcaagcuccgccucccggguucacgccauucuccugccucagccucccgaguagcugggacuacaggcgccugccaccaugcccggcuaauuuuuuguauuuuuuaguagagacaggguuucgcuguguuagccaggauggucucgaucuccugaccuugugaucugcccgccuuggccucccaaagugcugggauuacaggcaugagcuacugcgcccagcugcccagcuaauuuuuuuuuuuuuuuuuuuuuuguagagaugggguuuugcuguauugcccaggguggucucgaacuccugagcucaagcagucugcccgccucagccuaccaaagugcuaagauuauaggcgugagccaccaugccuggucagucuucuaacucuugaagggaggagugucuggcauuaaaagcagcauaagucaaaguuucuaguuuuaucagucuggguuccucauccuuuccauuuuucuucuauucauuuuaugauacugaggaggaaaagaaacaccucuaaacuuccucuuauacuguuuguuaacaguagauuagaguuucucaacuuuagcacuauugacauuuuggaccagaucauuauuuguaugauuguccugugcaauccgugaugucuaauggcgucccuggcgucucugcacuggagccaguagcacuuuacccuucaauugugagaaccaaaaaaugucugcauacauugccaaguguuccguggaggacaaacuugccccuguuugagaaccacugcucuacauucguguuucucaaagauauugauauggaccagccacauugauaucacuugcgggacuuacugaaguguuauuuuuucagaaucuggaauugggucccaaaaaucuguauuuuuuaaaaacuccucaagugauucugaugcacacuuaagugagagaaaugcugauauagguuauccuuaaaagcugaaugacuaagagguauauaaaugcuuuacucacugguaauauacugguuucaggucagauuaauggcauaguagaguuguuaaauauacuguuauauauuauauauuauuuuggguuccauuuccauagauuauuaguguaaauaguauauccauuccuguuucaugaaauuuuuguuuuuuaauuauuuuucucagcuuuauugugaaaacuuucaaacacagaaaaauuaaaagaaugaugcauauaaugaacacuuacauacuuuaccacugagaaucaagagcuguuaaaauuuugccguguuugcuuugugugugugugucuacgugugugagagaaugagugcacacgugugagcaaucagagcuuuccugguguauaugagagagagacagggagagagcaaucagaaguuuucaugguauguaugaaauccaaguaaaggagagagagguguaggauucugcaguauaagugcucccauguggauagacugauccauucaucuucacgguauuuaaucaggauaccuuuacucucaagcagaguugauuuaguguaauggauugcaaaguuuuaaaaaugcgugcuugguugaacaccuuucuuuccuuacuauuuagugguuuuaaugccacuccagucaaauuacacuucuccuccuuucauauagccuaggacagugcuacucaacagauugucuauggacuggguaccagucccuggccuaugaggaaauaaauacaguaaaugagagugaguauuuaguauuaguauuuuauaacaguugagagauacuucaccuucugcuuaauaaugaaaaauuaugacucguauuuuuugugucuuaaaaaauuuuauuuucuagucacuuuuauuguauuugcaaacauacuguauuggucuguguucuaguuaccuacugcuguguaaccaucccagaauguaaugauuuaaaacaauaacaguaauuaauuuuguucaugagucuguaauuugggcaggacuuggcaaggaagacuuuucucuuuucauugcagucagcuguaguggcucaacugaaguugcuccacucacauaucuggcagauuggugcuggcucugagcagagauucugucagugcugagggcugaggaucucaguuccuuucuacaugugaccugggcuuccuuggaggugggugacuggauucuggggauaaguauccccagacaaacccaguaaaaauuguaucuccuuuugugaccaagccucagaagucacugcgucauuucugcuauccucuuauucacugaggcagcuacuaaggucuacccacauuaaugguggaagggacauagacuccaccucuugguguaguggcaaaauuguagaaaauuguugcugucauuuuuguuaaaauacaaucugccauagccugugauagauuaaaaauggaagaaacuggcccuuccccacagauacaaccugagaggcaccacugaccugguccuaccuggcuuuagguugggcacuuacuauaauacaguucuaauuuaacuacuauacauuuggaagacaccuuauuauaccuuuaugcaguagacguaauaugggacaauggugggagagauaacaaaaggcuaauaggaaacucgugaauggguguguaggugugugugggugcacacgugugcaugugugugcauggugguucuguuuuuggcuuacagguuuuagcauuuacaaaucuucuccugggcugguggcuaguuuucucaaagggauuaccaguauccugccugggcaauaaaccuggcugcuaguguuccagaaacccaguuggggaaggacauugagggaaacagaggccaaagugauacugauguuucuauauaauacauacuuuuugaauacugcugaguacagagcucaguacuaggugcuaagagaaauacaaagguaaagcuccuuuuauuugacacuuuaauguuuaaguaguauucuuauuaauauucaagaucuauacauuaugauuacuacuaauagugauacugcuauuagaaguaguauugucuaacacuuuauguauguaauacuucaaagauuccaaacugguuuucagauauuuucuacugccuuagcuaauagauuagcucuaguaagucgucaguacuuacuguaguaccuggaacagaguggaugcuuaauacauauuuuauuaaauaaauaaaugaaucuuuaagguaugguagaaugauugcagccucuggugucuggcucauuaggucuuguacuuucuagcaguguggcaaugaggggauuguggaaccuauguaguucuauuucuucaucuauagaaauaaaguuaaucucucuuuacacacuauauauaaaaauugguugaaagcaucagguaugagucccuaaguugguguguauguuuuccacuucuaguuuuaaagcccaguauguguggugaguagaagaaauugcugguauuaaagacuaguauuagacauuuuaggcacugaaguuuaaaaauagaauguugccccuaggaguagggcagugcauuauuaaauuaaguguugaaaucuuuaugccucuucaugcaacauaaacuuuuauuuggaauaaauaugacauauuaaacaaaauuaaaguuuauuuugguuuauuuaaaaauuuacccuuguuacaguaguuuuauugauguguucguaagaaaacuuaggguuuucuuuuucuccccagauuaacuuguuguuugcaaauuuugacagggcuuuugaaaauagguaauguauuuuuaaaaagaugauggaggaagaaauccaauugaguguauuuauuuagaauaagagagaucacaaauuaagagaugcuaauaccacaaauuucacaaaauucaaaaauaaaauaauuucacuaauuaacugccugacacaccucuaaacauuugauuacagaaacuuagaucacuucauaaaauguuauguuuuaaaaaauuguuuuuaaucgagguaaaauaugaauagcauaaaauuuacuaaaauuuaccaucuuaaccauuuuuaaguguacaguucaguaguaguagguacauucacauuccuguggagccaucaccaccauccaucuucagaaugcuuuucaucuuuaaaguaugaaauucuguacccaauaaacaucucuccauuccccauucuacuuuuugucugugauuuugaacguacuagguuccucauauaauggaauuauauauaauauuugucauuuuguugacuggcguauuugacuuagcauaaugucucaagguucaucugcauuguagcaugugucagaauugccuaccuauuuaaaggcucaauaacacuucauuguguggauauaccauauuuugcuuaucuccucaauggacacuugguuuguuuucaucuuuugguuauugugaauaaugcuguugugaacguguguacaaauaucucuuugggacccagcuuucaguuauuuuggguauauaagcagaagugaaauugcugaaucauaggauaauucuauuuuucauuuuuugaggaacaacucuacuguuuuccacagugggugcaccauuuacacucccaccaacaguguacuuccaguuucuccuuauccuugccaacacuuguuauuuuucuuuuuucuuuuuuuuuuuuuaaaguaguaaccaucuaaauaagugugagguggguauuucauugugguuuuaauaugcguuuuccuaaugauuagugauauugagcaucuuuucauguguauauuggccacuuguauaucuucuuuggagaaaugccuauugacguucuuuguccuuuuuaaauuggauuguuugguuuuugguugaguuauagaaguuauuuauauauuccagacauuagguucaucugauacaugauuggcaaauauuuccuucucuauuguguuuuuaaaaaucgcuuucuugaugguguccuuugacagacaaauaguuuuaauuuugaugaaguccaauuuaucuguuuuuuucuuuuguugcccgugcuauuggugucauauaaagaaauuauugccaaauccagugccaugaagcucuauuccuauauuuucuucuaagaguuguguaugcagggguuuauuucuacaucccaucuauuuugauguguuguuauuuuuguuuucauuuauccaucucagaggauuuucugauuucucuuguguuuuacuuugaccauuacuuaugaaugcguuauuuuucacuuucuuguaaauuuuccuaauuuccuguuaauaauugauaauuucuucuuuauuauuuuuugagacagaaucucacucacucaggcuggagugcaguggugugaucucggcucagugcaaccucugccucccagguucaagugauucuccugccucagccuccugaguagcugggauuacaggugcauaccaccaugcucagcuaauuuuuuuuuuguauuuuuaguagagacucgguuucauuauguuggccaggcuagucuugaacuccugaccucaagugauccuccugccucggccuuucaaagugcugggauuacaggugugagccacugcaccuggccaccuguuacucauuucuaauuuuauuccauugugguugaauaacauacuuugcaugauuucaguccuuuuaaauuuacugaugauuuuuuauggcccuaauauauauuauucuacuuuggagaauguaccaugugcacuugaauagauucuauauauuuuuuuuguuggucauaguguucuauaaaugucuguuagaucuaguugguuuauaauguuguucaaauguucuguuuauuuuucugcauauuuuauucauuauugagaaugaaguauugaagucuccuacuauugucaaauugucuauuucucccuucaauucugucaguucuugcuagauguauuuugggacguuguuuuuagcugcauauauguuuauaauugucugcccuuuuguucuuauacaauaagaguaaaacuuauuaucuaguagcacuuuuggauaaauaucucauuuugacugaaauuaguauuaguauagguaugguagcucuguuguuacuuuuuugggguauauauuuauauauauuuuuauauuguuuauguuuuagaaucugaaauauggcuuuuguagagagcauauaauuggagcaggguuuuaaaaauccauucugcucaucucugccuuuugauuugaguauuuaguccauuuacacuuaaugaaauuacugacaaaccagcaccauuuugcaaauguuuuauaugucuuuggucccuuuuguuucucuauucaucuauuauuguuuguuuguuguuguauguugauauuuuuaaauuugucauuuuauuucuauuguuuauuucacuguaucuuuucaagaaaauuuuuucuuugugauugcccaggguauuuacuuauaacuaucucauggggggaacugcaacuuaauucaguaguauucagaaauuuugcuccuauauagcacauccuccuuuccccuuccuuuguauuacugucacacaaauugcaucuuuauacauuguaagcccaucaacguuguauugcuuuacgcaguuauauuuuaaaucagauaggaggaaaaaagaguuacaaacacaaaauguauuucuaccguuguuuacauuuagcuaucuaauuacucuuuuuuuuuuuuuuuuuuugagacagagucuugcugugucgucuggguuggagugcaguggcacaaucucagcucauugcaacuucugccuccuggguucaagcgauucuccugccucagccucccgaguagcugggacuacaggcaugugccacuaugcccagcuacuuuuuguauuuuuaguagagaugggguuucaccauguugguuggccaggauggucucaaucucuugaccuugugaucuacccaccuuggccucccaaagugcugggauuacaggccuaagccaccuagcuuaggcuaucuaauuacucuuaacugguacuuuuuauuauaggacagauugcuagugacaaauucuuuuagguuuuguuucucugggaauauuuaaaauuauuccucauuuucuaaagcuuuguuuugcuacauaugguauucuuuuugauagccauuuccuauuaauacuuugaauguaucauccuacuaccuucuaaccuucauguuucuggacuagauauugccuuguacuguaauugaggaucauuuguaagugaugaguuacuuucuuuuugcgcuggagauuuucuuucucuuugauuuuugaccacuugacuaugguauguuuagguauaaaucucuuugaguuuauccuaauuggaggucauuaaguuucuuggauguguagauuaauuuuucuaagucaaauuugaggagguaggugccauuauuucuucaaguauucugucagcccccuuuucugucuacuaucuuucucggacuuuuauugugacuguauugguaugcuuguuagugucuuugaggucucaggcucuguucguguuuuuuuguuuuguuuuguuuuguuuucagucuauucuuucuguucuugagacuggauauucucaguuaacuuguuuucaaguugacugauucuucugucuguucgaaucugcuguugcgcucuucuauuaacagugguagaaaguucgauuuaugauuauggaaauugagaugucauuuuuaaacuguccuuuuauuucaaaaggauuuuuaaauugaaaacauuauaaagugcuuucuuuuauauuugagcuagaauguauagaaccacuuauauaaauuauuuuuuaggguaaauugaucacuuaaagauuagucauuuuguguuuuagcuuagugcaguaccuauauuuccugguaccuacaauagcccuuugaguugggugcuauuauuauuuguccauuucagugaagcaagugaggcagagagaggcuaacuagaauaaacacacaacugguuaucacuguucuuuucuuauuaacagguuuuauggcuauaaucuauagaacaaugcauagcugaauuguuacaacgucugagguuaaaagccaauauuaaaauuuuuaauuugcacuuauauuuaccaucacugaaagaaauaagcuacauuuuauuaacauaaugaagaaaaauuaccaaaguaugaauuuugccaaguuaaacuaaucuugaugauaaccaggagauugugaaccagaauaucuaucggggaaccagcccccaauauuucaacguagguucuuuucuauuuucccuaagugucagccggucugagaaauaaagggaaagaguacaaaagagagagauuuuaaagcugggugucugggggagacaucacaugucaguagguucugugaugcccccugagcugcaaaaccagcaaguuuuuauuagcgauuuucaaaggggagggaguguaugaauagggugugggucacagagaucacaugcuucaaaggcaauaaaguaucacgaggcaaaugggcagggcaaggucacaaggccagggugaaacugggauugcugaugaaguuucaugucccacugugugcgcauugucauugauaaacaucuuaacaggaaacaggguucaagaguggagaacuggucugacuagaauucaccaggcuggaauuuccuaauccuagcaagccuggggacgcugcaggagaccagggcguguuucauccuuaccuacaacugcauaaggcagacgcucccagagcggccauuuuagaggccucccccugggaaugcauucuuuccccagggcugucaauuauuaauauuccuuacuggggaaagaauucagcgauguuucucuuacccguuuucagcaauaagagaaauaugacucuguccugcccggcucccaggcaguuagaccuaaugguuaucucccuuguccccugaacaucgcuguuauccuguucuuuuuucaaugugcugagauuucauauuguucaaacacacaugcuuuacgaacaauuuguguaguuaaugcaaucaucacaggcuccugaggugacacauacauccucagcuuacaaagaugaugggauuaagagauuaaaguaaagacagacauaggaaauuauaaaaguauugauuggggaagugauaaauguccgugaagucaucacaguuuauguuuagagauuguauuaaagucgggcguaagaaauuauaaaaguauuaauuuggggaacuaauaaauguccaugaaaucuucacaauuuguguucuucugccauggcuucagcaggucccucuguucggggucccugacuuccugcaacaaaugucaaaaauccauguauauuuugcuucuuaggugguuugaccauauaguuuguuuauuuguuucauuuuuaguuuuuuuuuuuuuuuuuuuuuuuuuuuuuggugauagucucacucuucacccagguuggagugcaguggcuuaaucauagcucacagcagccucgaacuccuggguucaagugauccuccuaucucaacugggauuacaggugcgugccaccaugccuagcuaauuuuuguuuuuuguuuuuguagagaugggguuuugccauauuguccaggcuggucuugaacuccugggcucaagcuaucugcccaccucagccucccaaagugcugguauuauagguuugagucgcugcaccuggccagauuuuuuuuuaacagcuuuguugagguaaaguagcauauaauaagugacauauguuuagaguauaguacuugauguuuuuguuauaggauccgugggauauugcuuagccagcuggaaaccucuguggccaguggcgccuuugccugaguuuuguucuggccugcugggcuuguuccauccacuuggcauggcaggcuguacuuggcucccgcuaccagccuggaucccacaccugccaagggugagccagauguggagcagcaaggcguguguggagcugggguccagccacugugcacagccaggcaugcuggcuguugcaggguaugcagcuccaggugucggcaugggugcuggcucugugcaaggcuguugcuggaucaagcauaccauaagcagcuuccacggcugacgcuggggaaugcgguguggcaccuggaagcuuggagaugccagaaaucacggagccuugaagagggugucagagcccuggcuuggagaguuucuaggucugggcucccugaagggcugcagcauuucucuccuccucucuucuguccuucuugucaccugcagcaacguggugggcaagagguguguuucagcccuguuuguguuacagcucuuuuaagccugccauucagcggguccugaguucuuguccuguguccaggaagaaugagguaugcagacaaguggagaguaagcaagacaaagaggagcuuuauugagcgacagagcagcucagaggagaccugcagugggcagcuccucucuguagucagaguguccagaugaguguucagcucucagcagaaaggguagcuccacucugcagcuggcuaucccauuguuucuucagcucucagcggagaggguaguucuucuuggcugcugguuguccuguugucuccucagcucugagcagagaggagacccugaggugggcagguccucucugcaguugguugucccaucaucucuuggugucuggcugagucuggggauuuaugggccucagagggaagugcuugcugcuugguccauggguggccauggacggacuggaaaaggcaccacaaguucccacucugguccaugggaccagcagcccagcccccaggcuucaggcucucuguggcuugaagguggggcuuuaccggggaccuggcuggccucuuccacccaggagccugacuccugccaccguucauggugcccaggcuauuugugccaaggggcgccugcaggccagugcuaagcgggccucacccccuccucggccuuucuccugugcucguuggcacccaaaguccagagggggccaagguggcagggggcuggcaugucaguacugcuucuggugugugcauaccuggcuggguugugacagcacccgggcuuggccucaacuuggcuccacagucggagcuggcguugacaacagggagaggccaggcagugggagcagacaccucugagccugugagggcaagggggggccuuccugggucccccaagauugcagagaugccuggguccacaacuguaacuuuugcagcaacauccaugccuggggggcggggcuucugccugcuccuggcuuccaccagcucuguggagcaaggcaccgcccugggcccaguucugccuuggggcccucuauccccaccccuuugugccuaacaucacugcucccucacuggugggugacuugcccggccccaucgcaauggcucaggagcgaggggaggcaugggggcaaggugcagguggcacugcagccaggcaaacccugcagaaaugaacccuacacuuggggccagccuugcgaauccugacugcaccuucuuuggggugccugcgggccccugagaugcaguggggagcaugauugccgaggcuucgggccuggaaauggguccuacccggccaugcgagggcagggguggcccagaggcugccucagggaugcaggacacaagggacccacugcugcucccacagcugcuccugcugccacugcucuggccuccccacugcagcuggcgugauggcaguggcuguucuggauggcccgcugcugccaccaucauuuugacauauguauacauccauuaaaccaccacuacaauaaaaauaaugaacauaucuauuacuccugaaaguuuuuuugugccuugauguaaucccuucucccacagcucccccacuggacucucauccccagggaacugcuggucugcugucuaucaccauagcuuuguuuguguuuuguagaauuuuauauaaauggaaucauacaguauauacucuuuuuuuggucuaauuuguuucucauuguaauuauuuuuagacuugucuauguuguugcauguaugaauaguucuguuuuauuacuuguauuccauuuuauugauauacuacaggucaauuaauaucacauaugaauaaacuaauucaccuauuagaugcuuguuuccaguuuggggauauaauaaaacauucauauacagaucuuuauauggaucuaugcauuuguuaccuaggaacgcaauggacagcucauaaagcaggaauauguucaauuuuguaagaaagugccaaaccguuuuccagcauuguuguaacauuuuauauucccaccagugaugaaugagagauguauuuucucuagaucauuuccagcauuuggcauugucacuguuuuuguguguguguguguguguguguguguguguguguguuuugccauucugauagguagguagugauaucgcaugguuuuaaauugccugagccuaaugucucaugauguugagcaucuuuuuguaugguuauuugccauccauauaucuucuuuggugaaguauuuguucacaucuuucgccuuguuuuuuuaauuguuuuuuucuuuuuauuuaguuuugagaguucuuuauauuuuggauacaaguccuaugugcuuuugcaaauuuuuucccagccucuggguugucuuuucauucucuuaacagugccuuuugaacagcagauaguuuaauuuugaugaugucgaaagagugaugaagaaaagauuagccacucuccacugaauucccuuuuuaccuuugucaaaguuacguuguccauauauauggggguauuauucuggacuguuuuguuccauugauguguugucuuaucuugaugccuguaugacagugucuugguuuugcuagcuuuauaguaagucuugaaaucagguagauauacuccccuauggugaccaucuuuuucagaguugcuuuagaagugguaaaaguagauggacaucuuuguuuuguuccugauauuagaugaaaagugcucaauuuuuugccauuaagugcgauguugaauauguuuucuguagauguccuuuaucaggucaagaagauccagcugaucucuuuccuccauucucugccaccuucaguccaucuuucuugugcuuucuugcugcugcugcauauggucaugucauuugucuucuauggccuaaauccuuuaaucucuauuuauggcaauagaaaaaauaaacuaaguuuuugccauuugaccuuugagguuaaaacaaggucggaaacagcaugcauauuuuuauuaaacaaaauagauuauauuaacguuaacagaauuuuaaauaugaaaaaauuguaucccagaauuuuaauuccccagucauggugugcauuugccuaagcgcuucuucuuuuuuuguauuuguucauaucuuuuauaguucgaacaucauuuauguucaacucuucacuuaacauaauguauauaacuuuuuacauauuuuuugaacauaaaaaguagauuuaucuugguuuucaaacuuuuagaauauuuacaauuuuauagguacauuaaauauguuuaaaggaauaaacauuuuuauagauuauuauuuauaauccuuuuuuaaaagaaaugggcucuuuccuacugucagcagcuguuuauacauauauaccaauuuuacugcaacaucuuuuuuuuuuuuuuugagacggaguuuugcgcuugucacccaggcuggagugcaauggcaugaucucagcuuacugcaaccuccgccuuccagguucaagcgauuuuccugccucagccuaccggguagcugggaugacaggcacccgccaccaugccuggcuaauuuuuguauuuuuaguagagacaggguuucaccauguuggccaggcuggucuugaacucuggaccucaggugauccucccaccuuggccucccaaaguguugggauuacaggcaugagccaccaugcgcggccaacugcaacaccuuucaaauggaaaaguaaagaugugauagauaauuuuauuugaucuucuuuccccuuuuaaaacaugaagauuuagcauauuuuuucccaaagagagaauuuucaaguagugaauucuccagaaauuaagaauuacuguauugugaaaugaaaaguaaauguggcaggaagugggaauauauuugauaccuugguaacuaaaaauauuguguuaguuuauggaaaaaucaagagcugauuagacaauucacuuaagcuuuaggucuauauuuauuuggauagauuaauaccauauucagguagguucuccaaauauacuguuuuauuaacuauuguuuauucauuuucaaagacucagcuuauagugucagacuaauuuauucacagccguaacuaguggaguaugaggcagaaaagcaggcugggaggagugcugauuuucaggaccugaaggguggaaaauauacuguugauauaucguuaugauugcuuuaucgaauguauuguuugauggcuacuccucggcuucucucugauccaguaauaaaccuuauaaaacccaggagauaaccaaaauguagcucuauacaaucaucuuucauaguuguuauggcaggugaaguuguuagggacauuugaauguuauuuuucggcuucagaucauuggaaacuaggaugacuuaauguuccucuauuggucuguagagauuguaguagcaaaguucaaacuacugauacuaauuuuugucacagcuauuuuuaaccuccauaagugaaaugcugaaaaguuauaaagcaggaacagugauuauuucaaugaugacugcuucuuaguauuggaaauauuuuauugacaaacuauccaauccaaaguuaucaaacaaauuaguagaacauuugaaaaauaaaaaacacuucaguuaaugauaacccuuguuaagaaucaauagaaauaagacaugugaguaauggcaaauuuuucguuuuaaaguuggccauuuaaaagggaaauacuagacaugguaauuugguuauuauacuuuagguugggaguaugaagaauuaccuuuguaucuggcuauaagucugccaccucucagcaaauuugaaauaauugagcuuacagauucucaccuuucuaagaaguuugccuaauuuaggcacuuuuuucaccccagaauucacucuucuuggaacugaaagaauauggugggguuuauaauuccaaaacauuuccccuggaaacacaggaaacggaaaagaaggaaaagacguuaaagcugacuagguggguuagcuucaagugcugguucucuuuuccugugucuucacuucauaaaaucaggaguugaucaugcuuuuaauguaauuauuuucuggucaagaaaaauaccauauagaaaacuuuagacuccuccagugauguaguuugcaaaauaaaaaugcguucuuugaccauuaugaaaguaauuuuauacagauuuuucuucauuuucuuaaguuacauauagaagauaaaauagaaaaaaauugugagucgauacauucuuuuuggguaaaagggagauaauaccuuauuaaaggaaaaaugcguaaugacuucauuccuccagauugcuuuaaagagccuuuuguucucauauguucuuuuaauucuaagaggaugcaaucauuauuuuuaacauuccucuaccucccacuuguaguaagauauuugaauuguauguauuuguuucaggauuuugucagagauccaguuucucagcaucuuuaccaaaaugccacuauuuuuuauuuuggccguuaaauagguauauggugguaucucauaauggucuuaauuuacauuucccaaauggcucagauugagcauccuuucaugugcuuaauggccaucugaauaucccauucgguaaaaugucuuuuuauguuuuuuugcccauuuucuaaugggauuauuugauuuuuuuuuuuuuuuacuguugaguucugagaguuuauuacauauucugaguacuagucuauugucagauaaauguuuugcaggcuuuuuuuuuuuuacagucuguaaguuuuaaauuuugaugauauagcuaauuugucuuuuuuguuguuguuuuuaugaaucaugcuuuugaugucacaucuaagaacacuucaccauaccuaggucccuaagauuuucuaguauguuuucuucuaaaaguuaguguuuuagguuuuacauuuaaaucugagucagugaguaauuuuuugcauaaggugugagguuuagguugagguucauuuuucauuuuguguauggauuucugauugguucagcacuguuuguugaaaaggccauccuuucucuguugaauuguuuuuguaccuuuguuaaaaaucaguuggcuguacuugugugguaauucuauuuuguuccagugaucucggugucucuacuucugucguuaccaacagucuugauaaauguagguacauaaucauaaaaucugggagagggauucccaguuuauuuuucuuugggagugggaguauaguuacucccacuuuagucuuuuucaaaauuguuuuugcuacaaugauuccuuugccuuuccauauuaauuuuuuauuuuuuuuaaauuugaggcagagccucgcucuaucacccaagcuggagugcaguggcacgaucuugguucacugaagcuccgccuccuggguucaagugauucuccugccuuagccuacugaguagcugggauuacaaacaugcaucaccacgccuggcuaauuuuucuauuuuuaguagagaugggguuucgccaaguuggccaggcuggucuugagcuccuggccucaaguguucugccugccuaggccucccaaaauucugggauuacaggcgugagucacugcgccuggccuuccauauuaauuuuagaauaaaauuaucuaaaauaaaauuaucuacaaaaaaguacugggauuuugauagaaauuacauuaaaccuguaugccuauuuggagagaauugacguguuuacuaguuugaauguuccaguccgugaacauaguuaugucucuccauuuauuuagauuuucuucaauuuuuuuaucagcauuuuguaguuuuuagcauagaaguucucuauguguuuuguuagauuuacaccuaaguauuuuguuuuuuguuuagcaguugcaaauuauacuguauuuuguuugacuccucauauuuauuccuagcauacacaaauaaaacugauuuuuguauguugauguauugggugaccucgcugaacuuacuuauuaguucuaggagugcuuuuguagauuccuugggauuuucuuuguaaaauuauuucaucugcaaaaauguuuaauuuauuccuguaugcuauuucuuucuuuuucuguuuuuucuuucuuucuuuccguuuuuuuuuuuuuuuuuuuugaggcagucuuauucucucacccaggcuggagugcaguggcgcaaucuuggcucacugcaaccuccgccuccuggguucaagcgauucuccuuccucagucucccaaguagcugggacuacaacaggcgcccgccaccacacccagcuaauuuuuuguauuuuuaggagagacgggguuucacccuguuagccaggauggucucgaucucuugaccuuguaauccgccugccuuagccucccaaagugcugggauuaccggccaccgugcccggcgcuccuccuuuuuuuaaccucacagcauaggcuaggacuugcagcauuauguugcauaugaguggugagagcagauacccuuccuugccuuauuccugguuauaggggaaagcauucaggcuuuaaccauuaaguaugauguuagcuguggauuuuuuuguagaugcuuuuuauuauguugaagaagaucccuuuauuucuaguuuucuaagaauuuuuuauuaugaauggguggugaauuuugucaaaugcuuuccugcauugauuaaaaaggucaugugauuuuucucccuuagucuguuaauaagguggauuauauugauugauuguuaaaauauugggugaaccuuguugcaccuuugaaauaaaacccccuugguacaugguauguaauucuuuuuacauauugcugaauucugguuucuuguauuuuauuaaggguuuuugugucuguauucaugaggaauauugguuuguaguuuucuuuauguuuuugucuguuuuuuccaucaggauaaaauuggcuacauggaaugauuugagaaguauccuuuucuauucugcuuucuggaagagaucaucuagaaauuguguuacuuuuucuuuaaauguuagguagauuuucccaggaaacccucuguguuugaauauucuguugggggaguuuuagaauuacgaauuugauuuuuaaaauaguuauagggcuguuuaaauuuucuguuucauauuggcugaauuuuggcaguuugugccuuucauggaauugguucuuuuuaugucaaauugauguauaaguuguuuguaguauuaccauuucaaugguugcaaagucuaugugguauccucuguuucauuccuaauguuagcaauuuguguuuucuguuucuuuguuagccuugcuagagguuuauuauguuuauugauccuuuaaagaacuagcuuuuuuccccuauugauuuucucuauuuuuauuuucuuuaauuucauugauuuauguucuuuguuauuuccuuccuucuguuugcuaugaguucauuuagcucauugucuagguucuugaggagggagguuagauuacugauuugagacauuuccuguuuucuauuguaugcauauauugcuguagauuucugucagcacugcuuaaaucauaucucacaaauuuugauauguuguguuuucauuuuuauucaaucaguguaucuugauuuuccuuaagauuuccucuuuguccaguggauaacguagacuuguuuaguuucuacguguuuggagauuuuucuguugucuuucuguuguugauuucugguuugauuccauuguucucagaauacauuuugcauaauuucaauuauuuaaauauuuagauuuguuucuuagcccaggauauggucucucuugaaauguucaguggauguuuaaaaauaauuaauauucuguugucuuugcuagaguguucuauaaauguucaugauuagauccuauugguuguuaaguucucuuauauucuugcuaauuuuccuaguuguaucaauuauugagaaaggggaguugagcucuccuauaauugugggauuuaucuuuuuuuauuucaguuugacaguuuugcuucauguauuuuugcagcucuguugguugguacauccacauuuaggauugguaaugucucgguggcuugaccauuuuaucauuauguaaugccuaaucuguucuuaugaauuuuauuuguucccaagucuacuuuaucugauacuaauauagguacucuucuuccuauugauuaauguuuccaugauacaucucuuuccauccuuguacuuucuaccugccuguauuguuauaugugaggagaguuucuggaagacagcauuauagcugggccauguaccccauccccacccccacuccgccaaucacugucauuuuaguuucuuagagacaggguuucugucugucucugacacugggguacaguggcaugaucauagcucacuguaaccuugaacuccugggcucaagggauccuccuaccucagccuccugaguagcuaggacuacaggugcaugccaccaugcucagcuaauuuuuuuuuuuuaauuauacuuuaaguucuaggguacaugugcacaacgugcaaguuuguuacauagguauacaugugccauguuuguuugcugcacccauuaacucaucauuuacauuagguauuucuccuaauaccaucccucucccugcccuccacccaacgacaggcccccgugugugauguuccccgcccuguguccaaguguucucauuguucauuucccaccugugagugagaacaugcaguguuuuguuuucucuccuugcgauaguuugcucagaaugaugauuuccaguuucauccaugucccugcaaaggacgugaacucauccuuuuuuauggcugcauaguauuccaugguguauaugugccacauuuucuuaaucuagucuaucauagaugaacauuuggguugguuccaaguuuuugcuauugugaauagugcugcaacaaacauacacguguaugugucuuuauagcagaaugauuuauaauccuuugggcauauacccaguaaugggaucuuugggucaaaugguauuucuaguucuagauccuugaggaaucaucauacugucuuccacaaugguugaacuaguuuacacucccaccaacaguguaaaaguguucuauuucuccacauccucuccagcaucuguuguuuccugacuuuuuaaugaucgccauucuaacuggcaugagaugguaucucauugugguuuugauuugcauucuggucaucucugaugaccagugaugaugagcauuuuuucaugugucuguuggcugcauaaaugucuuuuuuugagaagugucuguucauauccuuugcccacuuuuugaugggguuguuuguuuuuuucuuauaaauuuguuuaaguucuuuguagauucuggauauuagcccuucguagauggauagauugcaaaaauuuucuccuguuuuguauguugccuguucacucugaugguaguuucuuuugcugugcagaaguucuuuaguuuaaucagaucucauuugucuauuuuguuuuguuuguuuuugccauugcuuuugguguuuuaguuaugaaguccuugcccaugccuauguccugaaugguauugccuagguuuucuucuaggguuuuuaugguuuuaggucuaacauuuaagucuuuaauccaucuugaauuaauuuuuguauaagguguaaggaagggauccaguuucagcuuucuacauauggcuagccaguuuucccagcaccauuuauuaaauagggccauuucuuguuuuugucagguuugucaaagaucagaugguuguagauguguggugauauuucugaggccucuguucuguuccauuggucuaucucucuguucugauaccaguaccaugcuguuuugguuacuguagccuuguaguauaguuugaagucagauagugugaugccuccagcuuuguucuuuuugcuuaggauugucuuggcaacgugggcucuuuuuugguucuauaugaacuucaaaguaguuuuuuccaguucugcaaagaaaaucauuguuagcuugauggggauggcauugaaucuauaaauuaccuugggcaguauggccauuuucacgauacuccuucuuccuauccaugagcauggaauguucuuccauuuguuuguguccucuuuuaccccagaauuucauauucagccaaacuaagcuucauaagugaaggagaaauaaaauucuuuacagacaagcaaaugcugagagauuuugucaccaccaggccuggcuuacaagagcucccgaaggaagcacuaaacauggaaaggaacaacugguacccgccacuguaaaaacaugccaaauuguaaagaccaucgaugcuaggaagaaacugcaucaacuaaugggcaaaauaaccagcuaacaucauaacgaugggaucaaauucacauauaacaauauuaaccuuaaauguaaauuggcuaaaugccccaauuaaaagacagacuagcaaauuggauaaagagucaagacccaucagugugcuguauucaggagacccaucucacgugcagagacacacauaggcucaaaauaaagggauggaggaauaucuaacaagcaaauggaaagcaaaaaaaagcagggguugcaaucccagucucugauaaaacagaguuuaaaccaauaaagaucaaaagagacaaagacggccauuacauaaugguaaagggaucaauucaacaagaagagcuaacuauccuaaauauauaugcacccaauacaggagcaccgagauucauaaaacaaguccuuagagaccugcaaagagacuuagacucccacacaauaauaauggaagacuuuaacacccuacugucaacauuagacagaucagcgaggcagaagguuagaaagaauauccaggauugaacucagcgcugcaccaagcggaccuaauagacaucuacagaacucuccaccccaaaucagcagaauauacauucuucucagcaccacaucacacaccacauccaaaauugaccacauaguuggaaguaaagcacuccucagcaaauguaaaagaacagaaaucacaacaaacugucucucagaccacaaugcaaucaaauuagaacucaggauuaagaaacucacacaaaaccacacaacuacauggaaacugaacaaccugcuucugaaugacuacgggguaaauaacaaaauuaagguagaaauaaagauguuauuugaaaccaaugagaacaaagacacaacguaccagaaucucugggacaacuuaaagcagugcguagaggaaaauuuauagcacuaaaugcccacaagagaaagcaggaaagaucuaaaaucgacacccuaacauuacaaugaaaagaacuagagaagcaagagcaaacacauucaaaagcuagcagaaggcaagaaauaacuaagaucagagcagaacugaaggagauagagacgcaaaaaacccuucaaaaaaucaaugaauccagaagcugguuuuuugaaaagaucaacaaauugauagacugcuagccagacuaauaaagaagaaaagagggaagaaucgaauagacgcaauaaaaaaucauaaaggagauaucaccacccaucccacagaaauacaaacuaccaucagaguacuauaaacaccucuacgcaaauaaacuagaaaaucuagaagaaauggauaaauuccugggcacauacacccucccaagacuaaaccaggaagaaguugaaucucugaauagaccaauaacaggcucugaaauucaggcaauaauuaauagccuaccgaccaaaaaaaguccaggaccagacggauucauagccgaauucuacaagaguuacaaagcggagcucguaccauuccuucugaaacuauuccaaucaauagaaaaagagagaauccucccuaacucauuuuaugaggccagcaucauccugauaccaaagccuggcagagacacaacaaaaaaagagaauuuuagaccaauaucccugaugaacaucgaugcaaaaauccucaauaaaauacuggcaaacugaaucuaggagcauaucagaaagcuuaucccccaagaucaagucggcuucaucccugggaugcaaggcugguucagcauacacaaaucaauaaacguaauccaucagcuaaacagaagcaaugacaaaaaccacaugauuaucucaauagaugcagaaaaggccuuugacaaaauucaacagccuuucaugcuaaaaacuuucaauaaacuagguauugauggaacguaucucaaaauaauaagagcuauuuaugacaaacccacagccaauaucauacugaaugggcaaaagcuggaagcauuuccuuugaaaacuggcacaagacagggaugcccucucucaaccacuccuauucaacauaguguuggaaguucuggccagggcagucaggcaagagaaagaaauaaaggguauucaguuaggaaaagaggaagucaaauugucccuguuugcagaugacaugauuguauauauagaaaaccccaucaucucagcccaaaaucuccuuaagcugauaagcaacuucagcaaagucccaggauacaaaaucaaugugcaaaaaucacaagcauuccuauacaccaauaacagacagagagccaaaucaugagugaacucccauucacaauugcuacaaagagaauaaaauaccuaggaauccaacuuacaagggaugugaaggaccuguucaaggagaacuacaaaccacugcucaacgauguaaaagaggcccagcuaauuuuuaaaacauucuuuuuuguagaaacagggccucccuguguuuuccaggcuggucucaaacucuuguccugaagcaauccucccaccucccaaaucguugggauuacagucaugagccacuucacccagcccaaucacugucuuuuaauuguggaauuuuacuuggcaagcgucuccuugucaacauaguaagacuuuuuuccccuacauuauuuuuauauuuauauaacaaugacuuuuacuuugagcuuuaaucuuuugaaaugaauaaucugugagagaucagcuccagguauuaucacugauuugaaauacuauuuucauuauauuuugcuuacucauuguucauacugcuuacuacuuauugcuuacucauucaaacaucccaaauacuagucuuucuucuaguuuaguguguuuccuuuaccuaauugucuuuaagacagaaguguuagguguuuuaaaguuugaauccuuaaaugccugaguguuuuaagaguuuuuuuuucuccuccaugaauguuaauuuucuagguauauaagucaguguuucaaagaauuuucuuucacaacuuugaagcuacagcuucauugucuuuaaacaucuaguaucgcugauaucacugugauuucuguuguuuuauaggccaucuaguuuuuaucucuuagguuaaaaauucagaagcaaagauuggucaccauuucuauuuuguuuucuuaggaauaauaacaauaauacuauuagguugaauuuugaggaugguuaaaaugaaggguuguuuuuuuuuuuaaacuucuugguuuccccaacaccuuaaguuuuuuaaaaaagggaagggccugccaaaauuaaauaauuuuuccuccuguugucauucuacagugcuuuaaaauacuugcaucaaugaguaauauccaacuuccugaggcagcauaaucuucccgccccuuuuggcuacuccaaaguuuacauauuuugaauuggaauaugacuuccuuaaaaauuuauguauuaaaucuucuggauggagcaguuaaaaaaaaaaccucuuuuucaaagcagugguaacuuuaguuugaugaugaacuauauauaacuuauaccuacaauucuuauucugguguuucaaaauuuauaacuguuuuccaccuaaguuuuaauugagaaauauauaauaacuuugccuuuuaaacuacagcuuauauuuuacgaaccuuuuauuuagugaauuuuuuuuuuuuuaacuuagacuuuguguggacaguaaugaccucacguuuccgauugccugcuggcagaaccuacaauguacgagcaucagaguuggcccgagacagacagcauacugaagugguuugcaacauccuucuucuggauaacacuguacaagcuuucaaagucaauguaaguauuuugugucuuuuaaaaaauaaucucuggcuauaagucugaauuuagacauauauguaaacuaggauuauuaaauuauaguacaguuugaaaagucuuauucaaguaaaaaagucuuuuuggugcaggauuguauuagaugcaugcucucauucaaacugggucuuuuuaaaaaguguugcucacuggauguuguugagaaaccaacagugugcauuuugauuaguagagcagauccauaguaugugugugguuuucauaaaugugcuugagggugccugaaaagaauuuguucuucuaaauaauuuauacauauucaugguaauuuuacuuguacugucugugaguaaaauuuuugccaaacaaaaauaaaugacagcccugaucuuaucuaucgucugaaauauuuauuuaacaaauauuuguucauccuauuugugucuagcuuuguuugcucaucguuauuugugaguuuuacccaugugguguguuaacaguaguuaguucauuguuacugcucuguaguacccuuuuguaugaauauacuauaguuuacuuauccuuucauuuaccauuuacuuguccaguuuauuguugguauauauuuggauuuguuuccacuuugggcucuuacaaauaauacugcugugaacauucuuguacauaucuugauacauauaaaaguguauucucccuuuuuauuuaaaaacuuuucaaccuauauggaaaaggugaaauaauauuauaaugaauacccuuauacccuuuaccuaaauugacccaguguuaacauuuugcacauuuacuuuauguuuccuucucucuacaugacuuuuuuuuccugaaccuuuugaaaguaaguacuucaguauuccgagaaucucauaauuaccacaucccuaaauuuaacuuuaugaaaauaauaauauaugcagucuguauucaaacuggaauucuuauucuucaggauguuuugguauuuccaaauuuuucaggauguuuucugcuguauuacuuggguauuuccacacuuugaaaucuuuaaguaauauaaaauaugaaucuuacaccggggccagucgggggauuaggggcugggggagggauagcauuaggagaaauacccaauguaaaugaugaguugaugggugcagccaaccaacauggcacauguauaccuagguaucaaaccugcauguugugcacauguacccuagaacuuaaaguauaauaauacaaaaaaugaaucuuucuuauuuaccaguuuaagcuuaaaauuuucuguguauuacuauauagcaggauuaugaauuuaucucaaauuccaagcuauuucacauugaaaaaggggcugcagaguagugaauauuacaucauuaucauuaaaaauaccuucaacauuaucuaaaauacccaacagauuuaggauuuagugugcuuuucuaaaaagcuaaacuuuugauuucuuuuguauucuaucaucuguuaauauauaguuggaauauagguugccaaacagagauaacauaaagugaagagaauucuacuucguacaaauuucuauuuaauagaaacucucauguauuagacaguugauguaagaaaauaagccuuuuuuccuauuauucacguguuagaauucuuuuuuggaaaaggcauaaauuuaauaacuuuugucuuagcuuaaauuuagcuacuauuuaguuuucauuuuaacuauaguuuugaauguauuucaaaauauuguaaaaagguuugguauguuucucagcuagcauaauuuucuguugagcacuuuaguuaacaguaguaugcuguauuuuucaguguaguaaucaaugugcugucuaguuacucuuuuagaaagacauauauauuaauguacuuuuauauguuuauauuuuaaaaauauauauuacauauauuuagcuggcaguuucaauagaccuggauauauuaccuagaaugguaaguaagcuuaccauucuguggugcuagaaacuuucucuaccauuaucucaggucaucaaaaaacuuaagaggaacaauauuuaugaaaaauugcugguuaugugguauauuuauuccucuggguauuugaacccaagccauucaaaccaaaagaguugcuuuguacuuuuagguagauuauuuaucuuuuaauccaugugaauagaucuccaguuauguacuuuacaaccuguggagugguauguggcagccugcaaacuaauuggggguuugaaaguuuugguguuuguuuucuuguguccacuuaguaccauuaagucucagaaauccuuugugggcagcugccagguucaccagcauuucucuguucaccaagaaggagaacuacucaguuuccuuuggagacuaccaggcauuggagucauugcuuuucaugaaagauuuuugcaccacagguaaaauauucauguugccaaagccugcuuuguuucaucugguaguuaucucaucaaagccguuucuguauuuucugagggaaauuuuuguaaugaaggaguugauguaacuucacuagaucuugcuuuuucucugcuguggacauaggaaugauaagccuguuaucacuggguuuguguuggcuuguguuguuucaaugucaaguccuauuuucacuguggcuuugguauaaccauuuauuuacuguggccaaccuauggaguguauugucccucucaugccgugaauucauugucacuaaaugaauucaugauaugagaauucaucucaccaaauauguuugcauuaacaacucacuaaauauguuugcauuaaauacuuuaaaaugcauaguguccguacuacauggauugaugucuucaaucuaugaggauuuuuaccccuaauuuuugacuugacuuuuacuuuggugcagcugauuaacguuagccuguaugaugaacaaggaagggcugggaggaccagccuauuuuaguuacugugacugcguaagaaauuacccuaaaacuuaguggcauaaaauaaccauguauuguccucagggauuccgugagucagagauucacacacacacacaaaaggcuuaauuuugcuccauuauguaucaguccucggcuggaagacucaaaggcuggaggcuagaaucauucgaaggcuuauucacucacauggcuguuaccugaaaccuuagcugaggcugaggcaccuauauaugaccucuugauauccuggacuucuucauagcacaguggcugguuucuuucuuucuuuuuuuuuuuugagacggaguuucgcuguuguugcccaggcuggaguacaauggcacgaucucggcucaccgcaaccuccgucucccagguucgagcgauucuccugccucagccucccuaguagcugggauuacaggcaugugccaccaugccugguuaauuuuguguuuuuaguagagacaggguuucuucauguuggucaggcuggucuugaacucccgaccucaggugauccaccugccuuggccucccaaagugcuaggauuacaggcaugagccacugugcccggucacaguggcugguuucuaagggugagcaucuuuagagagagagccacacuguagcuauauugccuuuccagucuggccugggaagccauguaauguuacuuuuuccauguucuauuugucaagguugucacagaguuaagugaaaggaaauagacugcaucuugauaaaaaguggaggaucaucaugugggaucagaaauguugccguggacuuacugggaaaauacagucugccaauauggcauccuguggagguguccauuuugccucuuccucaucacuuacuguacccaucuuccuacuuucauagauacccagaaauuucaucccagaacugucuccuuugcuucucaagggauagcuaccauauuuaaggagucagagaugaugaaagacagguuuaauuuuuauuauuugcucuuuguguuuauuauuuaaauuauuuacccaggugugccauacuuaaaaaaaaauguauauguguguguaugugugacacacacacaucuaucuuuuaaauuugaucuauauguuuuauuuuauaaguguauguauguacauguaauuggcguauucauuuacacaauuuucaaaaccauauaguuuuauaggucuugaguuuguagagccucacugccagucuucuuagagcugagugagaggaagggauuggagaggacuuaccuauucacuauguagauuuuuucuuauuaugcaggcucugucuguacaauacaggcaguauaaucugccuguacaauuaguacaguacaaauuaaucagcugcacaugaugcuccugauuccagaguccuucugguucauuuucuucagagaguaaaucuccaguuccuauggugauuggcuguaggggaggggaagugagagaagucauguaggggcuguuacuuguauagacucucaacauuuuuucaguccugacccugccuucucuuuuugaaagauaauuuguaccccuauuucuagaguuugugggguaaaugaacuugcuccuaggccuuucucacacuguuaacuuuuucugucacuuaaggugaccacugaaguugcuuuucauuuuccaaaauuuucuuaggguagucuuuucuuucauuacuaacuauaccuacacuguuauuuuagugugccuugagcaaacauuuauguucagccuuccucauuuuuaaccuugacaucucucaaguugauugucaacagugccuaccuugaaggagaauuuauuaaauaccaaacuuuaaaaaauaaaaucagauguuaaaauggaauuuaucuuuaguacaaaaagacaugauaauuuugucagcuuuuauaguauaugaaaaguccaauauuauaguguaugauagauuuuuaaagcuuuuaucuauuuugaaauccuuuuuuucuaggcuauaaucauauuaaacacuagaaaauuauuuuaucagucaaauuuagaguugagcacaauuaaggugaccauauuucuuguuuuauuauuucaccuugcugugguuucaucaggcauauaguucuugggucucauauuauauuugccaugcauaagucuguuacugaaaaugaccuuuacuucuauugaaagauucuugggcaguuauucaaugaugauuuuauacaucuuuauuuugaaggcuuacucugugacuauacacaaguuguucuugucuguguuucauauucuuucuuuguuaagagagaauaauaucuaccugacauuaggaugcuuagcauuaaacaagaauguuggugaagugccuguuuauguaucugacuaguauuaugcauuuagaaagguugacuuuccucucuugcuuguaauccaauugauccauucucuuguuccagaaauguuuucuuggaaauauguuauuuuugaaauuccacaaaauagcaauuuacuaauuguuugaugugcauauauaacguuuucauccauguauugguguacauauacugcuugcaaaacccaauuuguuuacuggcaguauugauuaaaaauauauauacacagaaauuuuaaaaugccaguuauuuguaaaaaguaaagagaaaacaauugucaaguguuacuuuuuugagaauuagguuuuuuuuaucccacagaaaauuguaguuauucauguacauuauuuaauaauuauugaauaccuaacauacauuauggaguauaauucaaaaauaguuggcagccauuaaauuaugagagagauguuggauucuauuuagaaagauuuucagcuugguuuuccuucucuggaaauuacauguagauuuuauuguuuuuuguaauauguauaaugcacaaaacagugcaguacacagaucuucauuauauaacucaaugaauuauuuuauguauacaccugugcaguaccaccagauuaaggcauugaauaucucucucaauaaaaaggauucccuugugcuccucuaaguauagucacgcaucacuuaacaacaggcauacauccugagaaaugugucguuaggugauuucaucauuguguugagcaucauagaguguacucacauguagaugguauaaccuauuacacaccuaggauauaugguauggccuguugcuccuaggcuacaaaccugaacagcguguuagugaacuggcuauuauaacaugaugguauuuguauaucuaaauguaucuaaacauagaaaagguaugguaaagauacaguauuaaaaucuuaguuaggcacagcgguaggcacuuauagucccaguuacuuaggaggcugcgguggaaggauuguuugaacccaggaguuugaguucagccuggacagcauagcaagaccuugucucugaaaaauaaaucaaaaaucaaaaauuaaaaaucuauaaucuauggcagugguccccgaccuuuuuggcaccaggaaccgguuucauggaagacaauuuuucaucggacuuggguguggggcaaugguuucagggugauucaagcacauuacauuuauuguguauuuaauuucuguuauuacugcauuguaacauaucaugaaauaauuauacagcucaccauaauguagagucagugggagcccugagcuuguuuuccugcaacuauauggucccaucugggggugaugguagacagugacacccaaaguguguugcuuauguccagucuacuccauaaucucauuuugguugcugucacuucagaaaacacugcuucauaaagauaggauguuggaaauggaagcaggcuuuucagugcuguuguagcaaucucaggauauuccaccuugacuuuaaucuggaauuuacggagaugugaaguugucucaaacauacuuuuauaaggccaccaucauuugcaaucucaagcaguugauucucuucuagcacggacaaaguugauucaccugguuuauucacaaaugggucacagauccauguaaugcucgaauucuuuugaaagcugagaccuaucucagaaguugccauagagcugugugaacagaccugaguuaagggaaugcauuugucaacuuuugcuuuuguugcaauugcuuuuguugucuucgucaugaaaucuuugcccaugccuguguccugaaugguauugccuagguugucuuccaggguuuuuauacuuuuggcuuuuacauuuaagucuuuaauucaucuugaguuaauuuuuguauauggcuuaaggaagggguccaguuucagccuuaugcauauggcuagccaguuaugccagcaccauuuauugaauacagaauccuuuccccauugcuuuuuuuuuuuuuuaauacuuuaauuucugggauauaugugcccaacuuuucucucuggcugcccuuaacauauuuuccuucauuucagccuuggugaaucugaccauuaugugucuugggguugcucuucucaacaguuguagguguguagcauuauuucugggcuuucuguucuguuccauugguuuauaugucuguuuuuguacuaguaccguacuguuuuugguuacuguagcccuguaguauaguuugaagucagguagugugaucccuccagauuuguucuuuuugcuuaggauugccuuggcuauuugggcucuucuucggcuucauaugaauuuuaaaauaguuuucucuaguucuuugaagaaugucaaugguaguuuaauagagauagcauugaaucuauaaauugcucuggguaguaugaccauguuaacgauauugauucuuccuauccaugagcauggaauguuuuuccauuuguuaguguccucuaugaugucuuugagccgucguuuguaguuuuccuugcagagaucuuuaacuugccuaguuguguuccuagacauuuuauucuuuuuguggcgguugugaaugggaguucauuccugauuuggcucuuggcuugacucuuguugguguauaggaaugcuugugauuuuugcacguugauuuuguuuccugagacuuugcugaaguuguuuaucagcuuaagaagcuugagggcugagacuaugggguuuucuagauauaggaucaugucaacugcaaacaggguuaguuugacuuccucucuuccuauuuggauaccauuuuuuucuuucccuugccugauugcccugguuagaacuuccaauacuauguugaauaggagugguaagcuagagccuccuugucuacacauauauuuacaucaccccuaaaucuguuuuuauugacugucuugucucuugauugucagucacuuuccccugcuuuacacaucugcuaauuugucguuguauauugaacauagugagugaaauguagaguaauggacaacauacuauggccaugggccaaauccagccuucuggcuguuauugcauggccuauagcuaagaaugguuuuuuacauuuuuaaagguuauuguuuuugcuauguugcccaggcuggucuugaacuccuggccucaagcaauccuccuaccucagucucccagagcacugagauuacagcuaugagccaccaugcccagccucuguuuguuuuuaaagagaauguacaacagagacuauguguccucaaagccuaaaaauauuugcuuucuggcccuuuauaggaaagguuuggacucuuauuuguuggagcucuggauuauuaagucccucuaaauaauagugaauuauauuauggcaggcaguuaaauagccagcagauuacuuugaucuuauggagauuaguuuuaagcuuuuuaagauaggucuguuucaccuuuguucuuacuccuaggacagaguuugucuagggucucaacuaagugacuaagguguucaucaagauaucucuccuccgagccuggaccacaccuucucagaacugcacaaccucugaaaucucuguuuaguuaacagcuauuuucuccuagaaauucuaacccuguguacgcacauccuaugaagcaaguaaggaccaaagggcaauuucauguguauuuuuauagcuuuuuuccuuucacuuucucaguucuaauaaccuauccccaaaacccuggcaccauagcaaccccaaacauuaauuuuaguuuucuuauccuagcaggacuaccacugucugcuugggcuuuguuucuccacaguaugguuuggcaggugcccccaaggagaaagccagcgugagacuugauucaucugcccuuuucucccaaagaucauagcccuguguugguugguaucuguugcuuguaaauguuacauacauguuuuauuuggucuauauuugguccgguuuuuauagaugcuuguaacaggagaauauugcaauaccagcuacucuauaugaucagaaccccaaauccucauuauuuuaaaauaugaaaacguaucucauuauauaaucagugaauuuugauuugaaacauuuaacauguuacuugcuguauuuucugauucauuguuuacuugacccagauaguugagccaaauaggacuuagaucucaguuaauaauaguaaauauauucaucuuauaaaaucgaaauggcccuugcuuuccaaagauggaacccuaaacagcugggcuaauggauuugauauuuuagaagauuucaucugcaacauuugagaugcaccuucacacaaguugaucugggcauagccguugucagagaagcuucuguccuuggcugauaaauuauuaaugcuuaauuauuuaacuuuuuuguuuguuuacauaucuagcaucuuaaaaauauuucauaaauauuuuagccuaugcccuuuuuuucucuacuguauucacaguguguaaggaauacuuggcuguuguuuuuuuuguuuuguuuagagacagugucuugcucuaucuuccaggauggaaugugguaguaccaccauaguuuagugcaggcuugaacuccugggcucaagggaauccucccaccucaacuucccaaguagcugagacuacgggcaugcgccaccaugaccaccuaauuuaaaaaauucuuuagagacgaagucucacuauguuguucaggcuggucucuaacuccuggucucaagugauccucccaccucgaccucccacacugcuggaauuauaggcaugagccgcggugccuggccuauuuggcucuuaaaugugcugccuuuugacuuauuucauauucuugaagggaauaaucauuuaaauauuuuugccaucauagugcuuuguaugucucuccugaagcucauuuaauagcauguccaucugugauagaugugaucuguucuuugggaaaggauguaugacauagcucuguuuucuuccuaguacuugcauaaagaaacuuucaguauucauuggaauggaguuggugagcauagaaagaguuauaguuaucacauaaggaagcuacaugacucacucucugcugccucacugcuuccccuggguaauugucuguccugauucccauguggauucaagaaucccccaaggaagcccuggugggaagaccuggaaggucuggcucuuugcccagaugcugguguugguguugauguugauggaugugcucugcugaucauaauacucuagagaagaaauugcaucuuaucuuugaacccaccauucauaauguuuauuccuaacucaaauuggauaguucaguaucuguauaucaggaauuugguuucauauuaaagguaauauccauuuauuugagucuuugcccuuauuauuuaacauucuuuucaauaauuagacuuaauaauuaugcuuccaaauguuuaaaauaaagcuggacuugcacauauauauauguauacuuuacauauauauauacacagcuuuacauacacacauguguguguauguaaagcuggacuugcauguguauauguauacacguauacauguaugcacacauagcaagauuuacuuuugaaaauauuuauccugaaacuccuuuauccucuugguaauucaguauaguagcucuuccucuuaaauauuauuccuagugacauuuuaugacucuguuuuuccauuuaccuuuugaauucuauccauaauuuuuuuuuuuuuuuuuuuugagacaaaguaucacucugucaccaggcuggagcaguggcgugaucucgguucacugcaaccuccgccucccagguucaagugauucuucugccucagccucccaaguagcugggacuacaggcgccugccaccaugcccagcuaauuuuuauauuuuuaguagagaugagguuucaccauguuggccaggaugguuucaaucucuugaccucgugaucugcccagcugggccucccagagugcugagauuacaggugugagccaccgccucuggccucuauaauuuuuaguguaucaguuugguuuccaccaagaaaagugacagcuguacuaugugaggaauuaguaauaguauuaugacacuuuuuuuuuugaaugugcagacauuuccuuuugaugauucauuugauuuguuuaugauaaacuucagagcauguaguuuuggcuuucuuuugcaauuauuuaauuuuuucauguaaaaucuggauguugauaggcacuugauacauuaaauagguacuuaauuuuagcacuagguuaauuuacaacuuuggauucacuguauuuuuugacaucacuuacuuugaaucacugugagaugacuuucauuuuucuucaucaagaauaucuugugugggaugugugcuaguucuuuauauccuucguuuuugaaaaugucuuaaguuuuacccuagacuuaauugauaguuuggguagagaauuuuagauuggaaauaauuucucagaguuuugaaaauauugccuucuauuaauauugcugaugaggagucugauacuauuucaauuccugauuguuuauguaugacguauuguuuguagacauuuaaaacguguuuuccuuuucacuuuuuuuuuugcuuaaauuucauguagauugugcaugaaauccaccagcuugcaauaugacacucuuuugcuuuccacuaugcuugaugucccuagauuugaagccacuucaguuuaucuuagaauaauucaggggagguaugggauugagaacugagggacacaacuguucccuacauggaucuucaaccuuccuuucccauuuuuagccucaugccuuaucuugcuguuucucacacuuauccuccaauguuugagccuuucuguauauuugauuugcuuccuguugauaucuuucucugcagguauuugguguuuagcucugcugucucuuccacaugcuuucuaucuuccaaaguguauuaguauccccucccccccccuuuuuuuuuuuugagauggauucucauucuguugcccaggcuggagugcaguggcgugaucucagcucacugcaaccuccaccuugcggguucaagugauucuccugccucagccucccaaguagcugggacuacaggcaugugccaccaugcccagcugauuuuuauauuuuuaguagagacgggguuucacuauguuggucagguuggucucgaucuccucaccucgugauccaccugccucggccucccaaagugcugggauuucaggcgugagccaccgcacccggccuguguguuaguaucucuuuagccgauaucuucucuccuuuuguuguucuugugguuuuuauguuuuuaguacauuccuucuuuuuuuuucccccucaaauuagugggcuuucaggaaugaguaaagguaaacacauuuucaguccaucacauuuaacuguagguuuaagcauuuuugaacaguaaguuauuaauucuuuuuccuuuagaagacuaacaacaguggauggugguuugccaugacauuugaagucacauucuuguauuuuaauuaaaaucaaguuuuuauuuuugaaguuugccucuccccccauuucuauuuuacauguguuuuggggacuauaacaagagucaccuuaaccaguuuguaaucaagcaccuaaauauugcaaucuuaucucaaccuuuauucuuuuacuguaacugcuuccucagugauuauuaucuaguuaagaaauucaucaguuuaucaaggcucauuuuguuugaccucuaggagcuuuaaaaacugguacugcuccuuauuucaaggaaagcucucuucucugugaucacauucuggauauacuucaucuguuucuuuuuuuuuuuuuuuuggagacgcagucucgcucugucgcccaggcuagagugcaguggcucgaucuccgcucacugcaagcuccgccucccggauucacgccauucuccugucucagccucccgaguagcugggacuccaggugcccgccaccacgcccggcuaauuuuuguauuuuuagcagagaugggguuucaccauauuagccaggauggucuccaucuccugaccucgugauccacccgccucggccuccuaaagugcugggauuacaggcgugagccaccgugcccagcccaucuguuucuuacauaucaguauuccuugaggauuuacuauugucuuuuguaucuuuucacuuucaauuauuucgugguugcugaagauugugguaucuguuaucucuaguuuggauaucuuuccacaacucaaauucuguguuugcugaagauuucaguggugguuuuaaaaucuucgaaauauuucuuacugagagagagaggcuguauucccuuuacuugaaccuuggugagccuuuaugagugccguuuucuuccaauagaaucuguugaaagagauguugcaugacuucccucgcuagcuuagaaaagacccuucagcuucugcuauuguuuuaugguaaacucacucucgaagaacuuuuagcugcucuguaagaagucuggcuccccugaggccaccauguggagacucuguggaaagacaacaugcuauaacuauaucuuuuugauauguugucuuuucauauucauuuaguucagaauauuuuccaaauucccgcuagacuuccuguuucccccaggcauuauuuauauguaugucguuuaguuuucaaauaguugaggauuuuccauauaucuuucgcuuaaugauuucuauuucaauucuguuauggcuagagaacauacuuuguaugauuucaguucuuuuaaauuugauaagguuuguuuuaagggccagaauaugacauaucuuggugaauaauccaugugcacuuaaaaaggaugucuguucuacucuuuuugggggggaggcagggcgguggaaagggcuagaaauaucaguuagguuaaguugguuaguaguauuuuuguuuuuauauuuuaaaaaaauugagacauucuguguugcucagguuggucuccaacuccugggcuuaaacagcccucccaccucaggcucccagguagcagggauuacaggcacacgguaguguuuuuauaucuuugcugcuuuucuuuuaacuuuguucuaucaauuaucgagagaguagcauugaagucuucaaguauaauugugcauuuaucuauuucuuucaguuauauaauuuuuaucuuuuguauuuuggagcccuguuguuagauacccauuugggacugugauuuucuuuuuggugacaugacuccuuuauuauuauguaaggaguugaauauaaacauuuuuuucuuugagauagagucucgcuaugucugccaggcuggagugcaguggugugaucucggcucacugcagccucugccucccagguucaagcacuucuccugccucagccuccugaguagcugggauuacaggcacgugccaccacgcccagcuaauuuuugcauuuuuaguagagacaggguuucaccauguuggccaggcuggucucaauuuccugaccucaagugguccgccugccuuggccucccaaagugcugggauuacagguaugagcuacugugccuggccaaauauaaacauuuuuaagccauauuaaaagaaagcaaguuuuuauuugguaguuguauagggucuuuccuacguauauacuuauuucuauaaacugaauaacuucucccagcuuuucaacuuguggaaauuaucuuguuuuucaauguguuguccaucuaucaacuugcuuaacugagauaugcuuuaguuuuaauaguuuugaauaauauuuagaguauguuucuguagaaacagcuuuuuuuuauauauccagauuaauauuaccguaauuuuacugggauauggccuuccguuuagucauagguauuaauaucuaugaaguaauaguaauguguguuuauuauguccacagaguuuucacuuuucacacuuguuucauucuugucaguaacaaugugguggggcaguuaccucuuuuuuacagauagaggaaucaaauccagggauuuugcggcuugcccacagccacgugcuaagcaguagagcccaggcuagaacccaagccuuuuuuuuuuuuuuuuuugagagggagucuugcucuguagcccaggcuggagugcacuggugugaucucugcucacuacaaccuucaccucccagguucaggcaauucuccugccucagccucccgaguagcuaggauuacagaugccugccaccacgccuggcuaauuuuuguauuuuuaguagagacaggguuucaccauguugggcagguuggucucgaacuccugaccucaagagauccacccaccuuggccucccagagugcuaggauuacaggugugagccaccacgcucugccaauccaagcccuuugacccuucaaacugguguuuuuauuucccacaacaucugcuaucaauuggauggucuucuguuucaucucuauaugucauugugaaaagugacacaaauuuaaaaauuaaaaguuauggccaugaaagacuaaauagucugugaugcuguuuuucuuaucuuuuguugaacauaagaauauaauaguaaguuacuaaggaagguuuauuagaaguucagauuggugcuuuuccaccucaauuuuauaggucuguguugggacccagguguguauauauuaaaugaguacacaagauaguucugaugcacauauucucuggccuuacagagaaacacaguugggagagauggagacugccuuggccucauuaacauucuauaauuagccauauauuuauagaacacauuuuccuauuuguucauugcauauaccaagugagacagaaucaaaauccauguuaaaaccuagcugcacuauacuuauuuuucuccucacucauggaguaggauuuucuguuuaguguuuuucuaaagcugaaugagaaaauaaucuguacaaggauaguguuuagcaagagcuuuugagcccuuaccggaaacuauaaacucuaaaggaacuguaaacucuaaagcaaugauuccuaaauggggcagacuuugcaucuccccaacccaaucuccaagggacauuuggcaacgucuguagacauuuuuuguugucacaguuggauggugggugcuacuggccucuaguggcuagaagccaaggaugcugcuaaacuuccuuacaauacacaguacaaucccuccccuaucccccacaauagagaaugauccuaauacaaaauauugacagugucaaaguuggaaaacugugcucuaagguuaauauucaauaacauauuuuugaugaguaaauuuuuaaaauaaucuuaggugagugugguugcucacgcuuguaaucccagugcuuugggaggccgagacagaaggauugcuugaggcuaggaguucaagacuaguuagggcaacauagcaagaccccuucucuacaaaaauaaaaaauaaaauuagucaggcaugguggcaugcaccuguaguccuaacugcuugggaggcugaagcagaaggauugcuugggccaggaguucgagguuacagugaacugugauugugucccuguacuccaaccuggacaacagagugagacccuaucucuaaaaauaaaauaguuuuuuagcugcaguuuugaucuaacuaggcguuucuucuucagaaaguugagucaagugauuuuguuuugucuguagccguaccccuauacauacacauuugcuuccuaaguugauagugugcguugugagaauacuugaagguugcuugaagauacuaaucacacaauggauaaauagguauaacugcaucaacaaaccgauucacaaaucuuuuaucacccuguuggggggaaaucuauuugaguuuaaccuuuaaaggaaggcaaagagggaaaguagaauguuucaaaguacuaacuuugaaguagggagcauuuaaaauauaaaguaaaauuugcaaguuuugugugcaucagcauuacaugagagucuccacugagcuguuuguuuacuugcuaauuuuccuuggucaaacaaaaacuucuucccauucugaaugaaugugaacuaguauuuuauugaggauuuuggcagugcaagugggccagaaauaacuuuuuauuacaaguauagcauauauacaauaaagaacaaaucuuaaauguaagacaagaauuuauaaggugaaaucuccugugaaacuaucacuggaucgagauaauagaauauuaccaguacuucagaugcguccguugugcuuccuuacuguuacuauuugucucuugccuaaaguagucaccauucugaggucugucauuauagucuaguuuuguuuuuguuuuugaauguuauugaguuaaacuauaugagauuguguuuuuauagguuguaauuauaagcaauuucauauauguaguucaaucuaaguauuuuuuccccauugcuguauaauacuucauuuaugguagcuagugucaauagauggcccccuacacguacacuugauacucacaccguuguaaagucccucaccccuugaaucuuggcuggcuucuaagugacucacuuuuaacccugacaguaaaguuacccuuuguggcucccagucauaagaagccuugcagcuuccaauugggucuccuuagaacacacacucuuggggacaguccauuuuagacuucagcugucaugcugugagauguucucaccauauggagaagccauaugucagugcucuggucauuagcuccagcugaccucccagccaacagucagcaucaguugccagccauaugagcaaggcaucuuguacgucagauucaaucaaacuucugaugacuuuacuaucugcugucuaacuguagccacaagugagaaccgccaugugggcccagucaacccacagaaccaugaguaauacuaauauuuguuugguuuauguuuguguauuugucuuagcauugugguguauuugcugcauagcaacguaaaaugcaucauugcaugaauauaccaaaauuuauucaguuuacuguugguggacccuugauuuguacacuuuggggcuacuaugaauacuguagcucuaaacagucuuacaauacauauauuggugaauauauucauauacuucuguugggcaauuaucuaagaguggaaaugcugggucagcuucaggagacacugugaaacaguuuuccaaaguggcuauaaguauguaugcuccagcaguuuaugagacugcauuugucccacaucuucaaaaauaccuuauauuuuaaaauuuuagccauucuguugcuuauguuguagaauuucauugugguuuuaccuucuguuagugaauuuucccaacaucuuuucacuugcuuuucccaacaucuuuucacuuucuuuuuuacauaaguagaaggcucuacaauaaaaaguauaggauaguaaaugcuaggugauaggaauuuuuuaucuccauuauaaucuuuugggaccaccauaguauaugcaguuuaucauugacugaaaagcaguuaaugaggcacaugacuguacugaaagcuuuccccugaaacuggaaacaagguaagaauguccacuauccaccacccuuuauucauuguguuuuuuggguuuuucuucccauauauuuguugaccauuuagguuuccaauucuuaucucacucuuucugugguuugucagugauuuuuguuucucaugcugaaaucuccuacuaugagggauuuguccauuucuucuuuuaggacugucagcuuuuuacuuuguguguuuuuuuugaacgguuuaauugagaugugauucacauuaaaguggaugauucaccuuuuaaaaguguaugguucaauguuuuuauguaucacagaauuaauuuuuaaaaauuguuguaaaauacauauaacgaaauuuaccacuuuagccauuuuuauauauacaauucagugguaucaauuaaguucacaauguuguauaaccuuucaugucuacuuccaacuuuuuauuuugccaaacagaaacucuagccauguggcaguuguucccaugauucucuccccucagcuccuguuaaccucgaaucuuuguuucucuaugaauuuaccuagucuagauauugguuauaaguagaaucauacaauauaugucuuauuguguuuggcuuauuucacuuagcuuaauguuuucaaggaagcauguagcauguaucagaacuuucacuuuuuuuucauuccagaauaauguuuuauuguauggguauaccacauuuuguuuacucauucaucugcugacaggcacuuggguuguuucuaccuuuuacuuaugugauuaauguugcaaacauuggcauacaaguaucuguucaagucuuuguuuucaauucuuuggagucuauaccuaggaggagcauuucuggaucacgugauaauucaguguuuaaccuuuaagaaacugccaagcuguuuuacauggugucugcaccauuuuaaauucccaccagcaauguaccagggugccuauuuauacauaucauuaccaacacuguuauuuuccagguuuuuuuuuuaauagcuaucuuaguaggugucaagugguuacauuguaaccauuguagguuacacuauuuuugagacugcagucauuuacugcauaauaauguuucaugggccauagucacaaagguguguauuccuauauuuuccuccaagacuuuuguaguucuagcuauuaauuuuagguccaaacuucauuuggaguuaauuuucuauaugguaugagguagggguccaauuuauucuuuuguauguggauaucuuuuugucucagcaccauuuguugaaaugauaauugauaugguuugaaucuguguacccacccaaaucucaugucagauuguaauccccaguguuggagguggggccuggugggaggugauuggaucauaagggugguuucucaugaauggcuuagcaccauuucucuugguauuguccucgcaauagugaguucucaugauaccugguguaacaccucugcccucucucucucucuauuuuuugagacgagucucugucacccaggcuggagugcaguggcgcggucuuggcucagugcagccucagccuuccagguucaagcaguucuccugccucagccuccagaguagcugagauuauaggcgcccgucaccacgccccgcuaauuuuuuauuuuuaguagagacgggguuucaccauguuggccaagcuggucucgagcuccugaccucaagugagccaccugcguuggccucccaaagugcuacaggcaugagccaccgugccuggcucacccucucucuccugcaccugcuucugccacaugagacaccuugcucucucuuugccuuccacuaugauuguaaguuuccugaggccuccccagaagccaagcagaugccagcaucaugcuuccuguacagccuguggaacugugagccaauuaaacuucuuuucuuuauagauuacccagucuuggguauuucuuuguagcaauaugagaacagacuaauacaauaauucagcaguacccaaacuuuuuggcaccagggacugguuucaaggaagacaauuuuuccauggaugggggguggcaguagggcgugguuuggggaugaaacaguucuaccugagaucuggcauuagauucuaauaaggaguuugcaaccuagaucccuuucaugcacaguucacaauaggguucauguuccuaugagaaucuaaugcuaucacugauuugaggaggugcagcuuagacaguaaugcuugcuagcucaauacucucccgcccaucgcucaccuccugcuuuguggccugguuccuagcaggccauggacugauacugguuauggcuuagggguuggggacaccuacaauaauucauuuucacuugaguggucuugguauucuuguuacaaaucaacaauaaauggaauaguuuauuuuuggacucucuauuauuuuuuguuccaaugucuacccuuauagaagcaccacguugucuuauagguucguagaaacuuuugaaaucaggaagugugaguucuccaacauucuuuuuaaauauuauuuuggugcauacacauuuaggauugcuaugucuuauugguggauuggcccuuuggucauuguauaauaauucuuugucccuguuaaacucuuuagcucugaaaucuauuuuauuugauauuauaggcacaucuuucuuuugauuaauguuugcauggugaaucauuuucaucauuuaccuucaaucuaccuauaucauuauauuuugaguuucuuugagacaacauauaucugggucauguuuuuuauauauacucugccaauauuugaguccugguugaaauuugaauuccuacagagaggacuuuuauuuacuucugcaaguaaccuguuggcaucaucauacuagaaccacuugaaguuucuuuuuucacuuggguuuucugacuacgucauaguaaguucucaacagacagacaauuuugauuuuauuuuuuaaguuauuguuuuguuuuucuuugccauucuaugugguaugauuuuuguuguuguuuacuuuuauucugugagaauagcucauagaaagcuugugggucucuuauuguauauccauccugaauagaccuuaauaucacuuuugauucccauguauauucugugaucaaaaucggagguagaaaacuuaaggacuagaaacugaccuuaacaggucuuacuagguaggcucccugguuucacuuugcuuuggaucuuuguuucuacuuuuuuuccaugcuagcucaguaacagacuaaaacaaaaaguuucgaaaauaauuuaucuggcaauuuuauuguauuugagaggaguuuuccauaauacguuaucuccuguacugucugucaaaaagaggagucauuuuuuuuuggugucuuuauuugcacagaaaguuuucauuuuaauauagucagauuuauuuacuuguuuucuuuauuguucauacugugggaucuuuuucugagaaaguuucuccuauuuugaaaauauaaggauauucucacauaauuucuucuagaaauuuuauaauugugcuuuaaauuuauauugaauuuuucuguaugaugugaaauaagaaucaacuuuuuuucuuacugauuuuucaauuugauuuccccccuauuuuuaaggagauacuuguauaucuuuuucuccuuauucuguuaauauuaguaauuacauguacugcauuugcaauacugaauuuuccaugaaauucuuguaccuuuuuuuuuacugugaugcaaaaucaguuugcuaauauuuuauuugagguuuuugcaucucuauuccugcaugugauuugccuuuauacauucuuuuacgcacauucccucuugaauuagaaucauaagacuaacuggguaacagucccugccuucucauucuuuggaauaguuuaaguaaacuggagauuauuugcucuuugaagguuguuagaacuucacagguuugauaaaagcuuucaaugucagaugauuuuuaugugugagauuuuuaaccacuuguuuuucuuuaaugguuauaggucuaagugcucuaucauucuguucccuuuuuuauucugaucuguuuguuuaauuugcuucuuucacuuccuucauuguucuucucuagucuugucagaaguuuguuguuaaucuuuuuaauccaucuuuaaguaauuuugugguauggugcaguuuggauuuugauuguuuuauucuuuccauguggcuaucuaguuggcuuauuguuaucucauugaaaaagaccuuccuuucucgugcucuucaguacuacuuuguuguaaauaacauuuguguaggucaguuuucugggcccuuuuuccuauucuaauggucucuugguguaucugcaugccaauccauauugucuuaauuauuuuagcuuaauaaauaaguuuuuauauuggauagagcaaauccuuuuguaucuuuaauacuuuuaaucauuuaaguuuguaaucucuauaguucuaauuauuugaaguuuuaaagggauauaauugaguccugcuaacucuuguuaauaaauugauuacucuugugucuuauaauuuuguauugugaccuggucaucagguaaguguuaacucugugaaucaccuucagucggaguuacggaugcguuccugaagauguuuuauuuucaccucggacuaauuuuuuuuuuuaaucacaguguuucaccuuugggguucuguaaacaguauauaauguaaaaucaaacuucacacccacgugagacuuuuccuucuucauuccagaucccauuuggaggcagaaaaacuuaacuuguucucaucuugggcuuaugggaggauuuuucccccuccuagucuaccuuucauucagaaauguugcuauccagacucugggcuuucacugggaaagacuuaguucuguaucucaccuuauuuaggcccaaggccugcacauuuuuccaccuguuugugauaaacccgaauugcucgguuauuuuuccccucucuuuuuuccagugcccaccuguuuucugauugauauauaauacuuguacauauuuauggguacauaugauacagggugcauguuacaugcauagaauguguaaugauuaagucaauguuuagaguauccaucaccuugaguauuuaucauuucuaugugcugggaacauuucaaauucucuuuucuagguauuuugaaauauauaauacuuguuuuuaacuauagucacccuacucuacugaggaacauuaguauuucuuccaucagacaaccucucaucaccucuccccaaaauucacacaccuuucccauggcuuacuuuuuaagaaaccuguccaugacaacccuagcacaguuacacccaacuucuauuuuuccuuucugcacacuggagauuucuuuucagcuuagcuauguaauuaaaaggguauuuguuaauauuauccagcauguuuuaaguauuuuguugcugagauuucuagauuaucuagucugccauauugcuggaaaaggaaguugguauuuuaaaauaagcuauacaaagcaauuguauauuguuggcugaaagaauuucccccuucaggugggaguacuaaauauaauacccuuccauuguugacacaguuaaaaacugugucuuugaagcaaaguauugcauaguggcucuaagcauggacucuggagcuugauaaucugggguagaguauaaguccugccacucaugaccugaaugaucuuuacaagucuguguaaucucccugugccucaguuuuucaucuuuagagucuuaauaguaacuaucucauaggguuguuuucaugauuaaaugagucaguccauauacacugaacaacagugucuggcaauaguaagcagugaauaaguuuagcuauuacuauuguuguuauuaacuucauuagauauaacucuuacuuagagcucuuauccuguaugugaaaaauuuuccacugacuuacauauagacagcauuuuucauuuucaacgauagcguccauacuuuguauuuggaguacuguauuguuugguuucccuucuuccugcuuuauaaaggagcucagggcagaaaauggagucuauugucacuuccuuaagccacuacuaaauuuuaaguuauccaucaguaaguaaucuuuuucuuaucaaaaucaguauguuuauguuaucucuuuuuuugagacagagucucacucugucgcucaggcuggagugcaguggcacaaucucagcucacugcaaccuucguccccuggguucaagcaauucuccugccucagccuccucaguagcugggauuagaggcgucugccaccgcgcccagcuaauuuuuguauuuuuacuagagaugggguuuuaccaucuuggccaggguggucuugaacuccugaccucgugacccacccgccucggucccgaagugcugggauuacaggugugagccaccgugccuggccauuuauguuaucuccugaaguuucugccuucucuuauuaaucacucccucaaaugaagauguauuccuaugauggauucuucauucagugaggugaucagucuauauucucuauaaggaucugaaggauuucagucacuguuaagucuguaugccuuuggacuaaacauuauggaacgaacugguucuuacagacuuucuuucuuacugaccugcccaaccuauuaaauaauuauguuuuuucuuauauggaaaauagucccucuguccaucuucaggagagcaucuuuagaaauguggaaggaaccggccgggcaugguggcucacaccuguaaucccagcacuuugggaggccaaggcggguggaucacgaggucaagagaucgaaaccauccuggcuaacacagugaaacccugucucuacuaaaaauacaaaaaauuagccaggcgugguggcggguaccuguaaucccagcuacuugggaggcugaggcaggagaauggugugaauccgggaggcggagguugcagugagccgagaucacgccacugcacuccagccugggugacagagugagucuccgucucaaaaaaaaaaaaaagaaagaaauaugaaaggaaccucagagaucacuauacuaguuguuuuuagacacuuaaaaauaagugucuuuccagugaagauacgcauacaugcauacaccacuacacacauggagacuucauauguguaugacgaaucaaguucauuauuauaguuaaagcuaggagcccagauuuggccuucuuagacuuuucuuccucaguaacucagccugagacacucaaggagccuuagacauuacacaguagaacucuggaacugcugaucaggucuuucuuguaguuuaggguugaugaaacuggccuguguagcaagaaaaauucacccaagacuacuaacuagccaaauaagaacucagccuuagugauggcaguggcagccugucuggagcggccgcugcaaagacaccaacugcagugggggacgcgcagcuggggcugugcacuccacggagccugcgggagcugggaacaggugggagcccugcccccuuuccaaguuggcagagugggaaaccugcccuucugggggcaacugcagcugcccagccacggcugcagaccugggcaucccugugcucucgcgggguccaggaagccccucagccccugcaggcuuggaaguaccugcucccacugccuggccucuccucgcucccagcgccugcuccaauuuccaaaguugaggccaagcccaggugcuguggcgaccuagcugggugugugugugcgcaggguggugauaacacaccagccuccuucugccucggcccccucuggacuuugggcgcugaugagcacaggagggaggccuguagggggcugaggauggcucgucacgggccuccaggcaacccucagcuccagcagccugggcaccguggacgaaaugauugauggcggcaggaagcugacaggcuucugggcguaaaggggaagguucccggugaagccccaccuucaagccagggaugaccagaagcaugggggcugggcugucaguuccaaguugaguccacagccuggagggggauaacuuaaagugcuuuuucugggcccacgcauggccacccauggaccgguuagcaugcacuuccucccuucugaagucccuaaaaacagcccgauucacacagauguugggauuuaccagcugugggaaggagcuacccacuuuggguuaggucuccucgacucuucgaggcaaucugucugugggaaggggcuacccaucagaagucuccucuccacugagggcuggacacuugucgggucgaccugccuguggaaaggagccacccaccauaggucuccucuccaccgagagcuggacacuugucuggacgaccugccuguggaaaggagccauccacugugggucuccugagagcuaugcugucgcuccgugaacuccucucugccuugcucaccuccaguuguugacauaccucauucuuccuggagggaggacaagaacucuggaccugcugaauggcaguacugagaacuguaacacaaacacggcuaaaacacgcccccugcucgccauguugugggcaacgagaaggagagaagagcugcagcccuucggggaacccauaccuaggguacccuuuuaauuacguagcuaagcugaaaagaaacccagaccugugacacccucuuugggguucuuguguuccuggcaucuccaagcuuccaggcaccaccguguuccccucaucuagauucaggugcccgcaucggaagucucguguguuacaucugguccagccacagccuugcauggagcuggcaccuaugccagugccuggggcugccugcccuggcugugugcaguggcuggacccugugcucacucgcccacacaccccucgcugcuccgcgccugacucgcccuuggcagguguggaauccaggccgguagcgcgagccaagcuuccuuccaguaggaaauaugaugggaaaacaggaaggccguuuaauucagauuaauagaagaaguagguuucaauggagacuucaaagggaaaaugugaacacuuuuuuuuaaaauacuuuuuuuuccuuuuuauaucaucuuguauuuuucuucaguggaugauuucugguuuuauuguuuguuugcuuuuuuauuuccaacuuuuauuguaaguucagggguacaugugcaggauguacuccugcacauguaccagguguagccugccaggucaagugggcggaacaagcccagcggguaugagcaauacucaggcagaaggugccgccagccaccgagguuucuggcugccgaagugacaccccaugaauucugugacauuaauauuuacuguuuccauuuuggcuuggaaacauacuaccuuccaaaguauuuuccccugcugcaggucugcagagcugcugcuuugucuuuccugcaaacuugucuuaacauaucucuccuuguacuuggucugccaacaggaagcuccuuuugccuggcaguuguuauugacuuaaaauucuagugauaaagcuaaauaagaucugucgggaccagucucuucaucuuuagagaaacaauaaccaguaaauuaguuucucuguagauguauuaucccuugagcuuuagagauucuuucaaguaccuuguucucuagcugguccucuugugaaauaagaaagacugaagaaucugcaacacuggcaaaggaacuaaaagcacauaaacuuuaaaauugcuucuauuugcuguuuuaucauucacucauucaguuauucaacuaaccaaauauguauugauuguuuuauuuaacagccuacuggggauuuugguauauguuagaauucuggccacaguuuaccaauuacauuuaucucucuuucuuacaguuaaguguugccuuuugccugugaguuuucuuauguacuuauucucucugccugaaauacccgccuccaaaccuggugaacuuuuauucauccuucaauuguaacuuaaaacuccccuauuucaggaggguuuuucuagcacucuugagugaauuaaggguuuuuuccccuauggcuuucuuaucauaauuaaauuaauuauuuuaauuaguuuucauucccacacccucaccucaaguccccuucuccaauaugauacccauggcaauacuaauuuuaggagaauuugcuaucauaagguuuuuucagucuuguauuuuuugguccuagcaauguuucugacacauaguagaugcucaauauauauuuauugcauuucuuauacucgcagaagauuuauagugcuaauaaugcauguauaguauuugucuuccaagacauuguuuccagaaucuucugaagugagugaugagaggacaaaacuuucaaacacauaaauaugauuacuaaauguugccuuuguccaagaaauacuuaaaaaucauuuaguucacuuguuaaguauaucagaaguagcaacaauuuuaaaaauacuuuuuuugguuaguuuacauuuuaaaaauugcaauaaaaauaaaacugcaagcaggcaaccaaacacugauauaagacuguagaccaaaguguucaaguauuucuuauaauuagagguuccuuauuaugaauaguauuugaagauacuucagugcuuagguaaauaucaacaaaugugaaauuauuguacaaaauacauuacaggacauauacauuuugcuauauguugcaaauauauauauuugcuaagccaucuaguuaauugacuguauuuaaaauuuugucaucaguaugcagcuugcuuagagaguaaguuguauugaauuugagaaauuaugccuuagauuugugacuuauugacaggcuuccuuccaguggaaaguaugaggggaaaacaggaaggccauuuaauucagacuaauagaagaaguagguuucaauggagacuucaaagagaaaaugugaacacuuuuuuauuuaaauacuuuuuuuuccuuuuuaaaucuucuugcauuuuucuucagcaggugauuucugguuuuauaguuugcuugcuuuuuauuuccaacuuuuguuuuaaguucagcgauacacgugcagguuuguuacacagguaaauaugugccauggugguuugcugcacagaucaucccaucaccuagguauuaagccuggcauccauuagguauucuugauacucuccuuccucccaccucccacccucucacaggucucacagguguuguucccuuccuugugucccuguguucucaucauucagcucccacuuacaagugagaacauacgguauuugguuuucuguucuuguguuaguuugcugaggauaauggcuuccagcuccauucauguccuugcaaaggacugcauaguauuccauggugcguauguaccacauuuuccuaauccagucuaucauuaaugggcauuuagguugauuccaugucuuugcuauugugaauaguacugugaugaacauaggcauccauguaucucuacaauagaaugauuuauauuccuuuggguauguacccaguaaugggauugcugggucaaaugguauuucugccucuaggucuuugaggcauugccacacugucuuccacagugguugaacuaauuuacacucccaccaacaguguaaauaaaacauuccuuuuucuccacaaccucaccagcaucuguuguuuuuugacuuuuuaauagccauucugacuggugugagaugguaucucauugugguuuugauuugcauuuuucuaaugaucagugauguuaagcuuuuugguuggccgcauguaugucuucuuuugagaaguaucuguucauuuccuuugcccacuucuuaauggaguuguuuuuuucuuguugauuuguuuaaguucuuuguagcugcuggauauuagaccuuugucagauggauagauugcagaaauauucucccauucuguagguuguuuacucugauaggcuuuuuucuuuuuuucuuuuuucuuuuagcugugcagagcucuuuaguuuaauuaaaucccauuugucaauuuuugcuuuuguugcgauugcuuuuggauauuuucuuauauuuuaaccgcccaccagaucauaauuuuaaaaauuauuuugaaaaauauuuuuucucauuaauaaaacccuagaggguuugaaaguguaaaauacaaaguuaaaaacccuugugcuuacacauuacuguaauaaacuuguguauucccacauuuucucugcauaugcaagcauacauacacauacauguaugugucuauguguguguauguguuuauauguauacauuauauauucuuagaguuggagucauggaauacuuccugcuuucuguuaccugcuacuuuuccucuuucuguaugcuuuuuacauacaaagaaucuuuuugguucuuuuuaaugauugcagauauuccauugaaugcauguguuuuucuguuacaaugaagcagagauguauuuaugcauauauaucuauuucuccagcuguaguacuaauaguauaguugcuagcucaaaaggauuuacauuuuuaauuaucuuagucacacacucccaucuaaaaggcuuguguagauuuacacaauuuauguucucucuaccaguuuaugaauguaucuguuucuucucccuucccaugcucauuacucagcagccuucuaaaguaaauaaucaugggcuuuuacugcguaaucagauuagcacaguaaaugguggaaaaauaacauuauugauugaaaaguugguuaagaagacauaagcuugcuguuguuucuuucauaguuuugguguuaaaauuugcugguguuugagguaacuaauuuuaacuagauucagggugacacuaucuguaagaaaagauccugggaacuugagaagaaugaauccauauucauaccagguuaguucauggaaauaucugcucucaacauuuaagcaaacuaagaaugaauaauuuguuacaguuuacaacauaugauuucauuuauuccucacguagauuuuaaucuguuaugcagaggaguagagugaaacucagaaagauaaggaaggcucccucaggucacaguuuauaaaugguggaacuuuuguuuuguuuuguuuuugaugaauuauauugcauuucuaaucuaaggaagcacgugugcaucagguccuaguauaaggucuacuaaauaacagaggcucaauaaaagucuucaaauuaaugaauucucuuuugagaggaaauauuuugaagucuuuaaaggcauuaguaggguucaagacuaagaaagagaccacauggccuuauuacuuugauuuuuacuagggaaaguuguaagcauauaaaaguagaaagaauuguaaaaaugaacuucuguauauccagcuuuauaacaguuauuaacucauggccaaccguuuucaugguggaaauccacucaacacaagaugacaacucaaaaaaagcuauagaaaacagaaaaauucagguggacucaugauauaauaaaauaguuauugaaugccuacuauugauagacguguagaguaggguuuugguuguuuuguuucguuuuuuucuuuuucuuuugaaguaauuguagguucacaggauguuacaaauauaguacagagaggucucauuuacuguuuacucagcuucucccagcggcccaaugguaacaucuucucuaacugugguacaauauuaaagucccauuaguugacauugguaccaucuacagaucuuuuauagcuaucaccaguuuuuacaugcugucauuuguguguguguguguguauuugcauggauguguuacuuuuuacaugucuagauucauguaacaauuaucaaaauacagcauaaaguauuauauaugauguuagcugugagacuucauagauguucuuuaucacauugaggaaaguucucuauuacuaacuuguuaaaaguuaucacgaacgaauguugcauuuuuaaaaaugauucuugucugucuauugauaugaucaugugacuuuucauuagccuguuacuauaguggauuaccacaaacaaauaaauuuuaaacaaauaaacuaaauaugguggauuauauugagcuuuuuuagaauauucugccaagaauugguaugcauuuuucuuuuuuuuuuuuuuuuuuuugcaccgcccuuaauccauuuaauccugaguggacacagcacauguuucagagagcacaggguuggggguaaggucacagaucaacaggaucccaaggcagaggaauuuuucuuagugcagaacaaaaugaaaagucucccaugucuacuucuuucuacacagacacggcaaccauccgauuucucaaucuuuuccccaccuuucccgccuuucuauuccacaaagccgccauugucauccuggcccguucucaaugagcuguugggcacaccucccagacggggugguggccgggcagaggggcuccucacuucccaguaggggcggccgggcagaggcgccccucaccucccggacggggcggcuggccgggcaggggggcugaccccccccaccuucccucccggacggggcggcuggccgggcagaggggcuccucacuucccaguaggggcggccgggcagaggcgccccucaccucccggacgggguggcuggccgggcgggggggcugacuccccccaccuccuucccggacggggcggcuggccgggcggggggcugacacccccaccucccucccggacggggcggcuggccgggcagaggggcuccucacuucccaguaggggcggccgggcagaggcgccccucaccucccggacggggcggcuggccgggcggagggcuuacccccccaccucccucccggacggggcggcuggccgggcggggggccgacccccccaccucccucccggacggggcggcuggcccggcagaggggcuccucacuucccaguaggggcggccgggcagaggcgccccucaccucccagacggggcggcuggccgggcggagggcugacccccccaccucccucccggacggggcggcuggccgggcggggggccgacgccccccaccucccucccggacggggcggcuggccgggcagaggggcuccucacuucccaguaggggcgggcgggcagaggcgccccucaccucccagacggggcggcuggccgggcggagggcucacccccccaccucccucccggacggggcggcuggccggacggggcggcuggccgggcggggggcugaccccccccccccaccucccucccggacgggguggcugccgggcggagacacuccucacuucccagaugggguggcugcugggcggagaggcuccucacuucucagacggggcagcugccgggcggaggggcuccucacuucucagacggggugguugccgggcagagggucuccucacuucucagacggggcggccgggcagagacgcuccucaccucccagacggggucucggccgggcagaggcgcuccucacaucccagauggggcagcggggcagaggcgcuccccacaucucagaggaugggcggccgggcagagaugcuccucacuuccuagaugugauggcggcugggaagaggcgcuccucacuuccuagaugggauggcggccgggcggagacgcuccucacuuuccagacugggcagccaggcagaggggcuccucacaucccagacgaugggcggccaggcagagacacuccucacuucccagacgguguggcagccgggcagaggcugcaaucucggcacuuugggaggccaaggcagguggcugggagguguagguuguagugagccgagaucacgccacugcacuccagccugggcaccauugagcacugagugaacgagacuccaucugcaaucccggcaccucgggaggccgagguuggcggaucacucgcgguuaggggcuggagaccggcccggccaacacagcgaaaccccgucuccaccaaaaccagucaggcguggcggcgcgagccugcaaucacaggcacugggcaggcugaggcaggagaaucaggcagggagguugcagugagccgagauggcagcaguacaguccagcuucggcuccgcaugagagggagaccguggggagagggagagggggagggggagggggagggggagggagagggagagggagagggagagggagagggcauuuuucuuuaaauguaauuuuuuucuuuaaauucaccagggaaaccaucuggaucugauuuuuucuuuaugaaaaguuguuucuaauucagucucuuuacuuaugauagguauauuuaaaauuuuuauuucuucuugaguuaauacguguaguuugagucuuucuggcaauuuguccauuucaucuacauuaucuaucggcauacauuuguucauaauguuccuuaacaucucuuuuuuccccuuguaacuucaguauuaauguaccuucuuuuauuccugguuuuaauaacuuuuuacucuuuuuuuguucuuucucagucuaccuaaagguuuauuaguuuuucugaucuucucaaaaaacuaacuuucgguucuguugauuuucuuuauuguuuuuuaauucucuauuuuauacauuucugcacuaacuuuucuuucuuugugcuuuggguuuagauuuguauagugucuucagauaaaagauucuuuauaugagaucuuuucuuuuguuaugcagucauuuguagcuauaaauuuuucuccaguuuaccugcaucccaucaaaugugauauguuguuaucuucauuuucauuuauaucgaaguauuuucuaauuucucuugugauuucuucuuugaccccuugguuauuuaugagugugcuauuuaauaucgacauauuugugaauuuuccaaauuucuuucuguuacugauuucuaguuugauuccauuuguuguuggagaauauguuggguauuauuucaguuccuuuaaauuuacugagguuuauuucauggccuaccauaugguuuauuguggagaauauugcaugugcacuugagaagaaugcccauucugcuauuguuggauggaguguucugucugaccugucagucaggucucguuaguuuauggcauuguuccaagucuuuuauuuccuugcugaucucugccuuguuguuuaauauguuauugaaaguugaguaugggagucuccaaccauuauugaauugucuguuuuauagguacauauauuuuuauguuuguaucuucugauggaacgaccuuuagcguuauaaaauuucccucuuugacucuaguaacauuuuuauuuuaaaacuuugugugauauuaguauagcuguuccaccuuccuuacgguguaacuuuuuaaauccuuuacuuauuauauauuuguauuucugaaagaaaagugugucuuucuuuagcagcauauacuugcgucuuauuuuuuuuuuuuaccagucugacaucccugccuuuugauugauuuuuguuaugucaguuaauguuauuauugauaugguuggauuuauauuuguacuauuuuacuuuuugcuuuuuuuguuucucuuuuccuccuuuauugcuuucuuuuacauucagugcauauuuucuuguguaacauuucaauuccuuuaaugguuuuuucaguuuucuuuuuuuuaacuaguugcuuuaggacuuaaccagauacaucuuaacuuaucagaauacuucaggcuuauaauaacuuaauuacagugagauauagaaauguuacuuuauauagcucaguuuccucuuuccccuucuugugcuauuauucuuauauauacauauauuacaaacccaaaaauauauucuguaaaauuauuacuuuauauaauuuauguaauuuuaugucuaguaagcugagagaagagaggagagcaaguauguauauauagaaauuguauauuagccuucuauugaucauuucuggugcuuuucauuucuuucuauagauucacguuaccaucugguaucauuuccauaggccaaaacaacuuugauuccacuauaauuauauacauauacauauauauguauacauauaaaaaaauauauagaguauauauauacacacauaugguuuuauacuauuuauacuauaauaaaucaguuaagaaaaaaaggagauacucuauauacacacacacacacacacacacacacacacacacacacacauauauauauauauuuuuuuuuuuuuuuugagacagaguuuugcucuuguugcccaggcuggagugcaauggcgugaucucagcucacugcaaccuccgccucccagguucaagugauuuuccugccucagccuccugaguagcugggauuacaggcaugcacuaccacgcccagcuaauuuuguauuuuuaguagaaacgguauuucuccacauuggucaggcuggucucgaacuccugaccucaggugauccgccgccucggccucccaaagugcuaggauuacaggugugagccaccaugccuggccagagauacucuguuuuauaguuacucauuuaccuguaccagugcucuuugguuuuucauguaaauucauaucacugucuggggucacuuuuuuucagccugaagaacuuccuuugguauuucuuguaagguggaucugcuggcaacaaauacucucaguauucauuuauguggaaaugacuaucuuuauuuugccuucgucuuuuaaagaugugcugaguacaagauucuugguuaguguuuuugccucuuucagugcuuugaauaugucauccaggugucuucuggcuucuguuguuucuuauggcaagucagcuauucauguuuuuggaguuuccucguacaugaggaguugucauuuuuucuuuugcugcuuucaagauauucuuuguuuuuugggggcauuuuuacucuaaugcuucuugguguggaucguuuugcauuuauuguacuuacaguucauugagcuuuuugcaugaguagauuaguguuuuucaucaaauuugggaaguucacauccacauuucuauuuuuuuuuucuccuuuuucuuuuucuuuuuuuuuuuugagauggagucucgcucugucacccaggcuggagugcaguggcuccaucucggcucacugcaagcuccgccucccggauucacaccauucucccgccucagccucccgaguaacugggacuacaggcgcccaccaccaugcccggcuaauuuuuuguauuuuuaauagagacgggguuucaccguguuagccaggauggucucaaucuccugaccucgugauccaccugccucagccucccagagugcugggauuacaggcgugagccaccacacccagcccacauccacauuucuuuaaauaauuucuuccguuuccuucucuccucuccuucugguacugucauuauacauacauuggugggcucuuaauggugcuugcauaucucugaggcucuuaauuuaucuucuuuuuauuuauuuuuuuugagacagagucucacucugucacccaggcuggauugcagugaugcaaucucggcucacugccaccucugccuccuggguucaagcgauucuccugucucagccuccugaguagcugggauugcaggcacaugccaccacgccuagcuaguuuuuguauuuuuaguagagacgggguuucacaauguuggucaggcuggucucaaacuucugaccucgugauccacccaccucggccucccaaagugcugggauuacaggcgugagccaccacaccuggccucuucauucuuuuuucucuguauuauuuggauuauauaagcuguugaucugcuuucaaguuugcugauuaucuuuuuucaguucagaucuacuggugagccccuuaaauauauuuuucaugacagguauuuuugugaaaaaccauuugauuuuguuuuauaauuucuaucucuuuauauuuuguaucugagauauugucaucauaccuuucauuaccucuuuaagcauggucuccuuuaguucuguggauauauuuauaaugacugcuuugaaguauuguucagucugacauguaggcccucucacgagcaguuccuguuaccugcuauuuuucuucuguuucucuuauauguuucuguuucuucuccuguguuauguuuucguuuaaacuugacguuuuacuuuauuuuauauguuuuugagauaggguguugcuuugucacccaggcugaagugcagugguugugaucaugguucacugcagccucaaccucccagacucaguugaucuucccccucagccuccugaguagcugggauuacaggcacacagaaacacaucuggcuaauuuuguacuguuuuugcagagaugggguuucaccuuguugcccaggcugaugucgaacuccugggcucaagcaauccacccaccucagccaucccaaaguguugggauuagaggugugagccaccgcauccaagcaaaccggacauuuuagauuguguauuguaacuauugauaauauauugaccccucccuuccaaggcuugucguuauuguuuacuuguuuuucagugauuugauugaacuauuuuagccucugauaucuucucacagugcgcacagcauuaggcauucucacagucacccugggaugacagugguuuaucagggcucuguuugacuccucugauuucuguuagguuaacuaccucugucaguuucauaugcagcuguuaagcuucaauaauuauugucuaauuucuacauuuuuuucaucaguauauaaauagagcauaaauuguuccacagucuugauccaguuaaaucuaagccccuuugcagggauaguucuugaggccaaucuuugauguuuguucugacucuaggaggguucuuacuuuauuugucuuaccugcuuaucguauuucccugguuaucucugguaaacuagcugacguauguuguuuucaagagcacucuuagacuggaacuucucuauacucgcuaccaaauaaagucaguuucuuuggguagaguuuuaaaguuuucuguucuuguggccugucucccuuuaacacagcuucuccacugcccuggagcugggguggggacaguguucggcuucucuuggagugaaacuccugccuuacaagcagggcucuuguaggggcaguguccuuuacuugauuugccucucccuacauggaauuucugcccuaugaguaagcugaggcaagggugauuagggcucaguauucuggaccaucugugucugagguagagucuugcccugcaggcuuuggguggaggaagguugcuuuugauucuuugacauaccauucuggaauuuaaauugugauaauguugcugggaagcaugagaagugcugguggucugccucuccuauaucccuugacuaggaucuggggaagaagggauuugcaucuuccuggccauauuuucccagaguggaacauuggccagggcagaagaaggagggaguggguuguggcucaagugccacagggucuugcugauuuuacugagauugaguagacuuuguggaauaaaugcuguuuucuuuguuacuuucuuuuaggugaauucuccaagacuaaauucuugcuuuuuguuuuuguuuuauaauuuucccuaauaguaguuguuaugcucaggagcagauccauagaguuccuuucuguacauuauuacuugauugauuuuuaagcacugaaccagccuugcaucugugguaaaaccccauuuggucauguguauaauccuuuugagauauugcucaguucccuugcuacuauuaauauuuuuugaggauuuuugcaucuguguucaugagaaacauuagucuguaguuuucucuuuuauacugucuuuuucuguuuaaguaucaggccaaugcugguuucauagagcaauuugggaaguuccauccucuacuguuuucuggaggaagauuguguagaauuauucuuaauucucaucuaaaugauuuguauuuuuuagacuucuccagugaaaucaggcccaggagauuuguuuuuggggagguuugcuuugaaacuguuguuaccgguggaaggugucccgaguuaccggcagugaauccuuacaggucugcagcaaccuuaauucuugccuccuuauaagaaagaauuccacugagggucauaugguagaaaaagagacugaggcaaguuucagcaggaguggaaguuuauuaaaaagcuuuagaacaggaaagaaaggaaagugcacuuggaagagacccaagugggcaccaagaaggucaagugccacguuuaacugugauccuaggacuuuauaggacuucuggcaucuuggaacccuuccccaugauucuuuccuuacggugggcuguccauaugcacagugcccuucuuacccuuuggaagugagcacaugcaguggauuuaggaaguuuuauacaugcccaucugaggcuuucuucccuuuuccaguggugugcccucggaaagccaggcucugcuauuuugucucuuaaugcacaugccuggguucccucacccaacaccugagauuuuauuggaugcccuuuuuacuucucccuggggccugcauucaauuaacacuuuauaauguuaacagcuguagauuaucaggagauugucugucccugccuccggcugcugaauuaucuuuagagaggcaaugcaauaauuguggaaccaucaccugaucaccugacauuccugguggauggggagagcccucuccugccuggcuuaugccugccuaacuaccuguaacacuaugauuucaauuuuaaaauuauugugugucuuuuaaaaugaucuauuucauauuaggugaauuuuaguagguuuuggucugugaggaauuugucuguuucauccaaguucucaaauuuaugcuuaauagauuccuuucuccuauuuuguuaccuuguaaauguuuuuggaguguguaguuacauccucagcuuuguugggacaacuaaauuccucuucaaagacucaacuuccuggucauaaguuguaaaucaacccuaccuccuucuuuuuuccgcuucuccuuuucuugcagauugcgcguuuacccuauuugggaaaaaaaauuaggucuaagccaacggggaucagcuuagguugugcggucugaccccagccaacaggggaaggacacagaaacaggagcuguguuaggguuaaaaaccccuuccuuccuuuguucagugugcucuugcaguuguaacaggugcaggcaacacccuuccaccaaaguaaaagugccuugcugagaaauuuucuguuuaggugcggguuucuuuuggcuacgccaagcacuuguuucugacagcuucaauucuguaaagguugauuugugucuuuuuuuccccuuuuuauuuuagucuuguuugagguuuguuaauuucauugaucuuuucaaauugaccagauuuuuguuuuaccaauuuugucuauuuuuuguuuucaaauacuuagauuucugcucuuuccuguauucccuaauuuugguuuauuuucucuuuuucuaauuuucuuuagguaggagcuuagacuugauuugagaccuucccuuuuuuuaauguaacauuuagguuuauaaauuuuccucucagcucugcuuuggccuuauuccacaaguuuugauauguugaguuuucuuucaguucagugguuuuuuuuguuuuguuuuguuuuguuuuguuuuucuccagaguccucuuuguccuguggguuauuuagaaguuguuuaauuuccaaauuuuuccuaucuuucucucacuguguucuauuuugauuucauuauagucacagaacacacuaugugauuucaguuauucugaauuuaguaagguuuguuuuaugacccaggauauagccugucuugugaauguugauggaugcuugaagagaacauauauucugcuguugucgaguagagugcccuagaaaugucagucaauccuauuaguuaauauguuguuggguucuuuuauauccaugcugauuuucuuuuuuacaucuuugcugauuaaucuagcaauugcugagagagggauguugacaucccuaguuauaugugucccuuuucuauggcuuaaguuguuuucugccauuuuauuacuaguuuuaugacuuuauuauuuguuuccuuauuuucuguuuguucugcuuuucaauucuguuuuacuuuuucugcucuucuuagauuuguggcauuuucuagaauuucauuuuuguuuuuauagugucuuugagaguagugucuuugagugucuuuggauagcuuuuuuaggugauucuugcuauuauaauguacauuaaaaauuuuuuaugcuauaucauuaacaacauuuuaccgcuuugaguacauauaaaaaccuuaucuacuuuuagagaccuuugccuucccccuuuauaauauaauuauaauaguauuguguuuuccccaauauaauauaacuguguuuaaguauuuuucuauauacauuaggagcacaucaaauagguauaauuuuugcuuuagccuuuaaacauuuauucuuaaagagaagaauaggcuuuuuuauuuacuuccauuucucccauuucauuacucuuucuucuuuucuguuguuccaaguuucuucauguuacuuacuuucugguuggagaacuucugauagggcucugaugacuagaggaacaccaggguccuuugucucagaccgauuagauaaacaacacggacacauguggcaugguuucaagguuucagugaguggaaaguuuaauaagaaagaaggaaaaggcucccccauagagagacagagggagcggggcucugaacgaagaggaaaacccugagugcaccagaaaacagucuguuauauuaggaggcuggaggaggcggugucugauuugcauagggcucagggcauugguuugaccaagugugucauucacauagucugugaaaaaccuggcucucccacccuggccuuuuaauaugcaaaugcaggucuccaugauguccugcacacgcggagucaucuggaggcagccaugacacuuggcacacauggugaugaggaggagacggaggaauuaccaugcugaauggacccaguuucuaaucaccagcauuugcauaucaaagcuugcuggccuggcuuuuuaagcugcuuuucuauuagaaaagaaauguuugaggagcuaccuuuauuaaaagaaaaaaaccuuacugaggacuccuuacccuaucugcguaaaauaauuucuuaauaacucccguaauauuccccccugaggagaugucaccuuaacugcuguuagagaguuuugggugacgacucuuucuggccacuuccugcugaaaaggggcgucaaguggggaagagcagcuaggguuccucuuggagucgaucuaaggguccuuggaagaauggccugcccaugcaugguucguuuugcagcaccauuuggaguuugauugcuucuaggcaagagaaaacaauuugaguuauaguauugaguauacaaggugcaaauaugaauacaagauguguaagcaagagggggcuuaauaaaagagcuaaccaauuccguaaagaugauuggaauucauuaaagagggauuauggccacccgggcugaagccugcguuguuucuuagccugucaauuauuuugauuugaucuuuaaguaccuguauguuuucuucuacuugacuagagguguuaauccagaaacagcguguuucauuuaaaagugcacagguaccuccuacuucagcuaugaggacaccuaaggccugucuauuuugugcuacuacugagguuuuuagucuguagauugcuguugugccucuaugacacuuagaguugcuuuccauccuuguuguaucauaauggaaauauuaaguacugaucuuucaaggagaggggugcccauaaaccagaauagaccucugucuauagaauuucucauccaugguuuuucuaagaugauguuuucacgugcauguccuccccagucuacccuuucaguuaaaucuccauacaagggcauagaaaugauagaucucuuuguccagcauauacaagauaaugcaguuuccagaaaagacccuaaguuagggauguccccagaugaugcugcugucucgguagaauuuaaaaauaacaaguugggaacuauugcuacuauaguacaaguucccuuacaaggccuugggaggauuaaguuuauccaggagccgcaaagaaaauauagcccuguuccuugaagggacgguucuaaguuguggcuugugagagacaccggcagauuuuucucauaucuuagaaguuucccuucuuuacauauaauaggggcauccuugggauaaggauauccgucuuuaggauagucauuuacgaugccguuuggaauuugacaugccaagugaaaaggauccaccugacaaguggaguuuggaaaaaucagagacguaauaugcccuggccaguaucucagaugauccuguggcaagggcugucaguccagaugucuccaguucccccacagaucuguaagcugcuacuaugagcaagcaucauacaagggucuggaauuccaugggggaauguuuggaaaggcucauguguuauuuuauuuauuauuauuuuuuuuugagacagacucugucuuuguugcccaggcuggagugcaguggcgcgaucucagcuuacugcaaagcuccgccuccuggguucacaccauucuccugccucagccucccaaguagcuaggacuacaggcacccgccaccgcacccagcuaauuuuuuguauuuuuaguggagacgggguuuuacuguguuagccaggauggucucgaucuccugaccuugugaucugcccaccucagccucccaaagugcugguauuacaggcaugagccaccgcgcccagccuauguaauucuuuacauuauagucaacauggugacuuagagcauaucacucccaucgggacuuucaaccagaaggagaggcuagauucugaaagccccccauuagggcuucucauccuuuuagaucgcuccuguugcguuuuccuccccacaucuuugaacuaucagcaguuacaagugugauguuacaguaucugagaucucccaaguaugguccuucccuacugcuuuuaaagcagagggagccauuugcuauuacccgaucaacuuuuaccagccugagggugugaaauuuaucuuuggggagaauguuguuuggcacugggggaagaguguucuccugagaggaguuaguuacccaguuaaaagugcccccauacuaugucccauuuaugccucauaaaucuuuaaggguuaaagguaaagcuaacaaagggaauccuacgaugaugaguugugggucauugaaggguuccuuagugucauuaaacugagcaaaccacuuaggacagacccaacaauuagucuuguuguccaaaugggccauggcugauacugcaggagccaaaggaugugacauauuacuaagucugauaagaagucuuaacagacuuauugguaguaaaacgcucauguuuacuuccuguuaguaacuguuauucauacuaggaggauaauaauuaagcaaagugcuacaguaauugagauucucuguccaauauuguacccugagggugcuacagucuauaauccuacugcaaauaguagaauguagcaauuccugcagguguggcaugguaaauaacuuccaucaaaaagaaauucuaauauuuggcaaugaaucuugaaaggagagguagacacggcaaaaaguauuuggugagguaggggugagacugaguaaaaugaguaguucuuacucaguuacuuaucuuuugugacuuucagcuuaagaucuccuauuucuuuuuuacuuauauuuuuaaauuuuuuuuuauuuugagacagucuuacucugucacccaggcuggagugcaguggugugaucuuggcucacugcaaccucugccucccggguucaaggaauucucucucagccucccaaguagcugcuuuucaagcugcuuuucuauuagaaaagaaaagugcagggcacgguggcucaugccuguaaucccagcacuuugggaggccaaggcgggcggauugccugaggucaggaguuccagaccagucuggccaacauggugaaaccccgucucuacuaaaaauacaaaaaaaauuagccaggcuuggucgcgugugccuguaaucccagcuacuggggaggcugaggcaggggaauugcuugaaccagugagguggagguugcagugagccgagaucacaccacugcacuccagccugggugacagagugagacuccaucucaaaaaaaauaaaaaagaaauguuucaggagcugccuuuacuaaaagaaaaaaaaaaaaaaccuuaccgaggacuccuuacccuaacugccuaaaauaauuucuuaauaacuccuguaauauuuccuagagcauuauuuuaggaaaaugaucuguuggugauaauuuccuuaaauuuuucugagaauauuaucauuuacucuucauuccuauugaguauuuucuguugacauagaauucuggauuggcaggcuuggguuuuguuuguuuguuuguuuagcacuugaaguuuuuuuguacauuuccugauaugguuuggauguuuguccccuccaaaucucaugcugaaaugugauucccaguguuggagguagagcccaguagaaggcaauuagaucaugggagcagaucccucauaaauggcuugugaccaagcccuuggugauaugcgaguucuugcucaguuaaccugaaaucugguugauucugggaccucccacacuggcucuuuuacuccugcucuugccgugugaugugccugcuuccacuuugccuucugccaugauuguaagcuucccgaggcccucaacagaagcugaacagauaucugugcuguguauacaggcugcagaaccaugagccaauuaaacuccuuuucuuuauaaauuacccagucucagauauuuauuuacagugaugcaagaacagccuaacacauuuccuuuuggccuucuugguugcagaugagaaauucauucuaauuugaauugucauugccuguugguaauuucuuuuuuuaaguugcuuucaagauguuuacuuuguguuuaguuuuuaguauuuugauuaugauguguuauaagguagauuuauuuugauucauuuuguuugggguucacuuggauucuugaaucuguauuuuuguuuuugccaaauuuguaaaaauuuuauuuuacaaacaaaauacucaaauguuuuauuauuuuaucauccuagaaacucuuccucaucucuuaaauacuggagugaaaugaaugucaccucauuuuuuucuugucccacagguugcugacagucugguuguugucaucuuuuuauuuuuucagucuguuuuuucuguuguucuuuuuuuuuugagauggagucucgcucuguugcccaggcuggagugcaguggugccaucucugccucccagguucaagcgguucuccugccucagccucccggguagcugggacuacaggcacgugccaccaugcccggcuaauuuuuuauauuuuuuuaguagagacaagguuucaccauauuagccaggaugaucuugaucuccugaccucguaaucugcccaccucagccucccaaagugcugggauuacaggugugagccaccgcacccggcccuuuucuguguuguucuuauugaguaauuucuauugcuuuuucuucagguucauugauuauuuuuuuucuuucuuaucuuuauucuuuuguugagcccaucuagucaguuuuuauuuguuauuguauuuuucaguuauauaauuugcauuugguucuuuuauaucuucuauuacuuugcugaaauaaucuuuguuuuuuucuaauuucuuuucaacagcauucauaaugguugcuuccauugaaacauuuuuuucugaugacugcuuccaaaucuuugucagauaauuccaauaucugauuccuuucgguguugacaucuguugauuguguuuucuuauucuaguugggauuuuccuagcucuugcuauaauaaaugauuuuagguaguaucucagacauuugagacauuuuguuacgagacuuuggaucgcauuuaauuggcuuuguaguagggagucaccuugguagcauacaggucuuggcuuacuuuuuaaauuuuggucaguuuuacauguagucaguucguuguuaaguguccuauccaggauuacauuucaagauuuaacuaucccuuuuuccaucuaccuugucuccugaaucuucuuccuccugucuguuugggagacaccacuugcuacagcuaugugaugauagcaguggaaguccaggcuuccucuucagcuucuccuaguaccaacucaauaggggaagccgaacaccuccugcuaccaauaagccuaagugaaaguucaggauauguuuucugcuucugcuuaacaccacccuagaggagauauuaugaaguacuacucgguacuguuuggaaguggguauaaguucaggcuuuucacuugcugccugcucaaaccagguggcacaugaaacuaggcuucuuauuugauuuccguggacacuaguagagaagggcucaguuuuuuucccauugaguuuggcauugucagguuucuguccuaccacguacccuuaucugguccuuuuccuagagaaagcaggcuuuucuugggcucuuucaucagcaccuauuagcauuucuggguaacagaauucuacaguacccagucugugauauauaggaagugaaaagaaaaugcaaggucuagaguccagaaauaaauccauacauuuaguggaagaaagcauaguuucuucaaccaaagguacauuggauucaccuuaguagcuuuuaaaaaagauuaaugcuugcucucuuccccagacaaauauaaucagaaugagagacaggucagggagguagacuguaucaguauauaaaacauuugcaggcgauuuaaaugggggccaacauugagaagcucuguuugaagcacauacuucccaucauugaugaguuuuuucagauagccauuugacccaauucuggccaauaagagucuuuguaagguaacuuuuacaaggaagcuuguucuuuuaaacauugucacauggauaugaaucuuggaauugcugugagcaucuugcuaaaggcucacgaauauagccaacacuuggaaugcagaugagaaagauggaaagaaaccuagucuuaaugucccucaucugccaaauuagcuugcgcuggagucuuuugugccucuguacuuuccauuauaugaaaaaaaaauguccuuaguguuucauccauaaguuugaauucugacugguaccuggaagcuucuaaacugcuauagcuaaugagaagaaaaacuagugguaaaauauauugcuauucucuaccauauccauuuucuguugcuauaacagaauaccugagacuggguaauuuauuuuaaaaagagguuuauuggcuaggcgcgguggcucacaucuguaaucccagcacuuugggaggcugaggcaggcagaucaccugaggucaggaguucgagacuagccugaccaauaugaugaaacucuggcucuacuaaaaauacaaaaauuagcugggcgugguggcaugcaccuauaaugcuggcuacucaggaggcugagacaggagaaucgcuugaacgugggaggcggagguugcagugagccaagaucagauugugccauugcacucuagccugggcaacaagagcgaaacuccaucucaaaaaaaaaaaaaaaaguuuauuuuggcugggagguccgggaucagauggccacaucuggucuguucugaggguugcgugcugucauaacaugacagagaagcagaaggggaagugggugcauguaaaagggauagaacuccaggggcagccucacuuuauaccaacccauuugugguaauuaaucuaguacugugauagugagaacucacucgcucccuugagaauuaaccuugucccuggaaugugacauuaauccuucuaaaugaccuaaucaccucuuaaagguccugucucucaaaaucaccauaccagggaccaaauuuucaacacaugaauucuaggggacaaacucaaaccauugcacauauuuuucuaauauauguuguauauaaauguaacgagaauaaacuucucuagugaauuuauugauagguauagaaguuuccuccaguauuagcuuuuguuugcuacuuauguuaagaugccagaguaguugauauuguuauugcuuguuuugucaaauugcuuucccaacagauaucuuucuaccauguuagcagcaauaaguauuucuugucuuuauuuuuuaucauuggauuuuauuuuggggguuguuugcccauggcaugucauuauaauuucccauuuucuuuuuuuauuuuaacugaacauguugaucauuugucuguuuuuacucauaaguuauauuuuuuauuggagggggauuaucuaaucaugccuuuuguaccacaguuuaacagcuuuggaacuuggggaaguuguauuuacucuuuaaugccuacaugauagaauuaguaugagguuaaaaugagauaguuuucuaaaguucucugaguacuuuggcaaugaaaauauuagcaauccuuuaucaguuugcuauaaauaauuguuaccaucuucguuccccuuuuauggcauuauaauacaaaauuauauuuuaaguaauauuuagccaaauaugucacuuuccagucacaauuuaaauauaagaauaaaaggcauaacaaaaugauauagauauaugcaugaguuaauguggcaauaauauaaacuaaaaaaauaucgugauagccugaaagugaaaaguauuuucaaucaaauguuucuuuguauuuucauauuuauuauaugcucuuuaaaccaguuugccuaaggucagguuguuuucuaaaagugcugugucacaugugaagucuuuuuucucaaccaagucauugguaugaaaacaguuaccaaguuaacccauuuaugccuagugcuccauuauuggcuugcuaagcuuaugggaguuauuuauauccuacugcucaaggucauugccaaggccugauuuuucacacaaaaaacguuugcuaccucuggcauaaauggguuaauagaugaggacaaaagucaaccagguuaaaaaaugugaagaauguaaccuaucaaaguugauuucauucaauuuuuuuuuuuuuuuacagaaacaugaucaggggcaagucuuguuggaugucgucuucaagcaucuagauuugacugagcaggacuauuuugguuuacaguuggcugaugauuccacagauaacccaguaaguguaagauuuugucuuucauuuucauuuaguuuuuccucucaguuuaguguagaaaguccuuucugauuuacaguguucacugauuugaugaguuuuuuuuuuacuugacuuaaauagagguaauucuuuugcuuuuguuccucuuuucuugacauuuuaaucuuucagaaguuauuagcuuuaagguuuucauaauuaugucagguaaugucacuuucauuaauuaugugucucagacaacuaaaaaguaaauccaauuuaugccuguugacugaaagagaggaaauugggcauaaagguuaaaauaccuucagauguauauaaauuagucugcacuaaaguaaaauuaguuuuuuauuguauuuauagagagcuauuucuaauaaaaauucuuaauuuauucaaugucaaauuuccaaauuucaucagagacccucacaaauaagauagagauuaaauuucagagcuguacaauuauuuggcauuaaauuucuuggauuuuuacuuauucuucaguaauugcaauugugguucuuuuaauuagauagaucacaucauagaaauagaagauagcaugugaugaauaauagaaauguuuacuuugacaauuaaguguuauaaaaugcacuaaaggauauaccuuacucugaaccgagauaaaggguauacaagcaaauucugauugaauucuuuguaaauuuauaugcuuauacagugagggacuucugcaauaaaguauauucuuuugauuaguguaagaggaucuccauuuugaagggaauauuuuguauacuuuuagaaagauuaggaggcugaagaaaugguucuggauuaauguuuuagaaaucuguuuauaaggcuauauuaauagaagggcuauagaaaauacaaauaauguuuaugagaaaaguugguuuguuuuuuucuuccucucucucaugguugggaucuucauucucugaaugaauagcuagugggaauuauauaucaaacguuaaauacuaccacuuauuuuuuugacaucauuuacugauuuuguauuacaaaccagucauggaaaaauacgaggaugacacaaagaaaaacaaaccaagggccagcuaguuucagugaaaauaaaugcuuuuauacugaacuaaaauuaaaauaaacuuuccucauacuuugaugccuucacuagaccacuugagcuucuucaggggccuagaguuauacuguuguuuccugauaaauaaacccauguaaaaauggaagugaguagaaaugucaguaaugcagccuuucccagguugaaccuaaaauaaucaaaagggucagaauguaguuuaaagagaguuuauucaagugcaaagguugaggaccucagcccaggauacacuugcaaguugccuuggagagugcucuggagaacauaagaaagguucaaguuuuuaaagaauaaagaggaucacucaggagagugaguaagugcaaaaauuguucuucaggaauucucauugacuuacagaaauaacauugguuagcgauuggcuauacaugguugaacuauaggguguauaacauuuuauggcuacuuggcuucagucugcagcccacauagcaaguagcuucaagagguaacuauguagcugaagggagagugagaugugacugcuguuacuuuuuaaaugccuuucuugcccugaucauuuaaaggugcuccuauuccucagauauaagguuuuuuuccuuucuuaccagaaaggcaaauugugagccaagcaaauaccugaaaggugacuguuauaccucauuaaguauaccucgugaagagaaaaaauagauaauucuuagcucuugcugacccucauaagucaggcccuguagcuguaggcuggcauuagauugacgggguaagugacaagaugacaaaagaggaagagaccagugacucaccacuguagucacuaccauaaauaugaaaacaguccuuuucaggaaguacuccagaaggauuaauaucgagaucauguauacuacaagagauaaaaauucuaucacauaaauuuguauacaaaaagacauaucauauacaaaaagauguagggcuaauuacaccagaaugaauguagggaaacagguauuuggagcuagauugaucuuuuugcugucuccuacuuuuucuuucuuugucuuucugucuugaguauuccuucucaaauaagauacauuccaaguuccaagaguccaguuguuuaugauucaaaguaauucuuccagaaaaguuagaaucauagaauuuuaaagguccaaaagaggcuuuagagauuaucuagccucacacucuaauuuuucauaagacauuaucccaauccaaagcuacuuccuggcauuagugaaacuaggaccuggaucuccuaacuccccaugcuagucuuguccacugcacugcaguuucauuauuuaaauauuuggaagaauuucugagaugccaaaauguguccacagaaagaucuuuagagcacaaaucuuauaaacagugucccauuucuaguugucaagagcacaaaucuuguaaguagaguuccaauucuaguugucaaugugaaauuaaggcuuugaggauaauuaacggacugaaggaaaaagaugcuaugcuucaagagaaaggaguaggggaguaucauuuauaaaacaucugcugugaauuuguuaaucaacuaaauaauauuccauuuuauucucacaauacuuuccucacuuaugaugaaagugucauuaaaaucauuuuaaagaugaaaaacuaauacuuauagaagucaacuaauuuguuuaaugucacgcaaauuagugaaguagcugagaaaggacuugaacucagaucuaacuucaaagccuguacucucuaccauaugauguugcuucccaagugaugaugauauagaugcauaggauuuacagaguaaaugaacauauuaaggagaggagguaaccauauaauaaaauuacuaucagugauccaaaggaauuugcuaagauucuacaagaauuaauucucaccuaucuuuagcucauaauuuuuaaaucuuaaaacuuauguauguuacauauacauaugcacauguauguauauauuauguguauauguguauuuuuauauauuaguuuuagagaauuagaacuguugccuuagacauugaaauuaauguaauugaguuuauaauugauaaacuuaaaaggcaccuagcauuuuguuuuuuucuccuaaguaugaaauaacaaauacagaauaauagcugacggucuuuuccuuuagaaucuucccugguaaugaguuccagugcaacaaagaaaauuacuugaagcuuugacuuuucagaauuucuccugcuuuaauuuaaagccuguuuaucacaguuuuagcuuuuagcauaauaucuuguuguaguaguaauaguaaauguauguugaauaaaugaggaaaauaauauugugguuauaauucauuaugcauuauuucuuuaauuuuaugagcagucaaagguggcuuuuucuuaguggucuuuaucagcaugcuauuuaacagaggcuugagauuauauuauuccugugcauuuacuguuucuuucccuauuaaauugaauuauacugcucuuaaguaggauagaggguagauuauuaauuauuguuggccugaucuuucugcagguucauucuucugguaguuuuuguugguuuaugauauuugacugguuuacuccucuuugcauagcuccuaacccugugguuuucaaacuggagcuugcaugagaaacaacuggaaggcuucuuaaaauacagauuucugggaccuaugccuagagauuucugaaucagaaggucuacuuuggaacucaagaaauugccuuucaaauaaguuuccuuguaucacuaaugcugcuaguccaaggaacuauauuaugaaaaucacuacucuaacccaguaugcuguuaauuaacacuacuaaguuaugacauauuuuucuugggguaaguuuauuuacccuuugaagauuucuuuuauauaacucaauucuuacauuauuuauuucauuagguuugaguaaauaugggaaaagucacauacaggcugaccguuauuucaacaagccauguuugaauacaugguugcuaaaaugcuuaaaucuauuuuauauguuucacuauuucucucuuaucuauucauauguuuccacuguaauaucuuaauucaagcucuuauuugccuguuguguaauccucuuugguagccugcuaaaugcaauuuuuugcuucuugucucguuuaacucuguuguauuuugagagggaauggcaaagagaccuggggugcacagaaguguuuaagaaagaagcaggagcauaugcagagaucaagagugaagaaacaggaaugcugaauuugaagaacuggaaaaaaguuuuaguauuaaaccuuuauuuaauaaaaggagaagggguaaaagaugagauuugagcauuacaugauaucaugaaaagccuuuuaauccaugauaaaaaucaaacuuaccuaugaauuuauuuauaugacuaaacacaagacuuguauuuuacacauaucccugugguuauaguguagccagcaacuaauagacaguugggagauuguuggaauaaagaaauugcuaagaaaguagugguuggcuguggggaaugaagaaaagaagaugagugcuagagauaauucaguuaggagauaaagucaacaggacugguugguuugauucagauacagugaguucaugaggaaaagggguaaaucaagguuacuacuucaaauucugcuuuuggcaacuugguaaauagaaaaaacaugcaaauaguauuguugguuuucuuuuuucauuucaaauuguuuauuucuagcauauagaaauacaguuaaguuuguguauugauuuuguauucuguacccuuccugaacucacuuaauucuaguagcuuuuuguaaauucuauagaauuuuguaccuagauuaucauguagauauaugguaaauuacauugauuuucaauuuuuaaaccaacuuuguguuucugggauaaaccccaagauaacuaacugauuguauauuaaccuuguaucuugagaccuugcuaauacacauuacuguuaguaguuguuuucauugauuccuuaggauuuucuguguaaauaaucaugucuuuuguaaauagggacaguuuuacuuccuccuuacaagucuuuauccuuuuuguuuuucucauuuuuuaauucauuauugcacuggccgaagccagcagggcaaagaugaauagaagugauaggcgcagacuaccuugucuuguuccugaucuuagaggaaaauaccgaagauacuguuuccccaucaaguauacuguugaguuuuuccccuaaaucaauguaacugaggcauaaauuacagagaauaaaauucagcagccauucauaaugaaaacccaacuaaacuuggaaaagaaaggaaccuuuuuacucugacaaaggacauuuaauaaauauuuaaagaugcauccaggaaaugcaaaguaaaaccacaaugaaguaguacuuccucuagaaguaguauacccacuaguaguauauccagugaaguaguauauccacuagaauaauuaaaauuaaaaauuauuucaauaccaaauguugacaaggauguggaacaacugauaaaauugcuugugguaauuuaaaaugauacaaccacuuuuugaaaaauaguuggaaauuuucuuguaaaauuaaacauagauuuaauauauacuguugggaacaggaccccccaaaaucuggccauaaacuggcuccaaaacuggccauaaacaaaaucucugcagcacugugacauguucauguuggccauaaugcccacguuggaagguuguggguuuaccggaaugagggcaaggaacaccuggcccacccagggcggaaaaccgcuuaaaggcauucuuaagucacaaacaauagcaugagugaucugugccuuaaggacaugcuccugcugcaguuaacuaacccaaccuauuccuuuaauucggcccaucccuucguuucccauaagggauacuuuuaguugauuuaauaucuauagaaacaaugcuaaugacuggcuugcuguuaauaaauacguggguaaaucucuguucgaggcucucagcucugaaggcugugagaccccugauuucccacuucacaccucuauauuucugugugugugucuuuaauuccucuagcaccacuggguuagggucuccccgacugagcuggucucggcauauaccacugagaaaucccacuuuuagcuauuuauccaagagaaaugaaaacaugucucauaaagccuuguauacaaauguucacaguaguuuuauucauaauagcccaaaugugaauuaacuuuaauguccaucaauaaacaaagggaugaaaaguaacugcuguguaucuauagaguagaacacuauaugguuccauuuauauuaacuuacagaacaagcuaaacugacacauagugaccaaaagcagaucagugguugccuaggauuuggcagacugauugcaaagaagcacaggaaacacuuuagggugauagaaauaucuugauuguggaugguggugguuaccuggcuguacacauuugucacaauuuaaacugcauauugcaaaugggugcaguuaaccuggcuggacccacagucuguauucuguguccaauuugggagcaguaucucuacuuauuucuuaaagguucaaacuccucuuucuugggacucuggagucuaacuauacaugcauaguucagcugucagccagaguuuggagcuaauccucuuucugaguucuccuuuucagaaucuccuccucaauuuucuguuuuucccccacccccauuccuaaacucuguccucugacaccucaaguuaguaaggauguccucugccuguguaggauuugaacuugcccguaggcaaagauugcuaauauauaucucagcccuugcaguuuuuguuuuucaagaguagacuuuccuccucuuucugccuacuuuugguugcuuuccagugucaaauaguacacucaugaacacacagagaauaaaaaugaaugccaucagcagacaagaaauuuucaagauuuuuuaaaagaucgaauguugacauucaguguugacaggauugguggaagagucaaaccagaggaaaacuuaccaaaaagguguugaagaggaaagauuucuggguaauguaguacggguaucaaagugauuaacugagaaacuauuugaggccacuuggccuccucuuuuccccauuucuaauugaacagagggcagcagauacaguucccugcagaauaaagcuguguguuaggguauguuuguugggggaagaacucauuuuucuuuagcaauaugauuauccaccuugaaagcucaaaugaaucauuuggaaaacuauuauaacugguaagacuuagagcucaacaaacaucaguaccuuuuuauauaccauuuaggagacauacaccaaaaaauagcaaaucacguuuuuuuuaaaacccagauucauuaaacaucuaggaauaaacuuaagcaggagugucaagagccauaugaagaaaauauagaacuaugcaggaagauauaauagaaauuaugaauaaauagagacacaccaugcucauaaugaggaaugcucaguauuguaaaagaugucagcacuauuucaguuucauugguaaaaccagugguauugcugguuaguaucugaauggaauuuuuggggagaagauuugacaauaggauccucaacuuccucuggaagagaaucuggauaaacuuagccagauauauaaaauauaaucaacucguccuaacagguauaaaaauggaauaugaugacauaguacuuaaaauaguguguucuuaguaucgauauaagucaaugggguagaagaaacagcccaaguaucaauuuuugucuauaugaaacauaguuuauuauaaugaugguauucaagauagguauuggaacaauugguuaaagaugagaaaauauguauuuagauuccuaacagauaccauauauaaaaauaaauuccaauguaaauuuaaauguaaaacaauaguauaguuggguaagaguuggaaacauuuuuaauaauauuuguuaugaucauccuaggcaacaauaguuccugcauuuguaaaggaaauguugauagauuucacugcauaacauacagaguauacacugaggacaaaauaccaacuggagggaaauacuugcaacauauguaacauaauauuaaaaucuagaagagcuucuacaaauaauaaauaaaagucacauaacccaauagaaaaaugggaagauagcaugaacagaagaagaguaacuauuaauaacaaacgugacaagauauucagcuucacugguuaaucagagagaugccaauuacaaugauaacacucuuugcauacuagauuagcaaaaauacagauucacacuaccuguuucuggcaaaggcucgggaaaugugcauucucaagacaguuggugagaguguaaagugaaaaaguguuuuuggaaggcagauggcagcauauaucaaaauuuaaaaauuauuguauggaagaauuucucuugcaacacuauuuuuaauaggaaauaguaauggaaaaaccugaaacccucauaagagaauaguugaauaaaguaugugacaucugcugggcaugguggugcaugccugcagucccagcuaccggggaggcugaggcaggagaaccacuugcgcucaggaguucuggacuauagugcacuaugcugauugggugucugcacuaaguucagcaucuaacauuauuaaaugcuuguaugcagguguaccacagcauuauaagguauacuugcugguaugugaacagaggcuaccucuuuggauggaagaguagaauuggaagagccauaauaaaggacuuuuauguuuuuuugcucuguaugugugugagaaagagagagagaaaaaaaaagcuugaauguuuuauauugauacuguuauuuuaguaauaauuuuauuauagaaaacaaaaggauaaacgaucauucaucuaaacuuggcuaugcuuccaaauuccuugggaaacauaaaaaaauugcugacacccuaugccuacagauucaugguuaguuggucuauucaccuaaauaucugaagaaagucccuuugcgagucugauacucauugacucauucauagucacccauuugguuaaaucaccugauuuuauaauaaaaugaugaaagacuugagaggugaaaggggagcuguagugggaaaauauucagacgaggauuuauugaaccccacuaguucuccaguauuguuuuuaauuuuauuaaauuuuguuuuaauuuuauuuagccauuguuuuuguuauuaauuuuauuuuauuuagcguagugaaagguaaaguugggaucaaauccaaguuuuccacaccuuuucuuucuacuguuuuacuaaacccuauguuuuuuacuggaucuagugacucuccagaauuacuuuauuugggagaugcucuuccucccaaguuucuaacuuaauuucuaguaagaaauaggauugauuuauaagagaaacaaaagguuaauaucacaauguauacagcuaccauuaagaugaguaauggcagguauuacagcuaaagauuucuaaaaauggauagaaaauggaauauuuuacagaugaaauaggcaguacuugaucuuugcuaucuugggcauaaauacuuucucuuccugaaauaucuuaccuuuaacucacauccuucacucccgucacaucuuuuacccuaccccucuuaccuucacauuuuuuaagacucagaguaaaagucacuuucccucucaagccuuuccugacuaccacuacuccccagguacaguuuaccucuuucuuuuuuaucuguagcagugaugauacuuucuugaggugauauguuucaugacuuaccaguuuuugaggauagggaccauguuuugaacuuauaucaccccaguaccugacacagugccuuauagaaaauaggcuucaaauaaugaaugaguuaagggaaaaaaguauacaucuaaaacuugauacuguggaaaagaauauaagcuagaauuuaaucuccaaagugauacugaaacagaugaagaaauaaauauauggcuguaauuuguccaaauuauauuuucuuuaagaccaaggcuauuuacaauaggaacccugaacaguuuggaguuaaauuacuuuauugauugauugaaacaaggucuugcucugucacccagacuggagugcagugugcaguggugcgaucauggcuuacagcagccucagccucucagacugaaccucaaccuccuagccucccgaguaaccaggacuauaggcaugcacuaccacaucuggcuaauuuuuucuggguuuuuuuuuuuuguuguuguuguuguuuuuuuuguagagacguggucuugccauguaucuuuccccuaauuugcagaaagauacagauaugcaaauagaagaagcucacugaacuccaaguacaaugaaaauggucgaaagaguuuugaaagcagcaagagaaagagaaaagugacuugucacauagaagugcaccucaaugaaauaaccaguggauuucuuaguagaaaccaugcagaucucaaauguagaaauuuuauuacuacguuuuggcagauacaaaaauuaacuuugucaugugaagcaguauauagaguaaacaagagauucuucccagggaaaagaaugggaaauuggcuuugaaaagauuagaaaccaugagucaucagguaaccgauuagcaaugucuaaucgcuuugaaagguuugaaaagauuagaaacagagcuccaucccuaaguagacacuccuucaugaaugggguugaugauguaguaccgucucuuguuagcuaucaguguuaacuagauaguuauaguuucuaauaaaauauuaggacauuuaaaauucauauauauuguauugcagacaguucagcuuuucucagauguagcacaguaauccagcuaguacagcaguucuuggcaaagaaaaugcagucuguaacuaaauauagguagugauauaaccccaaugcucauuuauauaagaacaaaauuaaggguuuaucauaugugauuucaagauguauuaaaacaguuacuuuaagcaguuccacucccagauauauauugaagagacuugaaaauguauguccacacaaaaauuuauacacagauguucauagcaacauuauucauaauaacuaaaauaugggaacaauccaaauguccaucaagugaugacuagauaaaccaaauaugguauagcuauacaaugaaauauucagcaauaaaaaggaauggcauaccacagcacacucauugggauggcuauaauuuuuuaaagauaguguugaugaggaagugaagaaauggaaaucuuuauacauugauauuggagauguaaaagguacagccauuguggaaacaaguuuggcaguuucucaaaaaguuaaauauacaauuauccugugacccaacaauacuacuccuaggcauguacccaagagaauugaagacauguguucacacaaaaauguguacacaaauguucauagcaguauuauucauaauagucgaaaaguagacacaacccaguaucagccauaaaaaggaaugaguuauuguuacaugccacaauguagaugaaccaagaaaaccuugucugugaaagcagacaaacacaaaaggcaaccuguuguaugauuccauucuuacgaaauguucaaaacagguaaauuuguagagacagaauguagguuagugauuguuaggggcaacagggaaggguacauugagacugacugcgaauagguacaagauuaccuuugagggugauggaaauauucuggaauuagauagugaugaugguugcacaccguagggaauauacuaaaguauaaugacacauacauguuaaaaugguaaauuuuguggugcgugaaauaugucucacuaaaaauaauaaaaauaaugcugagucuuggcauaugcauuuuauaauuugauaaauuuugccaaguuauccuccauugagaugguacaauuuauacuuucagaagcuauguaugagagugccuguucuucucacgugugugucaucaaacguuuuagucuuugcccaauauuacuguugaaaaauaauaacccaauguagauuacuuuuguauuucucuaauuaugaucaagauugacuaucuugucauauacuuaaaugccauuuguaguuccuugauugugaacuugcauucuuauucauugccuguuuuucuauuagugucaguuuuuucuuauugauguguagaacuuguuuauauauuauguuuuuuccuaguuuguuuugcaacuugauggauuuuuacaaugaaugcuauuuuuaccauucaguagugcuuguuauagcacuguuccaucuuccugguuuaaaccaagaaccuuaacccuaucucacugauaucauugaugagagcaauuaaauuucucagugcuuaucuuuguacuucuaagcuaugucagcuugacacaucuguguauguaaauguguuuguauuucuuuuaccagaauauuuugaaggagaacugaaugaggaagacaagcuuucaauagauuaauugaucugaaauuuugauuguagacagucauuaaaguggauauaauuuaugacuuuuccuagaagauaugaagaacaaaaaucacuagauuaauagauagauggaugggaagguggauaaaugguagaugauugaggaaagaaguuuauuaaacagggcugaaaacccuacccccagcuauugagucauucagcagguuuaguccuucaguaaauuauuuauuuauuuauuuacuuauuuacuuugcuuacuuucuuauuuugagacaggggauuacaggugugugccacugcuuuugacaguauuuuuaacucauauuaugucaagcccugugcuaggugcugacucuacaguauugacugaaacagcuuuuaucccugguuucauuauaaucuaaugaaggagucagacaaaaaaagacaaaaggugaaacaaacuuaauugagguaauguaaugaagggauauaauguuccuuacuuguuaaaugggagcuguacgacauacuuuugguaggguggucaguugaaggccuuucugagguggcaggcuuuaagcugagacuuacggauaaugaagaguacuguaggaaaucuagagggcauucugugaaagggaagcuugaaauugagggccuuaugauggcaucuuucagaaacagaaaggaggccauuauggcuggaauuuaguaagcugagguggaagagguaagaagagaccauacaagcuguaguguaaggacuuuggaucuaguacugagaaauuaucaagaaguguuaaucaaaugagugacauacucaaaguuauguuuuaggacuauucuugcuucuuuauggagcaugaagagggacauggugaugagaaaaucaacugggagagcaauuaagaggcgauagagcuuagacuagagagauaaggaugauaaauugauaaauucuagauacaguuugcagauagacucaguuggauuugauguguuggauguuauggacaguggagaggaaaucauuguuaauuacucccagccauuuauuuauuauuaaaaaucuauguguucugccuggauuuaauuaugggugguagaaguuagguuuauaaauaaugauacauaaacuuacuuggaaaauacuaccacaucuaguaccucauuuuggguucuuugauuuuuuuuuaauugaaacauguuagcaguugaaguuuuucugaauucaguccuaauuguccagaaauagagcuaaacuggccuucagaaguauugaaacugcuuaaaauuucucacacauaaaaaucaaucauucucaaaacuaaacauuauaucuuuaaaaauugguggguuuuuuucaaaugggagguauuuuauuuuuaaaggaaugaggcaaauguuauaaaauuucuccucaguggauuuucaaguucuguaguagaauuuugccugaaugaguauaaagcccaagagcaugugugugugugugugugugugugugugugugugugugugugugcgugaagggugaagagaauuuugaaaacuugccagacuuuuaagaaauauaguuagauuaaugugaaucacuucacauucacuucagguugcugcaauuauuaacuaucuuuacuuaugaaauagagguuguugcacauuguacuguuugauggaaaagucaaaucaaaaucuuaauauuaacacauucacuaauuucuagcauaauuuuauuacauuugauaugaaaaauauugucuguaaugcaaugauuuuuuuccuaccugggccuuuucugaaaugcagcuuuuagcauuaaucuccaaauggaacagauuugcaagaaucaauauaguaguuccucaaggaaaaaagaaaucaguuuuauuuauuuauuuuucagagguggcuggauccaaacaaaccaauaaggaagcagcuaaagagugagcauacauauuuacuuaauguuuugcaaguuuacuuuauaaagauaaaggauuaauauagucugauuaauuagaacuacuuuuauuaauucuaggaggaucuccuuacaguuugaacuuuagagucaaauuuuuuguaagugaccccaacaaguuacaagaagaauauacaagguggguuuauggauauauuuuucuugaaaauauugucaaaacucuaauaugaaauuuugaaauuaauuaggcaaaaagaaauuacugugguguaauucugagcuuuccagucaguacacagaauaaguuauggcuauuccaagauaacguuuuccuccuuuuuuggauggcugggagaguguaaggggauuuagaaccucagggcugcccaguccagccccagcuuccugaaccauguaaauauuaaaaauuucuacuugugaacacugcuuaaguguggcuauaauuaauugaggucaucaaaugugcugaaauuguauccaaaggaugcuguguggugagaaauuuggguuuuuuuuuucccaugugaaagcauauucuaguaucuuuuuuuauuggggagaacauagaauuuauaaaauauauaaccauuauuugcgggucaguagguaccuuuuguccccuauguguuuuuaaucuuugguuccaaaaaaauauaauggaguuuauaaaggauguugcagagagugcacuagcauguugaggccuuuacaugcccacuugacucuccauuuuaagucucagcuuauguuacuaucuaauuuuauggucauuucgacuugacagaguauauacacaugaaugauccagaugaacauuuugauaauguucuugauuauagggugaaauauugaagguagaaauggagaaauaccaacaguguaguaacugucaguauuaaccugaaugacaaccuuguguguugccugaaagacagaauuaguaaugaguuauuuuacaaagacaguuaaaaauuagcauguuauacucucuguaaaauucucagauauaagaauauaggccagugacuacauucagaauuacucuaaaagauaggugucaaaauuaaaaaauccauaccuaaaauuaccuauagaugggauguuaaauuuuaauguauugguuaucauuuaggauacugucuuggaguagagaaacaaaaggauaaauuauuuaauuagcugcagcugccaguucuaagguguuugcagaguuuucaguaguaaaccaagugagaaaaauuagauugaaauucuagagauuucuuuucagucaguguguuuuggggugggugcgcagguguuccuuuuuuuuuuuuuuuuuuuaacaaaugggagaacucaguaauguagucucuggauuauguaauccuaaugcuugcaacuauuaguagaauccaagcuaauuccucuugaaaaacuaaguuguggccgggugcaguggcucacgccuguaaucccagcacuuugggaggccaaggugggcggaucacgaggucaggagaucaagaacauccuggcuaacacggugaaaccccaucucuacuaaaaauacaaaaaauuagccgggugugguggcaggcgccuguagucccagcuacuggggaggcugaggcaggagaauggcaugaacccgggaggcagagcuggcagugagccgagaucacgccacugcacuccagccugggcgacagagugagacuccgucugaaaaaaaaaaaaaacaaaaaugaaaaacaaagucguguuauauguauacaccuuagcuuaauauuguagcccuuaaaauauugucaguuaaaacuauguuuauaauguacuucacuugaaaaacugucuuugaauuucugaauggagguagaauguguugauucuuuuauagccugcauugaaaacauaauaaggaaauaaauauguuucacuaauaaguugaaauaacugccugaagcagaagaaaguaaaaucaaguuugaugguagucaaggaauuaauuugcucucagacccuuuuauaauggaauguuauggaaucuuauaacugguauuguuugguaaaaugggguaaaugucuaguuuuuuguaaauuuuacuaccauaguguauaucagugauuuuucuacucugauuagaaauuagaaucauuugggggagcuuuaaaaccauaaugaugucuuggccacaucccuagauaauucugauugaacaggucuuagaugggaccugagcauaggcaugcacaaguucccccaaaugauucuaauauauagccaaggcuacauauuagccaaagcuuuaaugcuugaguagccuuaaugugaugguuaugauuaguaacagugcaccuucugccacagcugcuaaguuuucagaacuaguuuagaccccaggaaacaggaaaucugcugcaccuccuuaccuugagauuucaagaauguaaauaguauauucccaauaugcagaugaaucugcucaguaauucuuucucaguuuuuagcuauaugaaaguugacucuguuugguagugagccaagaggagaaaauaaacucuauguaauacuaaauuaauuuuuaaaauaucccuuuaacuaaugaauuaguuuaguuuaauuagugaaaaauauuccuuuaauuuugaaauuauggggggguggggggcgggaaagaauggagucaaacagguucaccagguuaaacaccguuuacuuuuagcaggugcuagcaucauuagaacugaauuuuuccaauuccugagauacauauacuaggcaaguugauacuacuuucuucuuacaaauguagaaacuaaggcucagccacauuuuaacuaauuugcccaagaucacaggcuaguuuugccuaggacuugaauucugguuucuacuuuuaacaguuaaguucuugccucuugguuaaaugaguauguaaguaaaauuuggcaaguauaggcauuauuuaugucagauuuacaauauuauggcaaggauaugcaugaccuuuaaauccugacuauaagauuguuucuuaccaggaaccuuuaacuuugaauuuuuuuuuuuuucuuuuuuugagauagagucucacucugucgccuaggcuggagugcaguggcgcgaucucggcucauugcaagcucugccucccagguucacgccauucuccugccuuggccucccgaguagcugggacuacaggugccugccaucacgccuggcuaauuuuuuuuuuuuuguauuuuuaguagagaugggguuucaccguguuagccaggaaggauggucucgaucuccugaccuugugaucugcccgccucggccucccagauaacuuugaauuauuaaaccaaaacaggccugauagaaauauacugucuuggauugaguaaauagauuauauuuauaauauuaugcacuaagccucacaagaaguuauauaugaagccaggauguuuguauucuuuuuuuuuguaaugaauaucugauucucugaaaaccucuuugguaauuugaauauugucauggagcucuucagugacuuaaucagccaaacuagaauuucuaaugacuuuugacucuuggaauauguacuuuuuuuaguuuagugaaauaaaaaaucuuaagauuuccugguuaaacauuuaaaaccaaaaaguuuggucuucugccaccccuauacaacacaggugacuuugcccaaguauugacaaaucuuugaguggguuacccacuagcagagaccaaaggacaaugcuaucuuguaagcaaugacagcaggcuuguuaaagaaaaccuaaguuuuuguugguuucacaggaaauugaauacuugacaauucuaacaauaguagacaaaaguauucuuccccugccccgccaaucaaagagagacuuccuuaauucacauggaaguguauaggugcuuuucuguaacaggcagcuuccugccaucugaugauaaaaugaucaaaacgcuggccuguccuuguagcuggcuuucuaucucagaccagcgaaaaucaucgcuggucucuagugcauugcuuacaaugcucuuccauguuugugauacucagguuuucuaugcuucccacuucuuucugcauauaccaacccucaagaguauuucucccucugucauguaacuauuugaaaucuugagggcuucuauaauggaagcuaguggaaacaagacauucgaaauacaaauuucauacaucaaagaguuuuaaagauuuagauucaugagcuuaugaaaucuuauuuuuaaacuacuuuacauguuuuaauauguaaauuauaaaagcaaauauuuaaauauguuuauuuguuaauguaaguauacaguuucuuagaauugaaauuguuacaauucuauuaaaugcuauccuuuuuguuuguuuguuuuuaagguaccaguauuuuuugcaaauuaaacaagacauucuuacuggaaggugggcucuuuaaauuucuuaaaaaauuuuuuguaauggacuuuaaaaauacuuuuuaaaucuguguuaaguaauucauggucauugcaaacaaauuauuuaagaagguuacauguagugugaauuccuuucaucagauaaguuuauuucuuaacaguuaaaaucaaaucacaugaaacuucaagugugauuguuuaacaaauuauagcacuuuugaaauugcuauguuuaaccuucgguuguguauuuuuguuuuguuuuauuagauuacccuguccuucuaauacugcugcccuuuuagcuucauuugcuguucaguguaaguaucagcccauuuuuaggucaaauagcauauaacugugguuuguguugcuaguacauuggcuucaaugugggaguucuuuagaaauguugcuauauagaaaauagugacugcaguggaaauguaaugaaaucuccaguuaguuagcaauuacuaugauuuuugaaaaaauuuccucugaaauugagaccaagaagaauguuaaauggauugcuguggcuugcuuaagugguuauauuagaaacauaaguauuuuacauccagaaauagaauuaauggcaucgcugauuugacuauaauaauuuaaaaauuuguuuauuaaaaugugaauguuuuccuuucauuauuagcugaacuuggagacuacgaucagucagagaacuugucaggcuaccucucagauuauucuuucauuccuaaucaaccucaagauuuugaaaaagaaauugcaaaauuacaucagcaacacauguaagaguuuuuuaguuuuuuauuugauaaacuucuuaauggcauucuuucuagagaaauguuugaaauucuaauaugauggcuguauuuaauauagaacaauuacuguuaccuaaaauaauauuaucauaaagaaauauaggugaucuaugcuaaaaaacgauuucauagaauauaugaagcucauuuucauuucuauucagagccauuaagcuaucuguaaacagauauuuauuugcuauuguguaauagucuaaauaauuuuagaauauaaacaguauagucacaauauagagaucagucugcuuaguaauucuuucucaguuuuuagguauaaaggacuugauucuccuugguagugagccaagaggagaacaggaacucuauauaauacugaauuaauuuuuaaaaaauauuucuuuaagaacaguacagguugaacauccuuaacccaagaguuugaaauucagagagcucuaaaauuuaaaacuuuuugagcacugacauuacaccacagugggaaauucugcaccugaucccauguaauggguuucagucaacauucggugaaaacuuuguuucauacacagaauuauuuuaaauauuauauaauauuaccuucaggcuauguguauaaaguguauaugaaacauaaauuucauguuuagacuugguuucuauaccaagauauugcauuaaguauaugcaaauauuucaaaacuugaaaaaaucugaaaucugaaacacuuacgaucccaagcauuucagauaagagauacuuaaccuuaucaauauucauucauuaacaauauucauucaacuuugauuuuuuugugugaguauaauuuuauauauuauuuuuucaaaagagauuuguugccuugaauagaaaguaauauuguuuauugguucagaauucaguugugcuucaauauacaauucagaauacucagggaaaaacuaaggcaguguugcguauuggcuaagagucugaacuaaagagccagacugccugguuugaaauucuguaagauuacuuacuaucuuauaaccuuggccaaacuguuuuaugccucuucuucucuguuuccuuacguaaacuggggauaauaaaaguaucuaucucuggaguuacuguaggucuuaaaugaguuuauauacauaagguucucaaaaccauacauagcacauuguaggcacugaagaaauguuagcuguuguuauuauuaagaaaacuuacuuucuuuuacuaauaacucauguaucuaaaacaggauaacaaaccauggccauugaaacggagucucgcucuguugcccaggcuggagugcaguggcgcgaucucagcucacugcaagcuccgccucccggguucaugccauucuccugccucagccucccgguagccaggacuacaggugcccgccaccaugccuggcuaauuuuuuguauuuuuaauagagaugggguuucaccguguuagccaggauggucuugaucuccugaccucgugauccgccugccuuggccucccaaagugcugggauuacaggcgugagccaccacgcccagccccuauugccuauuuuuauauggcccacaggcuaagauuguuauguagauuuuaagugguugcagaaaaucaaaagaagaauagcauuuuguggcaugugaaauuuugugaaauucaguguucaugaauaaaacacuuacuggaacacagauacccucauucauuuauauguugucuauggcuguuuucgcacaauggccaagcuaaauaguugccacagagacuguauguccuaaaagccuacaauauuuacuguccagcccuuugcaauaaaagguuugcugauuccugaucuaaaauagacuaaugacugaguuuuuaauggacuaccuaauguggugagggggcuauuuuaaucuaaguaaauuccauucauagugaaaguuauacauacagcauaucagaaucaagaguuugaagauaagccagauuuuuuuaaauuuaccgauaaugaaaagacucuuaaggaaaagcuuauugauuauauauaucuauuugguuuaaguaaaugauucaucagaucuuuaaaugaagaaaaacagaaguauccacuuuaacuggagggaguauauauuuaauuuaauuuuauagaaauuggaaguguacuguuuuuuuugaggagucguguuaugaucaugcauuagcgggcuguuggcucccuuuucuaguagcauuagugaauagaaaguuuguaucuuuguuuuuguaauuugcugcuuuugcucugcuguagucugauaauaacagauaacuaagguuguaaaaacuauaugugaaauaggaguaaaucuauuuuuaaaggccuuacauuuagagcaaugguucuucaacuuguguuuauaagaaucacuugguauucuuguuaaauauaaacaguuuugaccucauccuuucuaaaucagacucuacagaauagucuucuuaaaccaucugugaugaaagaugauuucuuccccccagcugucauuauuguguuacuuauauuuuguagaauauaauaaaaauuaauuacuagaaaaauaaaguggagaaagaaaacaaagacguaaaaaauacaaguccucauuuguuuguuuuuuuguuuuguuuuuuugcuguuagauuuaacagauauuacccaggcagauugcuauacaagccuccaacacucagguuccauacugugaaucaaccucugucugugcaccacacucugagaagcacugcccuggagguuggcuuagaaucugcaaguuucagagauauccugugugauuuaaaugcagauaugguauaugaaccaaauuuugagaaauacugcuuuuaaguuauaucuaaaagugagggguuuuguuacagucacccauauaaauagugaggagcuuuaaaaacuugguguauucuuguauuucuagaaaauaagacaguauucuggaaaauaauaauuuggguuacugaaaaugugcccuccagauaaguuagaggaguaguccugcaugguguuucauagauuuaauuagacugcucaguuuuuucagauaaauagccuuuuucuaauuuagccauauuuauuugauugauugauugaucucauuuuuaacuuaaugaugucuuuauagaggcuuaucuccugcagaagcagaauuuaauuaccuaaacacagcacguaccuuagaacucuauggaguugaauuccacuaugcaaggguaagugaagaaaacuuacuuugauguuguugaguuaggcuccguuacucaauauaacauuuuuuaagauuagauaacaaauggaauaaguuaugauugcugcugacacagcugcacugaaaauuuccucugaauuuaaguauuuucacaauaacuuaagauucaauucccgaaugugaaggaugguuaauguggauucuucaagguaguguuuuauauguaaagauaauuuuuacagaccguaagauauaguaccuuuagaauauuuauuuuaaaauauaauuguuaggcuauaggaaaaguggcuuuuguauacuuuuauaauaaugaucauuaaaaauguucucacaucacugaggccuguauuagugcacuuacuuuguuuucaucauuuaaaagcacuauuacgaguuuuuauuuauaaagcacaacauggagcauauuaacauuuuuaucuccccccaucccuguagugaaguggaauuuauagucacugacuuuuucuauauuauaccgugugacuucuuuucccuugugucaaacauugcugccuuugaaaaacugguaaccuccuggcauaagcauauuugugaguguuuauccuguauuuguguguuuccucauguuuuucuugaguucucuaucaaaaguucuuggaguacagcuauucuauacccagugaaaaguggaauuauaaucaucaguugaguuggugauagcguuuaucuucucuuggaaaugaauaguugagccuaaaaaggauaucaaccugaaagagaauucagagccaauauuuuucuuagauaauuauuuucaaucauguuaauacucagacacucacagguacacagauaguuguugaaguacucaaaguucuacuucauguaaugguuuuauccuuuaggaccuuaccugaccauguucugggagaggaacauuaguucuuauguuucacaaagcuuaugucaaucuuuccuuuaaaagaccagaugaauugcuuuccucacaugauuuuaucuuguaauucugaguguuacuuggaaaucuuuuugucugauuccauuuaaaaugugucucuuagaaaccuucagcuuucuuuuuuuuuuuccuucaacuuuuauuuuaaguucaacuuucugcuuucuuuaaaauaugccccuuuauuuuccuuccuuauuuagggccuauaucuuuugaacaugauucuuaaaaauguaauguacuggucaguauuuguguaacuaguuuguuuuuuauuauaauaaaguuuaaaacagauggaacuuuaaauauaugaauuaaacuaugguuaaaaauaaaaaggggcugggcauaauguaucaugccuauaauccgaacaccuugggauggcgaggcaggaggauuguguaagcccagguguucaagaccagccugggaaacauaaugagaucacaucucuacaaauuuaaaaaaugaccugggcaugguggugcaugccuguagucccagcuacucaggaggcugaggcaggaggaucagcugagcccaggagucuaaggcuucuguaagcuaugaucaugccacuucacuccagcuggggugucagcaagauccuguccuuucuucuaguauuuuuauaguuucggguauuacacuuuagucuuucauugucuugaguugauuuuuguauaugguaagagcuagauguccaguuuucuuccucuguauguggcuaucugauuuucucagaaccguuuauugcagagaauguccuuuccccaauguaaguucuuguugacuuuguugaagaucaguuggcuguaaauauuuggcuuuguuucuggguucucuagucuguccuauuggucuguguguauguuuuuauaucaguaccaugcuguuuugguuacuguagccuuguaauauauuuugacaucagguaauuugaugcuuuguucuuuuugcuccggauugcuuuggcuauuugagcucuuuuuuguuucuauauuaauuuuaggauuguuuuuucuaauucuaugaagaacgauguugguauuuugauagggauugcacuggaucuguagagugcucuggcaauauggucauuuuaacaauauuaguucuucagauccaaaggcaugggauuuuuucuauuuguuugugucaucuuaaauuuuucaucaguguuuuguaguuuuccuuguagagaucauucaccuucuugguuaaauuuauuccuagguauuuuuuguagcuauuguaaaugggauugccuucuugauuucuuucucagcuagaucauuauugauguauagaagugcugcugauuuuuaauguguugauuuuuacugaauuuauuuaugaaaucuaagcauuuuugguggagucuuuagguuuuuuuuagauauaagaucauaucaucagcaaaaagaggccauuugacuuccucuuucccaauuuggauaccuuuuccuucuuucucuugccugaguguucuggcuaggacuuccacuacuauguugaauaagagugugaaagugggcauccuugucuuuuuccaguucuuagggggaacaauuucaacuuuucuguguucaguaugauguugacuuuggguuugucauauauggcuuuuauuauuuugagguauguuccuuuugugcauuuguugagauguugaaguuuuucaaaugcuuuuacaaugucuuuugagaugguuauaugguuuuuauucuucauucuguucuugugauauaucauguuuauugauuuguguguguugaacuauccuuacauuccugauauaauguauuguaucugauugugguguauuaucuuucuaacaugcuguuggauuugguuugcuaguacuuuguucaagauguuggugucuguguucacuagggauauuggccuguaguuuucuuuuuucuaguuuuugcaucuuugucugguuuugguaugaugcuaaugcugaccuuauagaaugagucaggagaauucccuccucuucaguuuuuuuuggaauaguuucaggaauguuauuacuucuuuguguguuugguaacauucagcuuugaauccaucugguccugggcguuucuguguugggagacuuucuuuacugauuucaauaucacuacacauuauuggucucuucagguuuucuauuucuucuugauucagucgugguagguuauauguuuccaggaauucauuuccucuagguuucccaguuugucagcuuguaguuguucguaauagucucugaugggcugggcacaguggcucaugccuguaaucccagcacuuugggaggccaagacgggcggaucacgaggucaggagauugagaccauccuggcuaacgcggugaaaccccgucucuacuaaaaauacaaaaaaauuagccggucgugguggugggcaccuguaguccccacuacucgggaggcugaggcaggagaauggugugaacccuggaggcggagcuugcagugagccgagauggcgccacugcacuccagccugggcgacagagagagacucugucucaaaaagaaaaaaaaagucuugaugaucuuucguauuucuguaguaucaguugcagugucuccuuuucauuucugauuuuacuuauuuggguguucugucuucuugguuagucuagcaguuuauuaauuuucuuuaucuuuuugaagaaccaacuuuuuguuucauuuauccaucauuuuuuuuaugaucacuauuucauuuauuucugcucugaucuuuguuauuucuguucuauuaauuuuagguuuguuuuguucuugcuauuccagguuuuugagaugcauuguuagacuguuaacuuguaaucuuucuccuuuuuuuguguaggcauuuauugcuguaaacauuccucuuaucagugccuuuguuguaucccacagguuuugcuauguuguauuccauuuucauuuguuucaaagaauuuuuuuauuuccaucuuaauuucuuaauugacccaauggucauuuagaagcauguuguuuaacuaauuuguugagacuuguuuuguggccaaacauauggccuaucuuggaagauguuccaugugcuuaugaaaauaaugcauauucugcauuguucaguggaauguucuguaagugucuguuugguccauuugaucuaauguucaguuuaaguccaauguuucuuuauuuuuuuucuagauuugucuaaugcugagagugagguguuaguccccuacuauuauuguauugcagucugugucucucuuuagauccaguaauauuuguuuuaugaaucuggguacuccaauguuuggugcauauauauuuagaauaguuauguccucuuacuggguugaucucuuugucauuauauaaugaccuucuuugucuuuuuuuuuuaacuguucuugaaauaauuaaaaucuguuuuaucugauaaaagcugagguacuccuaacuucucauuuucauuuguauggaguauuuuuuuccaucccuuuauuuucagucuauauguguuuuuaaugaaaaagugagugucuuuuaagcaacauauaguugaauuauguauuuuaauccauucagccauuuuguaucuuuuaagaggagaauuugaucuauuuacauucaaaguuauugguaugugagguuuuguucuuuucauauuguuaauuguuuucugguuauuauauguauucuguguuucuuucuuuuucucuuauagguuguuguuuugauggguuucuguagugauacuguuugaguccuuucucuuccuccuuuauauuucuuuacccauuaaguuuuauacuuuuguguguuuucaugaugguaaaugucaucauuuuacuuccaaguuuaggacuuucuugagcauaucuuacagaacugaucuagugguauagaauucccacaggauuuauuugucugugaaugauuucauuucccuuucauuuauaagugauaauuuugauggauauaguauucuggaguggcagguuuuuucuuucagcacuuucaguauaucauucuauugucuuccggccuauaaaauuucugcugagaaauucacuguuagacuggugggauuuucuuuauaggugaugagacacuucugcuauuuuuaggauuuguuccugaaguuucacuuuagacagucugauuauaauguuccaugcagaacaccucuuuacauuauuaucugcuuggggguacaaguaacauguaaauuuggucaccuuaucuugccucaaauuucaggaaggcuuugcucauucuuuuuucaucucuuuucuuuauuuuuguuugacuggauuauucugaaagaccugucuucaaguuccaagauucauucuucagacugauguaggcuauuguugaaguuuucaaauguauuuugaauuuuuuucagugaauucuacaguuucaguuuuuuguuuguuuguuuguuuguuuuugagacggagucuugcucuguugcccagguuggagugcagucgugugaucucaggucacugcaaccucugccucccagauucaagugauucucgugccucagccuccccaguagcugggauuacuggcgcacgccaccaugccuggcuaauuuuuuuuuauuuuuaguagagaugggguuucaccacguuggacaggcuggucucgaacuccugaccucaggugauccacccaccuuggccucccaaaaugugggauuacaggcaugaaacagcuucagaauuuuuauuagguucuuuaaaaaaauaucucuuugguaaauuucucauucauauccugaauaguuuuccugacuuauuuguauuguuuuucagaauucucuugggucucacagaccuuucaagucaauaauuugaauucuuuauuucaugcugggauuuugaacuuuucuuuuugauuaagaucuauugcuggagaauuauuguauuccuuuggagauaccauauuuucuugcuauuucauguuuccugugugcuuacauuguaucugugcaauaguugcugcugcuuauauuugaauuugcuuuuguaggggaggacuuuuuccugaagauuuaucugugguuuggguugaguaggguacauagacuucgauucuggcugcaugcaguaauauggucucauuuauagauaucguagacauagcagugaguaaaguagauaaaacugaacccucccaaagcuugcauucuguggggcaagaaacaaaacuauaaaugaacaauuauggguauaucagaguauguacuauuugauuccauugaaguucaguaacuagcaaaauaccagccuauauugauagaagucagaauagcagucaguucuggaggaauguuuauuaacugggagacucaugagggagcuuucuggauuuuucaaaauguucuauauauugguuugugaugguuauguuggaguguaaauagguacguguauguauguguguaaaauuuugaguuguacauuuaagaaaugugcauuuuacuauacaguacuucaguucuuuuaaaaaauuaagcaggucauacaucagauauugauagaugcuaugaagaaaaguuaagcugagaaaggggaauuaagacaaacaaaugagggaucagggaaggucucacugagaagguaaacagaucugaaagagccaugcaaacaucugggaggagauuauucuaagcagaggaaagagcaaugaaauaguguauauagcaguucaaauaauagcuaagaguuuaguguggcuuguguagugcgaacaaggagaggagaguauuagggcaugagaucaaagcagacaagaacuuuuaagacuuuuuuuuuuuuuccuucuuucuuucuuucuuuugaggcagagucuugcucugucauccaggcuggagugcauuggugcaaucucagcuuacugcagccuuggucucuuggguccaagugauccucccaccucagccuuccauguagcugggaccacaggcaugugucaccaugcugguugaauuuuuuuuuuuuuuuuuuaaguggagauggagucuugcuauguugcucaggcugaucucaaacuucucagcucaagcaauccuaccugccucggccucccaaagugcugggacugcagacaugagccaccacaucuuuauaaaacauuuuaaggacuuuggcuuuuaauuauaaucaaaaccauuagagaguuuugaggcaauaaaagacauguugugaauuuacauuuuuaaaauauaacaaugacuuuuguuuugagaguauacuauaagauacuaagggaagagacuguuggagugauccaggugaaagguaaugguucuuguaguauuggggugguggacaguaaucagauuuugaauauauuuugaauauggaagugacagcuuuuacucauguguacuggcuaugggugugagagaaaaaggauuugguaauuauuccaaagcuuuuggccugaacuuuuacuaaguugggaaagaccugggagaaguagauuuaguagaagcauaagucaagaauuuaucuugggacauguuaaauuugaagagacguaaauccucacgaaagagggguaggcaauucaauuuauagaccuggaguugagaggaaaagucuggacuagaaauaauacauuugggaauuguuagcguauaguuaauaguuaaaaucaugagaugagagcacugaggaaguaaauuuaguagauguugaagagaacagguccucaaaguuagaacacuucaauguuuagaauuugaagagaugaagaagaaccaggaaagagaaccaagaaggagcagccauucagaaaggagagccuuucuuucuaucaaagacacaaaugugugucucugaagccaaguaaaucaggagcagucagcuuugucagaugaugcuguuaggucaaauaaaaugaggacagagaacuggauuagaaaaguggaggucacuggugacuuuucaagagcaguuuuggaggugcagugauggccaaagagugaugagagaauaugaaaaaaaaaacaaaaacggagaacaguaauuuugagggcuuuugcucuacaggacacagauaauaauaagaggaaacaccuauauagcauuuacugcgugccagccauccuucuuagggcuuuauguauguuaaucccauuuaauccuuacaacagccuugugaggcaggaguauuauuaucuccacuuuacagaugaggaaaaugagacacggaaaaguuaaguaaugugaccauauaaucccuauuucuguauuaagagccaauuuauagcuucuuuccaaaaccucauuuuuaaccugcauguauuugaagacuuuucgacagauccauuaaaauaaugaaacaauuuacaaauguaaucucuuggaacagagaaaggaacucuuuucucagauuggagcuauacauaugacuuuauccaugucacucuacuguacucaaaucacauagugguuuuccauaauucugaugugugcuuucacuuauugugacacagcauuauuuuauuuuuagucaaccaucuuucuauaucaagcaucuuuaugaaagcauaaauaggucacuaauuguuuucauuuucacugaauaauuuguuugcauucucauacuccauuaggccuauauaaagcauacaaacauuuuuuucaucauuaaugaauguauaagccuuuaugccuaacuacauuaaaaauagacaugaaaauuuuaaacaagugauauauuggaaaagaacauacugcuacaggauaaaagaaaauaauuucaacauauguuacagaaaauuuuuuaauauucauguuuuauaaagaguuccccaaaggaauaauuuuuuuacaacuuguaaguagaaacauauggcauacagauguaauaaacauuucacaggagaaauauaggugaucaauauuaugcacuugucacuaauaaugaaaacaaggagauaccaauuuuaucagauuagcaaaaguucaaaggauuaaaaauaacuauuuuuugccugaguaugggaaaguggacacucuaauacauuguugaaauauaaauuuguagaaaucuuuuggggggcaaauaugaauauaaucuuugcucacuuccauuacugaaacuccauucuuuaaaauauuuauagauguguuagaaaaaguuguauaaagauagaggaaaauauacaccaaauuguuaauagcgguuaucucugagaaugagggaaggaggcagggaaggugaugaggggagucuuugacuucuuauuugauauuugaaauuguuguauauuguuuugaaauuguuuuauaauugaaaguaauuaagaaaauuaacggcugucuccaccguguaaaauuaauguuguucuuauguacaucauaacauugaguggguuugcguuaucguacuguuaacaugugauaguagagaggucagaacauuuaaguacccuagguaauuaguuuguguauaguguaguagucuccaaagaaaggaggggauguugggaggccgagguggguggaucaccugaggucaggaguuugagaccagccuggccaaaauggccaaaccccgucucuacuaaaaguacaaaaauaagcugggcaugguggugggugccuguaaucccagcuacucaggaggcugaggcaggagaacugcuugaaccugggagcggagguugcagugagucgagaucgcgccacuggacaagagcgagacuccaucucaaaaaaaaagaaaaaggccgggugcaguggcucacgccuguaaucccagcacuuugggaggccaaggcaggcggaucacgaggucaggagaucgagaccauccuggcuaacacggugaaaccccgucucuacuaaaaauacaaaaaauuagcugggcgcgguggcgggcucagucccagcuacucuggaggcugaggaaggagaacggcgugaacccaggaggcggagcuugcagugagccgagauggcgccacugcacuccagccugggcaauagagccagacucugucucaaaaaaaaaaaaaaagaggggauagcggucuauacaccacaagagaaagugaaaugaacaauuaggguaugugcagaaaauguuagaacaucuguucauauucaguuuaaauaucauuuuuuuccugcucuuuuuaaacauacuguuguaaaauaaaacacagacagguauguauaucuuacugaauuacuguaaggcaaacauccuuguaacuaccaccuaguucaagugguagaauguugccaguuacuccagaaaccuuuucccaauaacagcuccuuccuacauaguauuuuuuuuuaaauaauuuuuauuacccaaaugugccuugguagaaacuguagcuuggucuugcuguuguuuaguuauuuuauuugacucacaguaacugagaucucucuuuuuaaucuacagguuguugcuucuucucuugugcuuagaauuuaccuguaaagcacuggauuauuuuaccuguaguuucuuacagucuggauuuuacuugaucacauauucauaauguaauucaacauaauuugcuguccucucuauuuccugcagauuggcagcuuaaucuagcagcauguucagauucaagauugaugucuguuauguucuuuuuucagguggugcauaaugccuggguuuugcucuuauucugugcuagcagccauuuaugcuggaugccuagauccauuaauuuauuggaagcagcaaaauggagauauccuaauauauuuuuguuuuuauuuauuugcuggaaugauuuuauaaagggucguuuucuuucuuuuacuauucaguuacccagugguauaguucauauagaaaacacauggaaaagaauguuugauucuuuuccuuuuauuuaccugguuuucaagguaaugaauaugaagugguggauuagauauuacugauaagauuuaauacaguauaauuauucuccuuauuaaagcucaaauuagcccaucuuuggucaccaguggggaguguucuucuuuuggcucguaaguuuuguuuuugaaacagggucucacucugucacccaggcugaaguauaguggugcagucucggcucacugcaaccuucgccuccuggguucaagugauucucccaccucagccucuuaaguagcuggacuaaaggugcacaccaccacacccagcuaauuuuuguuuuuuguuuguuuguuuuugauagagacgggguuucaccauguuggccaggcugaucucaaccuccugacuucaagugauccaccugccucagcuucccaaagugcugggauuacaggcaugagccaccacacccagccuccuaaguccuuuugacaugaucuuggucuagcuuugauagcuuuuaugcuaucuaguauuuuuaagauguuuugccacagacaugaaauuagccauuucuccaagaagcccuuuuaauggaaaaugauauuucaaaaaucucagugugggugcuaaggaugcuuauuccuacuggguuggucauuguuucuaggcuuuuuaagugaacagaguugggcauuugcuaguuucuauaucuauauugagauacacagaauauuuugguucuuagggcucaaagaauucuacaauucacauauccuauaauuauuuacuugcuucaugcuauccuguaauuaaagauaguacuuauaauuaccauaucaguuauuacuagaacaaugaaaauuuuuaacuuuaucucccauuuucuuucuuuuuucauaguugcucugaauuuacauuuucaagccauauagccacugcauguuauaaauucuccccuuuaauuaucauuuaaucauaguuccaaagauaacuacauaguuaaagcucaucacaaaucuuuauaaucugauuguguauuaaacauuuucuaguaauaugacuggcuaaguguaagcauaaaauuaccaucagaaaucaaauaacguauuugauaaguaggcucuuuggaggagugugaaaugauguaauuguuuguugauguuccaaguacgauccacagacuguugccagucuguaaacuguaguugguccgugaagagacacaugcagaaauuaaguguaagauuuagcuacuuuuauagcagucugacauaaagcauguuaguguguuuugcaaaagcaucaguagcugacagauuggaaacuuaaacaacaaaacauaacugguccuuuuccacauguaguuugaaagacacgguuacacacaaucucagcccuuaucucuacaauaauuaggucuuucagauaagugguuuaagaaacagauaaauaugagagaaacauguagaugugggcuaauaaaauuuuuacugagaagauggauguaagcuagacuuugguuugguuuggcuugauuuggcagggagauaugaucagagauaugagaacauuuuuaacacggaauugugggcacacaaaacauaucauaaaaauggccuggcuagaguagaagauuuuuaccaguuagggaggagagauuaaaugggaauaguuguauaaaggccuuggaucccaagcuaaacagcuaagacauuuucauacagacaauaauagggagccauucaugcugcaaaagaguacaagguacuuuuuucaaugccuacgagguacuuuuuucuaugccuaagaauccaauaaauagcucuacucucuguuacuuggguucuagugaauaauuuauuuauuagauuuauaguacaguauuaauaagugauaugaagaaaagcaaaauaagguauuuuaaauuaagguggucaaaguguauuuuucuagacauuggaauuaauaacauuugugucccugaaggcuauaauacuuguucucucguuuuaucuuacccaacucuaggaaugccuugggaacugccccuucagucuagauaucuauaauuuaaaacuugaguuccuacauauuucugaauauguuauuuuuuaaacuuguuuuucuacuaacauuguaucuugauuggcuucucuguuuauuggguuugguauaucucucuaaugguauuagcuuuccacaaauacuugaugauuuuugguuauguacugucuuuuguauuugugauuucugguucacuugguugcgaaugcuguuucucuuuacuguagccugccuuaugugaugguuaaggugggaaggaauacaaagccagcuacaaugugccuauaguuugccucuuucaguuugggguucuccauucauuccuucugaagauuacccuuaauucuaaauuuuuggaccuacuguccacaauugcuguuuuagacaggcuucacacuuucauuuccuauaguugaauccaguuggagugggauuaugggacuguucggaguuaauuaccacagcugcucccuaccugauuauccugacaguaauuugcaggccucucuuaauuauuuuaucuaugguaacugaacucguaccugaaaauuucuuuucuguuuuuuaccuccacauagagcagucucuuuccuacguaguuugggcugugguuuuaugaauuuuuuuuccucucaguaaaucuagucuuaccacuuuauaucuuuaaggauuccucaaaaugucugguccauugauaacauauguucauauguuauagauuguuuuuaaguauuacagauucuuuugcuuuauguauaucuucccuaauguauaucuucucuaauguuuuaugagguugggagcagauaggcuaauaggaguauauauuuacccuugcaucauuuaggcucagucuuaacaucuugauccaaacuucuaauugauguccuuuaaaacaugcuuuuuaauacucugauaauaguguacuaaaauaauguugauuauugcuagucaaaggcagccaugcaaauuaauauacacuguugcauuugaccauuuauguauuaccuuaccuaacagauuaauaagauuuuauuucauuagaaguuauugauauuauaaaguauuuguucuaggaagacaaugauaaaaucuaguuuauauuuuauuaauaaguucuaucuucugauuaaaugaaugguaggugguaaaagcgugccuccuguauuagguuacuuguagaaucuuuuaaauaaagaagcaaaaugguuucaagguaaauuagcaucuaagaaauguauuuuuauucuacccauucucucauuaguguagguuagcuauucaaauugggucauuuaguuugaaaacucucacucauucuucaaggcacaauucaaauguuauucuccggggucuucuaaacucucuaagaauuguucucuauuauauacucucaugauguuucuaauguauuauauuaguuauaggacgucucauuauguuguaaauauugcuuuauuggguuccuuuucaccaaacucugaauuccuccauguuuuauucauguuugugauguuagcaucacaguuacuuaguaaauggauuguaauacuuuuaggaaugguaaaaugaauacuaaggaaaaggucucugauuucugaauucuugguuccuauuccaaagagucaguucuagucauaaauugugggaaauccugagauccauuuuacuuuagauuaaagaauuuuaauaagacauuucaguuugguuuaaaauuuguucuuuauuuuuauuugguaauaaguaccauuuggguuucuaauuaguauucgguucuuugcaaccuuugaaaaugcaauguuuaguuuuaaaaauagaauccuauuuuuaaaauauaucucuaacaaagcccauaaauuuagauuuaucauguuuuuauucauuuuuuuugaaggaucagaguaacaaugaaauuaugauuggagugaugucaggaggaauucugauuuauaagaacaggguacgaaugaauaccuuuccaugguaagaacaucuauugauacuuuuauguuuaccacuguauuacuaaauauaauaauuuauauuaaaggcaguggcuguugaacuauuuuaauguugucauuuuacuugugagauaaacuuuauacuuuaucccacuuaguuagcaccuaccagaagacaccaaaaugguuuauuucaaaauuacuuuuuaaaaauuauuacuuaugaguuuuucuuuuauggaauuuuugaaagaugaucagagcuuuccagucuuuuuagcagagauuugcccccagggcaaauuguuuuaccagcaucuaaccaauauggguuuuaucagaguuuaaccaaaguaggagaauggaaauacccaauuuagaccccuccugcuuucuugucucaccuaaggagggguugaccugagaagcaccgaagaucgcagccaagaggcacagaccacuaaaccacuaagaccuaauuacaggaugaaagaaugauuccucccugucccacaccuuacugccacaucaacauggcucauaaauaauaacagggaaucacaacuaaaauaacuguaaggcucagauuguuuaggagucccuuagggaaaccugaagacagcaaggaugugaaaaacaaagauagagaaaauuacaaccucugacaccuacgguuuguacacaaacauuaaacauagucuuaugccuugccaggucuacauaaaacuucacaccaaaggcauauuuauuucuuucuuuuacccaguauaucauauccagcauuuagcaaaaaauuacaagacgugucgaaaggcaguaaacacaauuugaagaaacaaagcaaggaugagaaccagacccagauauagaagaaauuuuggaaguauuauaccagaaauuuaaaauaacuguaauuaauauacuaagggaaaaguauauggaaaaaguguguaacguacaagaacagacggaaauguaagcacagagauggaaaccuuaugagaaagaauuaaacaggagugcuagaaauaaaaugcauugcaacagaaaugaagaaugccuuuggucuuaucgguagauuauacacaagaaaaaaaugagugagcuugaagauaugucaauagaaacuucaaaaaccgaaaagugaugggaaaaaggaaugaaagaacaguauuuaagauaugugaugggaauaaagagagagaagaucagaagaaauaaauaucugaaaaaauaguggcugauaguuuuccaaaauucaugacagccaccgaaucacagaugcagaaaguucagagaauaccuagcagguuaaauaacccaaaaauccacacuuacacacuaucauagucaugcugcagauaaucagaaaaucuuuuaaaaagcaaagcauaaaaagcacauuuaaccuagaggaacaagguaaaaaauauguuguauuucucuucagaaaccauguaagcaagaagaaacuggagugaaauauuuugguuaaaguguugaaagaaaaaacccaccaaccuggaagucuguagcaaaguuauccuucagaagugaacgagaaauaaagacuuucacacacacaaacaaaaauugauugaauuuguuaccaguagaccugccuugugagaaauguuaaaagaaguucuucauagaaaaggaaaauaauauaagacaggaaucuggaucuacagaaagaaaagaaagcagagaggggacuucaagauggcugacuagagucacggaggcacuugugucuuccacaaagaaggaccagaucagcaaguagauaaacacacaaugaauaggacauuuaaaagagaacagaagaauucaacaaggaagugacagggaaccucugagacacagaaggagagggaagcaaaguagccagccuagccaggaucaccugagagccaggaggaauugcccauugcaaggaaaagguaagcaagagauccucaauaguucacauuugcaccaaagauuacugcaguccuucuuauaugagagaggcccuugacccucaugggccgugagacuagcauagggagcugccugaaguccacaccauggcauuguuucagagagggaguuugcacucccucuacacacccccuaagacccaggcaguugcaacacaaugccauuuugagagcucagaccccaucagaauacauccugcagugaggcccaguagcuccugcauuuccccacugacaacccuccauguccacacagagggcugcaaaguugcaagacuuaacugcacccaggauacagcuagguccucgagacuguaucucgugcaguguccuucacccuggggaaugggcagugcagugugccagggaggcuguaccugucauaaagggagaugaagcaugugcucaccacagccucagaguugccugcacagggacauuaccauugacagcaacucacauccuccggcagcaagaccacuguacagcugcaugugccuuuggggggcuaaguaaggacuggccuaucugagcacaccuuccagggacauuuauaugcccuguccaccgucaccagugauaacaucaagggccugaacagaggaccaucccagcugcuggcaccuguauauguuauucaugaaccuagagauugacccacuuagaacugugagggcccucacgugacauccaagggccugacgauagaugugccucgcccucagcuaccaccuccagacacuguuggagucuaggcauuggcuggccauaccugcagcugcugacacacacacacacacacacacacacaccuuucaggggcucaauaauggaccuaccuugccugccacuggcaccugugggcacuucccaggggcccagggacuggcucguccacccugccucuaccacuauugucccccacaugcauagcucaggaccccaagggauagcccacugauacugcugacaccaugcauaccaccuggagacccaaggacuggcaugcccagccugccaucaccacagcuggugcccaugaaccagccuaccuggcauuuccauccccaauacagcuucaccacaaccucuacacccuaagccacugaggaacucacagacaccucugacacugauuagagccaaauaaauaaugugaagacuaugcuacugcacccauccagaaucaaagccaaagcacccuauccagccaacacuauagguacaucacaagaaaaaguuuguuccuaugacagccaauucauaaaauuggaagaagcaccuguuacaccagaugugcagauaucaacguauaaggacagaagaaauaaaugccugaaaaauaaaauaaugauauuaaagaaaugcaaugauauaugacagcuugacaauacagagauaucaagaaaaccauucauaaucugaaugagaaauucaacugagagauauuuaaaaaaaaaagccaacaaauuuuggaacugaguucagugaaugaaauaaaaaauacaauagaaagcaucaacaauagacuagauuaagcaguaacaauaauuucugaacccgaagacaggucuuuggaaauaaccuaguaauuuuuuaaaaggcuaaaaaagccugaaugacaaauggaacacuguaaagcagccaaauauuugaauuuugaaaauuucagaagaguugggcaaaggcauaaaaaaaaaaccuauuuaagaaaauacuagcugaaagcuucccaacucuugcaagacguagagacguuaagauaccagaagcucaaagaaccccacagacauucaacccgaaaaggucuccuccaaggcacuucauagucaaauuuuuaaaaaucagagacagaagucuaaaaagagcaagaggaaaggaucaagucacacauaagggaaucuccaucagaccaauggcagauuccuaaucaaaaaccuuacaggccaggagcgaauauggugguauauucaaacugcagauaaaccaguagaaaugcugacugaggauacaucacccaagcaaaucuacccuucagaagugaaguagaaauaaagucuuucugagauaggcaaaaacugagagaauucaucaccacuagauggaucucacaagaaaugcuuaagggagucccuacaucuggaagugaaaggaugcuaugaacuaucaugaaaacacacaaaaguauaaaauucccugacagagcagauaagauauaucuagaguagaugagaaaaagaaaggagucaaagguuauuacuacaaaaaaaaaaaaaacaaauaaucaagggaaacaauaagaggaugaaaggaauaaaggauguacaaaacaaucagaaaacaauuagcaaaauaacaagaauagaucuuuacuuaacaacauugaauguauaugguuuaaguucccguuaaaacuuagacacuggcugaauggauguaaaaaaagaagaccgaauucuaugcuaccuacaagaaacucaacuucaccuguaaaaagcacaauagacuaaauguaaagggaaggaaaaaucccauguaaauggaaaccaagagcguacagaagcaguuauuuuagacaaaauauacuuuguaaaaaaccauaaaaagagacaaggucaauaucaaaugauaaagggaucaauucagcgaaaggauauaacaauuguaaauauguaccuaauacuggagcacccagauauaugaaguaaauauuguuaaagauagagaaacagacuccaauacaauaguaguuggggacuucagcacaccagauucaccacuggacagaucaucuagacagaaaacaaacauuggacuuaaucugcacgguagaccaaaggaaccuaauaaacauuuaaacaacauuuuauccaacagcugcagaauaugcauucuucaccucagcacgugaaacacucuucagaaaagaccauauguuaggccacaaaacaagucucaaaaaaauuuuuaaauaguaauuauauccaguauuuucucacaccacaauggaauaaaacuagaaaucaauaacaaggaacuuuggaaacuguacaaauacauggaaauuaaacaacacucuccugaaagacuguugggucaaugaagaaauuaaggcagaaauaaaaaaaauuauugaaacaaaaacagcaacauaacauacuagaaccugugagauacagcaauagcauugcuaagagagcuauuuauagcaauaaaugcuuacaucagaaaaguagaaagagcucaaauaaacaguuuaaugaugcaucucaaggaacuagaaaagccagaacaaaccaagccccaaauuuagucgaagaaaaagcaauaaagaucagagcagaacuaaaucaaguagagacuguaaaaauaauacaaaggaucaacaaauugaaauuuguauuuuuugaagugauaaaaaucaacuaacaacaaaaaaagaaaaaauuaucuaggugugguggcacaugccuguaguccuggguacucgggagacugaggcaggaggaucacuugugcucaggaguucauccugagugacagugugagaccugucugaaaaaaaagaaaagacagaaaaaaacuaccagccaguauuccuaaugaauauagaugcaaaauuccucaacagaauacuagcaaagcaaauucaauaauacgugaaaaagaaacauuuuucacguaucuacacgugaucaaguggaguuuauuuccaggaugcaaggauaguuuaacauacaaauaucaguaagugaaauacuuuauuacaucaacagauugaaaaccaaaaaccaugcagucaucucaguagacacauaaaaagcauuugauaaaauucaacaucccuucaugauaaaaacucucaacaaauuagguguagaagaaacauaucuugacacaaucaaggccauaagugacaguuccacagcuaacaucauacagaacaggucaaagcugaaagcuuuucuucuaagaacuaaaagaagacaaggaugcccacgcugaccacucuuauucaacauaggacuggaaguccuagccagagcagucaggaaagagaaugaaauaaaggccauccauauaggaaaacaggaagucaaauuguuccucuuugcagaaaaccugaucauaaagaaaagccugaagacuccacugaaagucucuuagaacuauuaagugaauuccguuaaguugcagggaacaaaauuaauguacaaacaucuguuacguuucuguacaccaauaauagcuggaaaagaaaucaagaacgcaaucucauuuacaguaccuaccaaauguuacacuuaggaauaaaccaaggaggugaaagaucucuacaacaaaaacuacaaaacacugaugggaaaaaauugaagagaacagaaaaaaaguagaaaaacaucucauacucaugaauuagaaaaauuaguacugugaaaaugaccacacuacccaaagcauucuacagauucaaugcaacaucugucaaaauaucaaugacauucuucacaggcauagaaaaagcaguuucaaaauucauauggguggggagccaaguggcucacaccuguaauccuagcguuuuuggaggccaaggcaagaggauugcuugaggccaggcauuuaauaccagccuacacaacauagcaagaccucgucucuauaaaaaauauuuuuaaaaauuagcugggcauaauggcauguauuuguaguccuagcuacuccggaagcugaggugggaggaucacuugagcccagcacuuuaaggguuacagugggcuaugaucauaccacugcacuucagccuggauggcagagugagacccuuucucuauuaagaaaaaaaaaaauauuguauggaacccuaaaagauccugaauagccaaaacaauacugagucaagaggacaaagauggaagacaucaaauuauccugugaagcuacaguauucacaacagcaugguacugguauuaaaauagacacauagacccaacagaacagaauagagaacauagaaauaaauccacguauuuacagccaacugaauuuugacaaaggcaccuagaacauagaguagggaacagacacccuuuuccauaaaugguacugagaaaacuggguaucuauugcagaagaauggaaccagacccuuaucucaguauauaaaaaaucagcuccaaauggauuagagaguuacacguaagaccugaaacuauaaaacugcuaaaugaacauagaggaaaugcuucagaauacugaucuaggcaaagauuuuauggguaggucuuuaaaaguacaggcaacagaaagaaaaauagucaaaugggacuaucaaacuaaaacgcuuuuacauagcaaaggaaacaaucgacagaguauagagacaaccuauagaacuggagaaaauauuugcaaauuguacauccaacaagggccugguauccagaauaacaaggaacugaacagcaaaagccagcccaauaauucauuuuuuaaaauugacauuucucagaaaaaagacaugcaaauggucaaauugaagguuuguggcaacccugcaucaaacaacucuguuguugccauuuuucugccagcaugugcucacauugugucuuugugucauauuuugguaguucucacaauaauucaaaguuuuuuauuguguauguuauuguaucagugaucuuugcucuuaguauuauaauuguuuuggcaugccacaaaccacacccauauaagacagcuaacuuaagugauagauauuguauuguuuguucuuucugccccacugacuggccguuucugucucucuuccucuccuuggaacucccuguucacugagacacaacaauauagaaauuagaccaauuaauaacccuucaguggucuauaagugaucaagugcaaggaagaguugcacuucugucacuuucgaucaaaaauuagaaaugauuaaguucagugaggaaggcaugucaaagucaagauagaccaacagcuaggccucuugcaccaauuagccaaauugugaaugcaaaggauaaauuuuugaaggaauugaaaguacuacuccauugaacacccaaaugauacaaaagugaaacagccuuauuguugauauggagaguaucuuagugguguggauacaugaaaccagccacagcauucccuuaagcuuaauccagaacaaggcccuaacucucuuuaauuaugugaagacugagaagagaggugagaaagcugcagaagaaaaguuugaagcuagugcagguugguucaugaggcuuaagaaaagaggucaucuccauacauaaaaguucaaagugaagcugcagguuauacagaauaucuagcugucuggcuaagugaugaauggcuacacuaaacaacagguuuucaauguagaugaaacagccuucuauuggaagaagaugccaucuaagacuaucauagaugaaguuaauaccuggcuucaauguuucaaaggacugacugacucucuuguugcggaauaaaguugaagccagugcucauuuaccauucuguaaaugcuagguccuaaaucuaccuuaccuguguucuagaaauggaacgucaaagccuggaugaccacacaucuguuuacagcauagcuuacugaauauuuuaaguccauuguuaaguccuacugcuuagaaaaagauuccuuucugaauauuacugcccauugacaaugaaugcaccuugccacccaugagcucuguuagagauggcaaggaaguugaugcuugcugucacaauaugaauucuguagcugauagaucaaggaguaauuuugacuuucaaaucuuuuuuaagaaacauauuuuguaaggcuguaguggccauugaggaugauuucucugauggaucugggaaaaguaaguugaaaaccuuuuggaaaggauuuaccauucuagaugccauugagaacauucaugauucaugguagaaggucaaaguagcaacguuaaccggaauuuugaagaaauugauuccaacccucauagaugacuuugaggggguuaagacuucaggggaggaaguaacuacaggugggguggaaauaacaagagaacuauuauuaaaaguggagucugaagaugggguaggggaugaauugcugcaaucucaugauaaaacuugaauagaugaggauuugcuucuuauggaugagcaaagaaagugauuuuuugagauggaaucuacuauuggugaagaugcugugagcauuguuuaaaugacaacaaagaauauagacuauuucaugauaaagcagcagcugggugaagaggauugacuguuuugaaagaaguucuaguguagguaagugcuaucaaauagcauuuggcaauguggucuugccacauuguggcaagacccuccaccaacaaaagauuacaacuccugagggcucagaugaucauuagaauuuuuuauaaauuacucugauuuuuuauuauacaacuuguuuucauuauaguauaucgaacucuuaauagacuacaguauaguguaaccauaacuuuuauauccacugagaaaccaaaaaauagugugacucacuuuaucacaguauucgcuuuaguagucuggaacuaagcccucaguaucucuaaaguuuggcuguaccaauauccagaaugaaaggggauagcauuacagacccuacauacauuaaaagcauaauaaaaucauauugugagcagauuugaauguuugaauauugauaugguuuggcucuguguccugcccccuccuccacuaaucucaccuugacuuguagucuccauaauccccaugugucaagggugggaccagguggagguaguugaaugauagggacaguuucccccauuguguucucaugauaaugagugagucucaugauaucuguugguuuuauaaucaucuggcauuuccccugcuugcacuucuccuuccugcugccuugugaauaaaguaccuugcuugcccuuugccuucugcugugacuguaaauuuccugaggucuccccagccaggcugaacugugagucaauuaaaccucuuuccccaauaaauuacccagucucgggcaugucuuuauuagcagugugagaauggacuaauacaaguaccauuaauaaauuucacaacguagauuaaaugugcaaauuccuugaaagacacaaauuaaaaaaugaccugagaagaaaagaaacuugaauagaucuguaucuauuaaagaaguugaaauuauaauuagaaaccuuuugaacauuagaacuccaggccccuuguugugaauucuaucgaacauuuaaaguagaagugaggccaauuuuacauaagcucuuuuagacaauaaagaaggaacaugguuuaugugauuauuaccuugauguuaaaaccagacuuaagaccuuacaaggaaagaaaacugcaguuacucaugaacauagaugcaaaaauaccuaauaaaaguuuagcaaauucuauccaguaauauauaaaaaugacaauucaucauguucaaauggggguuauuuuaagaauauaagguugcuuuaacaucugaaagucagucaguauaauuaaccauacuguuauaauaacauagaaaaaccauuugagcauuucaauagaugcagaaaaagaauuugacaaaauugaccauucaugauuuaaaaaaauaaagacauagcuaacuauaaauacaaggcacuuucuauuuugauuaagggcaucuacaaaaaaucugcuaauauuauacaaaauggugaaagucucaaugcuuuuuauauaagaugaggaaaauauaugcuucaucucacuacuucucuucagcuuuguacaccagguccuuacuaguguuuuaaaaaaagaaaaaggaaaaaggaauaaaaggcaaacaaauggggaagaaaaaaguauaauggcuuuccuuguagauaagaauauauauauagauuggcugaaaauaaagagauaaaaaagguauaccaugcaaguaguaagcauuaaggagacuagaaugacuguauuauuauaauauauacaaugguccaaccagucuagaaaacuguucuguaguuucuuaaaaaguuagaaauaugucuaccauaugaccuagcuguuucacuccuaccugguauuugaccaccagaaauuaaagcaaauguuuguacaaagacuugcacacauguguucaaagugacuuuauuuguaauagccgaaaacuagaaacaacuuaaauauucaucaugaagugauggcuauuuccauccauguugugguauauccauagaauggaaugcuccucagcaaaguggagaaaagauuuagugaaaaacacaaugcagaugaaucucuaaauaauuaagcggagugacaagacagaugaagaaaaauacauacuguaugcuuccauuuauauaaauucuagaaaauucuaucuguagggacaaaaaguuggucagugguuacguaggcgggauggguugcuguguuggaguucuagaggaggaucacuguguggcggaaggaaucuuuuggaagugauagauauguucacuaucuugacugugaugaugguuugauaaguacacauguaugucacacuuaccaaaguauauacuuuaaauaugugcauuuugcaugucaguuauacauaauaaaaugcuuaaaagggaaaaugaaaagaugcauuggugguauaaugaugagccuagcugcuuuccaaaaccaugugaaaguuaaucaguaaaacaguauaaaauaguuauaugauuacauaauuggcauuccaguagaaacagaaaacuuuggacaaguagcaaaaaaaauuaugguagagauaaauccaaguauguuaauuauuaucgaaacuguaaauauguuggauauucauauugaaaacaucaaacugaauuuuuaaaucacuauugauauaaucuauguaccauaaauuugccuauuaaaguauacaguuuagugguuugugguauaguuucaggggcagcaucaccauaaucuaauuuugaaucauuuauauuaccccuaaaagauaaccuuguaauuauuaggagccauuuccuguucuuuucuaugcuuuuuauuugccagaagucuuaggcaaucacuaaucacuaucauauaucucuauagauaugccuauucuauauauucuauuaauauugaaugagaucauguacuguguggucuuuugugauugauuuuuuucauucauuuuugagguucauccgcauuguaguauguaucaguuuugcuuuccccuuuauugcugaauaauuuuccauuuuaugguuauaccacauuuugauaaccaguucaccaguuuuuuccccuuuuuggcuggugagaauuauguugcucugaacauuuguacaaguuuuuguguggacauguuuucauuuuucaugaguguauauaucuaggaguggaauaccuggguuugcuaaacuguuuucaaacguggcugcaucauuuuacguucccaccagcauugcauguggguuuaauuucuccagauucucaccagcacuuguuaucugcauuuuuauuauaaccauucuagugaguauaaaguaguaucucauuguaguuuuuauuugcauuccccugcuggcuaaugauaaugagugucuuuucaaguacuuauuauuguuucauauauuuuggauuauucaaacuggauuuuuaaaaaucaaucugagccagaugcaguggcacacaccuauagucccagcuacucaggaggcugaggcaggaggaucacuugagccuaggaguuugaggccaggcugggcaacauagcgaaaccaugucuguaauaggauacauuuuaagauggcaaaggcaaaccuuaaacugaaauguaaagucauuguaaaaccucugaugucaagugaaaaaugcguaguaugucuaaugauuuauuaacuacagaaaggaauuguuccaguuaaaaaaaaaucaaucuuuauacuguuuacaagagacauaccuaaaauguuauacaaaaugacagaaacauugaaaaagauaaaccaggcauauagaagccaaaaaaacgguuauggcuauauuacugcuauauaaaauagauacuguuugaaagauuuuuaauuuauacauugguauuuuucugaaaaaacuuuguagcaaauacaagucacacacaauacauuuauaagaaaauaaaaguuauacaaaauauauauuaugccacagagagcauucagugaaaagauuuuuauucauugauugauaccuuccugggaauuuuugaaauuaaagugauuugaaacuggccuagauuuccuuucucuugaucauuuagaaaugaacaguguuuuuuguuguuuaacuucugaaauaucagugugucuucauaagauuuuuugaauugaggcaccuggcuuuuuuccauaaauacagucaauaguuacucaauuuuuuuuuuuuuuuuuuuuuuuuuuuugcuucuggaaauaaugcccucucucuaugacagaauauuuuucccaugucgagugaaagcucaguauccaaaaguaaaauacaaaguuuucaaaucagaaaccuaaacaugucucuucuucccuauuccaaacaugcaugcuugaaaaguugacucaugcauuugccucuucaagugauuaaagugugagaaguuuauucuuugagaaugcugagagcuucuuggauagauagggccauaagccauaaagauuaagacuuagaauuaucaugaaaauauuuacuuagaagacugagacaggauccugaaggacauuuuucucaguaagaaagaucaaaucucuuuagccuuauuacccuuaugucuuaaaguuuacaaagacuguguuuacuguguuacuuauuuuaugguuucaaugagacaaaaugacuuggcucauauugauuguacuaauaaggcuuugagaacgcuuauggcauuauguggguugcguuuaagaagaagggugguguacaaagguaaauuuuuaaaauuuaaugcuuuuuaaaauuaaaaguguuuuuaggguuguugcauaaaguaaugaaaucuuacauuuuuccaaggcuugcuuauaguuuuagagaguaaacaacuaaguuagugauaguuuuugaaauuuuaauuugugacaucuguuuuuaaguauuucuguagauacaaaauuuuccucaguugaacacaaauacuaauuauuuuuuccaugaagcaagaaaaacuuucaauucuuuauguacuauguguauguauauaugauaaaauguuuagauauuacuaaauauacacuuaaaacauuuuuucauaauuuguuaauauuuuuaucauuauucaauacuuugaauaauuuauugucuuuuguccagguugaagauuguaaaaauuucuuuuaagugcaaacaguuuuuuauucaacuuagaaaagaauuggugaguacggauuuaauaauuauugacauaaaugaagccuuuuaagaaauacccauucaugacagaacuuuucuauuauuaguacaagugaaagugcaauuaauacuguggauaacugcccgcugagguaaugaauucacuuguuauaacaaaauguacuuguuuuuccaguguguaugugguucuaauuuaaaguucuucuagauauuccucuugcuguuucucgagcuuagaaacugauuucucacacaugauguucauugaaaaccucaggguccauuuuugaagggcagcaaaugagcauuucauauaucccuuuuucccuacuaaaucuauaguacuuacuuucguauauaaguucauuuuauuuuaggggagcugaguguuacaaguucaugaacuuauaacacauugccucccuuuguuggagugguaauggcuuuauauauuauaaauaacaaauugaguugucauggaaaguacaguguuggaaauaauuucaucuuguuaaugauuuugucuguuucauuaaaucaaacuaaccuuauccuuugauguacauuauuucuuagaaaucugagaagucuuggcaaauucaugcagauuucaagaugguuguguguguauguguguaaaauguauuugaaaccauaaaaaugucuuuggggcuguccucaguggcucaauccuguaaucccagcacuuugagaggcugaggugggaggaucccuugaggccaggaguuccagaccagccuuggccacauagugagacacugucucuacaaaaaaaaaauggaaaaaaaaaauuggccaggugugaugaugugugccucuagucccagcuacucaggaggcugaggugggaggcucucuggagcccaggaauucaaggcugcaaugagcuaucaucacaccauugcacuccagccuggaugacauagggaggcccugucucaaaaaaaaaaaaaaaaaaagccuuuggguacagugguggcuucuaccuguuaucccagcuacuuggaaggcugagguggguggauagguugagcccaggaguucaaggcugcaaugagcugauugugccacuguaguccagcaugggcaacagagcaggacaccacugccucuugaaaaauaaagaaagucuuugaaucagcucuguuguauuggucuacuacgugauuauaaacuaugguuuaucguuuauguucauaaaauacagagggauuuuuuucaagagaauuuuuauugaaauaaaacauaauaccaaaaaugugcauauuuuaaguacacaacuugaugaagugaacauauccauaucagcaccuccaagauauguaguauauguaccgccuucuaauauguagaacuuuaccagcaccccagaugcuugaaauguugcugcuggagcugaugcccacuuccagucauuaagccuccuggaagguaaacauuacucucauuuguaugaccauggauuaguuugcuuauauuugaacuuuaaaaauugaaauuauacaguuguugucuuuacugucugccuucuuucccuuaauauuuuuugugagauucauccauguuguugcauauaacauuaguucguuccauuuauguaugguauuccucugaaugacuaugccauaaauuauuaauucauucugcugcuaguggacagcuuugccauuuccagguuggggauauuaugacuaaugcugcuaauggaaauuauuuuacauguuuuaaaauuuaggugauuaaaauauaauauuguuaucuggaaacuagaggacaaauauuuuacuuuaaguaaucauagauggcacuguagaagucaacuuuucuaauuagacuuauaauaauaucccaucauaauacuaguguuauuaauaauaguuauaauauccagccuuuauugagaacuuacuaugugccugguaaaagaccagucauuuucauaucacugaauccucacucucauuuucugaaguaguguaccaguuaaaaauguauuuaccaauaagugauaacagcaacaauagcuaacugacaauugauuaaagacaguauacagggauccuuuugugguucauaagcaugaugauuagauuuucaugcuauugggugagauaugccuuccucagacuuuguuacagcauaggcacauuacaaccugucugauaggagaaagaaaguaaagaugguauacaggccaggugcgguggcucacgccuguaaucccagcacugugggaggcugagguggguggauugcuuuaggccuggaguucaagaccagccuggcccacauggcaaaaccccaucucuacuaaaauacaaaaaaaugguugugguggcacacaccuguauuucccguugcuugggaggcuaaggcacaagaaucucuugaaccaggagguggagguugcagugagccaauaucgcaccacuguacuccagcccggacaacagagcuggacucugucucaaaaaaaacaaaagaaaaaaggaaaaaaaagacaguauacaggcauacucugcaaaagguggccuuguuaauguuuucucucuaaaacaucuuuguuuuuaaauacccaaacuucauacgauauacuuaucucucaguacaaauuuuuuuguguguuguuuagaaauugggcaagaaaaauuuuuguuacauuucaaauauaauugauagaauauggaaauuacuuauagacuuuuugaaaaguauaccaagugucaaaaugggugaauauguaugcaucuuagaugcugacagugagaagcuucagugcaucauaguagcugagacauuuucuguuauuuuguguaauguuuguggcauaugguaaaacauaugaacuauauauguuagugcaaacaaaacaacuauuaaccauaauuaagacaauuuucuggcaaucaagaagugauguuuuaagcauauucccuucuaauaugauaguuuaauacuuuauacaugggcauuuauuuguguauuagucacaggaaauaucuuaaugaccuuuugaugggcaagaauuucuuuaaccggacauagaaggaaaccuucauacccuuaaaagauugaugauuuggacuauguuaaaauuaauaacucuguucaucaaaagauaucacuaagagagugaaauaguauagaccauuauauaauacacacagaauccuugguuguauaugcauccugauagaaauauaugccagugaauugaacagacacuucacaaaugaggauauccacguggccauuaacauugaaccucaauaauuauaaaggagguucagauuauaaccaaaaugugcuaccucuacauacacaacagaauaguaaggggaaagagauugauaaaccagugguuggugaauauauggcacauaugcuacuggugggagggauuguauauugaucuacccauuuuggaaaacuguugggcauuaucuaccaaagcugagcauauguguacaacauaugacccaacaacaaaaaugugcauauguguacaccagagaacauacaggaauaugcauggcugcauucuucuuauauccccaaacuagaaauauaaaaugucugugaacaguaaaguggauaaguuaacuguuaaauucauuauaauagaguacuauggaaauuagugaauuacugcuucauaaacguugaauuuauaucagaaacauaaugcugaacaaaagccagaccuaaagacacauauguuugauuccauguauguacaauaaaguucaaaaacaagcaugacuauucuauggugauaaaggcagaagagugauuaacuuugggaagguaaucugguagaaaggggagacaaaggauacuucuguggugguaguaaugauccauuucuggaacuggguaaagguuacaugguuguauuuauugugugaaaaucagagcugugcaauuaugggaugugaauguugcuauaugugguuuacuuuaaggaaauuauuuauuuagaaauuuguaccaguuuucaagaaaauggaaaauuauuuuagugcuaauuuuaaauuuugaauuauguaauaguguucagagcugcugaauguucuuuauuuacaaucuagacagauauuuuaaauuaggaauauuguuaaaaguugugaugauauauuuuaacauuuaauuuauggccuagaauuauauuuugaaacagagucauagcuaauguugaaaacagauacauauuaaaaguuugaacucauuucuaacuaugaucuaagguuaaaguuccuaagaguuauaauaugaaugaacaaggccagcacgggggcucaugauauaaucccagcacuuugugaggccaaggcagguagaucacuugaggucaggaguucaagaccagccuggccaccauggugaaaccccgucucuacuaaacauagaaaaaguuagcugggugugguggugcaugccuuuaauuccugcugcucgggaggcugaggcacaagaaucacuugaacccaugagguggagguugcagugagccaagaucgugccacugcacuccagcauggaugacagagugagacugugucucaaaaaaaaaaaaaaaaaaaaagacugaguuagguccagauuuuucaggcuuuugcauauacuucauugccuuuuuauuggauaagcaaaaaagauccuagauaaaagaucccauagguucuaucuauaucauuaacaaguucauguuuacaaggcuagaauaauuuaucugucaaaaguaaauuaaauggagcauuagauccugacauuuuccugguauucucugcauuuugucauuuauuacagcaugaaucuagagaaacauuauugggauuuaauauggugaauuacagagcauguaaaaauuuguggaaagcauguguagaacaucacacauucuuccguuuggacagaccacuuccaccucaaaagaauuuuuuugcacauuauuuuacauuagguucaaaauuccgguacugguaaguauugcuucuguguuaaggcuuuauuguuggauuuuguuuccuuucuuuaaaauaaagauguaguuuauggaaccauacaaccuuuguuacacaaacuuaacugagucaaaaaucccuauggauugcagccucuauaucaguaucauuaaaaaguucuauagguucuugugauaugcuacaggcuugagaaaccaguucuguguucuguauuugcugucauuauuuucuggaguaaauuaacuacauuuacuuauuuacaauaaagacagaugacauaauuucuauugugucuuuauuagauauuugcuugaaaacuuuucuuuguucuaagacacccaagguaucuuaugccuaaaacuauauaauuauuguuuuuuaauuuagaauuuagcauauuuuuggguugucaaacccuuuauuguaaaguguuuaaaacagucacgaggcaaaaucagauuuagucauugaacaguaaccccagguuccauuuccuaaaauuguuuuauucuugauagcuuuuauuuuuuccugacggcaacaaaucuuuggggaauaacuaaaucugaagaagcucugauuaguuuuaccuuuggaauucuuaaaagacccaugcaagcuaguuuuuaaguggaaccugguaagaaucauguagaaaguuauucauuaucuuuuaguaaaacaaauguuauucauucuuguuuguuuaugcuucacauaauaagauuuuucaucuuugauaaauaaaacccuuggccagucgcaauggcucacaccuguaaucccagcucuuugggaggccgaggcaggcggaucaccagaggucaggaguucaagaccagccuggccaacauggugaaaccccgucucuaccaaaaacaaaaaacaaaaaauuagcuggcugugguggugggcgcuuguaaucccagcuacuugggaggcugaggcacgagaauugcuugaacccaggaggcagggguuucaugagccgacaucucgccauugcacuccagccugggugacagagcaagacuccaucucaaaaauaaaaauaaaauaaaaugaaaaacccuugaccauuauguguuaagauuaauucauguuauauguucaugagaaaaauguuuagauguucccagaaaagauuuaaauuguaaaccuaaacauguauaauugccuaauuuguaaucuccguaaaaauaacaguaugaagcuuaguacaggauaugucacuugaaauacaugacucccaccccagaaaaauuaguaaaaguggcucaaaaguucaguaguaacaauuaaacagaauuagaauauuuuuaaccaaacaaaaggcacaguaauuuccuaagcaguuugcugucacguuuaacuccuuuuuuuuuuuuugccuuccuaaaagcaauuuugaguaaaguaagaugacaguacuugcaaauuuaaaagcaaauagauggaaggagagaguaucagaucuauaaugaaagucaaggaaaaagcaaagagccuuaccuacuguuaauaaaucucagcaaggacagaagaaaucuccacggcuuuaugugaaaugagaacaguacaaacccuaaagauauucuuucaaugaauuuaauuucugauugguuaccaggguaguuauacaaggacuacucuuacccucuguucaaauucuuuuuucuccucuuuguccuugcaaaugugacauaaacacacaccauuuaauuuagguacaaagaaaugaguaggaccaauaaccagucuucaacuauaauucaagcaagucucagacaagaugagaaaagaaagucaaggaaguuacccaaaccauaccaaagcaaacauaaaauuuacauacggugacuucaaauacaaaagacaguugaagaaaccuguuugggaggaaaucaucacugaaacagaaggaaauuuguaccauaaauauuaauaaaagcaaguucaaggacaaucugauuuaaaaaaaaaaaaaaaaaaaaaagaucggccgggaagggagcaacaccugccauucagaaggcuguuacugcccuuggggaagauuggccuaguauugacaaauuuuacauguuuuucgacaaaacugggauuaaggacuauuaaaugggauauguacauuuuagaaaguugaacaauuauuuuaacagcuuuauugaaguauaauugacacauaagaaaugaucauauucaaacuuuaaaaucugauguuaguaugaugaauuacuuugauugcauuucaaguguuaagccagcccuacauuccuaggauaaaccccacuuagccaugauauccuuuauauauauuguuugauucacuuugcuaaauuuuguuuaggauuuuugcauauguguuuaugagggauauaucucuguaguuuucuuucguacgauaucauuuucagauuuuauugugucagggucaaauuggaaucaugaauguguugagaaaguuccauuuucuggaagaggcugcauaguaauaauauuaucucauuuuuaaauguuucauagaauuugcaaauuaauucaucuggggcagaagucuuacuuauaggaagguuuugaacauucaaauucuuuaauagauaaggcaauuaagguuuugucuuucuuccugagcaagauaugguaguuucugucugucagcaaauuuauccauuucaucuagguuguugaauuuauuggcacagaguuuauaauauuccccauuucuuuuuaaucucucuagaauauguaauaauguugcuucucucauucuugguaacuugugucuucuuuuuuccuugauuagucugcuagugguuuaucaguuugaauuaaauauuuuaaaauaauguaggccaggcaugggggccuguaaucucaguguugugggagaccaaggugggaggauuguuugaggccaggaguucaaguccagccugggcaacauaggcagaccccugucucuaccaaaaguuuaaaaacuagcugggcuuuuggcacacaccuguaguccuaacuacucaggaggcucagggaggaggaucacuugaggccaggaguuaaaaguuacaggacuaugaucaggccacugcacuucagccugggugacagagcaagacccugucucuaaacaacaacaaacaguauguauuccaaauaaaacuuguaucuucaggcuuauguuacuugugggccauccuuugucaaccaaguccuaaagacaaaaacaugaccaaaaaauauuaaacaugaucacauugccauucaaguccaaagucaacauauagacauuauccaauaugcaaaaacucagagaauauaacaucuccaggaccuuccugaaaacauuuauuaaguaguaaaauucagcaaaccaggagauaaaucagaauaauccugauuaaaaaaauaacuuuuuaucagguauaaaaaaauaacuuuuuaucagguauaaaaaguuauuuuuauauaaaaagcccugagagugaagauuaaauccucucuauauagaaacaauucuugacaaccgugagaauuauaacugcagaauaaaauuuaaaugguauaaacuuugccaaaguagaauaaguaauauaacuuuaaaaaaaugaggcugggcacgguggcucacgccuguaaucccagcacuuugggaggucgaggcgggcggaucacgaggucagcagaucgagaccaucuuggcuaaugcggugaaacccugucucuacuaaaaauacaaaaaauuagccgggcguaguggugggcaccuguagucccaguuacucgggaggcugaggcagaagaauggcgugaacccaggaggcagagcuugcagugagccgagauggagccacugcacuccagccugggcgacagagugagacuccgucucaaaaaaaaaaaaaaaaaaaagcaagggacuagugggaggaaguauuugaauccuuaaaguuugaaacaauuuuagacauuaacacagcaguucuuaagguuuucuucaucuuuuuuccuuuuuuuuaauaugaauggcagucuuuuuuaucuuuuauuucacuggaaaccaguuuaauuuuuuucguuaaaaguggcauauauaccauaguuucauuguaauaaaauuauugugccuguaugucuagccuuuuuaauguuuauauacaugaauuucagaaugauuuuuaccugcucauaauggugaugauuucuuuauggauaggacuguggguaaaaacaauuuuuuuguucuuuuuauauuuuucuauguugcuugaauaacuuauaauaagccuauauauaaagagagagagaaagagagagaacuuucucauugcucaaaagauaaguaucuuacugugaaaguuuaguguucugaaacuggaacaguuuuucauuuuguuguaaugauaauacuaaaucccuaaugucuguauuauggacaauaugaaauauaagccuuucuuucauuaauuuuaaaaaaaauuguuucuuuauuaugaaauuuaacuuguuacuccagccuuuugaguaauaguaucccauuugaaucuucuucacuggaaaauuaagguaucagucagaguucagucagggaagcagaaagcccuuuugguauuucaaacaaaagcaauuuaauugaggaaauuaguuacaugguuguuggaaaugcugggaaaacaaaaggguggaaacaugguuauggagaaaaaaacaagaagaagggguaaugccuaaaauucagaugcauucaggacucccugggcuggaguccacaaacuacaccugcuacuacacuguuagagcucuguuucccugacugaacucugacugauacauuaauuuuccagugaagaaaaaucagucugcaucuugcagagaaguacugcuuuaaucaaggaugggaccaucuacaggaugcucuuucucacuauacccuauccccaugacuauuaaagcagcugccagcagcugccaguuuccugcucugccuuucuccacuuucugaucuuccaccaguaccuucuaaaagcagaaccuaaggcaaaauaaucuagaaaauggaauuuguuuaucauagccccugcaaaacauagggcacaggacaggacugggccuaugacagcucgcacauuaaauuguauauacauaauuguguauauuuauaguuuuaaaaaguuaagcuuugcguuuguaguccuuaagaacuuuaaaacauauccaaagcacuuuuuaaucaucaaagugguuagacaucuuguaaaugaaguaggaaugggagaacuuuaaaacuuauccaaagcacuuuuuaaucauccaagugguuagacaucuuguaaaugaaguaggaaugaaguaggaaaugaaguaaaaauguuaacuggacacaguccugucccuaaugaguaugcacuaaauaaacuuuuuuucccuucauaauaagcagugguggagaauacuggaacuguugucauacuuaaaauguugaaauacucuuuugacugacagaugguacugggacuaucagaucuauuacuuucuccaccagucucuucauguacauauccuuaucucuguuccaaaguauccagaggauuaacaucauuauucuaauguggaaauacaaaacagugaugaacuuuaauuuauuaccucccucuuagaggaaauauuuucuuaggaaaauucaacuugaaguuuaaaagucaugguaguauuucucauuuuuccguuaaaaucucauaaaagugccauucaguucauauuuacugauauuuauccauggaaaauggucuuaaaauugcuugcuuaacuauggaaacuggcauuuggcuguuuuuauaugcauuagauagcuauauuuguauaugguuacauuugauauaccgcaaauuuauguuaauucacaguuaaguaaugagaaugucucaaauaaaugcucugagaacuuuuauuaacaaacuucaucugaacacauugguguacuucagaagaagaucaguuucucucuaucaacaauuucccucuagacaaaucagcuugaaaacaaaucuccuagugccaaaaccccaccauuuuucugccuuaguuccuuccucuaaacaaaaaucuggagcuguucugugucuggacauggagggaguugaacacaucuuucuucauuaaugggagaaauguaacuaagcuucauucauccagguagaauuggaauguuguccagucuuuuuauucucugcuuccuuuucucugcuagaaaugucuugucucuuaggaaguuacacuauaaucauguuauguguugucauuuuaucuuauaguucucuuaagacuuuauuguugugcauauuuauauauuucagugggagaacugaaguccaaucaguucaguauggcaaagaaaaggcaaauaaagacaggguauuugcaagguaagccaaaucuguuucauuguuugaauuuuuuuaaaaagauggauugaguuuacuaaaaaguuuuucuaaauauuuuuucuaaaguuuuucuaaauauuucaaauuuuugauuacagaauuaucacaauucuuuaacaguaaauaauguugagggaaugauaaacuagcuugucuaguuuauugauucauuuuuuauauuaauagugugccaggcauugcaguucugaauaggcugaucaaauauuauguuauuaauauaauauucuguucgagguugcuccacuuuuuuaaacauuuuugagaaauauagugacuuauuucauguuaucaagccauuuccauauuuauuuaaauuauaauguuaagagauaaguuguuuuauuuuuuguuuuuguuuaccauuuauugucuuuauuucuuuagggucugucauagccaauuugcuuuuuuuuuuuuuuuuuugagacggagucuuacccugucauccaggcuggagugcaguggugcaauuucagcucacugcaaccucugccuucuggguucaagugauucuccugccucagccucccuaguagcugggauuacgcaugccaccacaccuggcuaauauuuuuguauuuuuaguagagaugggguuuaccaugucagccaggcuagucucgaacucgugaccucaggugaucccccccaccuuggccucccaaagugcuggcauuacaggcaugagccaccacucccgaccuagccaauuugcuuuuuaacaagugaaaugacaugauaagaucuauguuuuagaaaauaguauuaugagcaaugauagagaauggauuagcgaggaaagccucgguacccagaaacuauaagguaauugcaguaauccaagugaaaauaauaaaggccugaacaaaaacauugguaauggaauggaaaauagggaacaaauuuaaggaacguuuuguaggcagaacuagcagaagcugaugaccaacuggauacagguguguuagagacaagaguuuguuuucagugaaaauuacuuugagaggcuaagucuuuuaauuaguuauguguuuggcaucuacugcuauuagaggcuugaguuuuaauaaagagaacuagaaaguuugcuuuugauuucacuuuguuuaaauuuuguucuuaagucuuuaucuaagagaccuuccuucuuuguguuucuggaguaaagggaguuuuguguucuugguuuuuuucuuccuccuuccaaaaguggaaauugcuuuuuuccccuaguaauauaagugauagcucauuauguuuaaaaacuccaacaguaucaaagagcauaaagaaaauuuaucaucccaagacaacuuuuuaaaaaaauuuugauacucauuauucaggauuuuucuaugcauauacucauagagacauuuuuauauauguguguauauuuguuuccaaauuguuuuaaacuauuuguuguuuguuuuuaucaucuagcauaucgugcacauuuucuuugcuguucaaaaaucuagucauuuauaauggcaauaaaucuuuuaacaguuaaauucuuugauuguaaacuguaaacuuaacuuuuaggauuccucccuuuacugagccacgucccugccuccagaguaggaguuguugcuaagacuuuguaaggaugucacaguaauaugugacauacagcuuacauuuaguagucuacuauaugaggaaauaauaguuuauuacauuaugaauuaacauuaauagaagagccauaaaugguaaguuaaucuuuauuuuaaaaaucaaaugcaugagauaauauacuuuauuuucauucuguugugacugauaggaaaauuugcacugcaauaugaggggguuggaccaaacggugucaugaguugucuucuaaucaaaaaauccuauaauuuaaaccugugauaauggaaaaucuucacaccuaaauuacuuugaauucacuuauggaaaaugaaaugaguccauguauuuuuuaaaaaacgaauaacauuucuuaaaauauuuuucugauucuuaguguuguaacagcguagcaauauacuuaaaacuuuccuuucuuaacaagugucuucuuucugcuugacuuuuauaaacaguguagaacgugcgauguggucacuaguuguaugcagcauauccucauacgaguaccagaucguaggcauauuuauguauuaaguuaauaucacauacaaaugguuucuuuauaaguguuaauguuuucauguuuugauccuaucagauuuuagaaauaagcagaguuauaccugcaucuuaguuguucauuuuguguauucauuauuaaaauguauaguuguuuaauagguuauuuuauaaaacaaauagccaugauuccgugaauaguagagguaaaauuucaauauuauaagccucagauaacucucuuccuuuuguuuuucuggaauugugugguuccucugaaauaauaagguaucagcuacaaugagguuguaauaguacugggcuguuuaaugaucucucuuucucugaaagauaagcuuuucugggauuguuuuucuaauauguuaggaucuaauuguaaugaacagauauaugucuaccaaaauucucuaaugguuuuaguaauuauuaaguuauuuuauuaaaguaccagauaaccuagaguucuuuuuuuuucuuuggguuuuaguuggcaauaugaguagauagaaaaggcuccuccuuaaacuucucauauaauaauuuuuuagcaaucauuaaauguuuuuucuuuuuucugauuaucaccucuuuguguucgccucagcagcacauauacugauuaucaccucuucaaauugcuuucacauuuugcaguugucauauaauauaucuaagaaaagagaaaaacaauguucucauacaacagaaaaauaaggugcccuagacagaaaagaagcuuaccacaucgcaaacacacugaugcugugugguauuuuuuucucugaaauuuccacacucaacaggaaacauagacagcaagcuugagugggugggucccugagguuaaaacuguuaauaaaauaaaauacaugaaguuugguuuuaaguucaaaguguccagccauguuuaguccauuaacagcaauaaaguguucugacgcuucagacuaggugagugugcuggaauuuuuuuucuucaaaugacuuuuuccagcuuuuagaaaaugaaaguaguugaucuauugauuacaguuagugaacuuucauacagcuuacauuucguaguuuaauauuugaggaaauaauaguuuauuacauuaugaauuagcauuaauagagccauaaauguuaaucuuuauuuuaaaaaucaaaguuuuaugcaugagguaauauacuuuauuuucauucuguugugacugauaagaaaauuugcacugcaauaugagggaguugaacuaaacggugucaugaguugucuucaaaucaaaaaauccuauaauuuaaaccugugauaaugggaaauguucacaccuaaauuacuuugaauucacuuacggaaaaugaaaucugagucaauguaucuuuuuuaaaacuaauaacauuccaugucuuauaaaaugccuacaagauuuuugauuaaggaaaugucauuaggccaaacuaaaaaaguuuuagcuaugaauugcugaaaugacaggacacuucugugguguagauucauaaguaacuuaaauuuuucgugguuuaguaaaauuaauaggcuaaaauauugcccugaaaauuuggauauucauaaaucauaaaauucaggagguagggagagaccuaugggucauauuaugcuaauaaauuuauacauuuagauacagaaacauaagaggucugucuaauaggaagccacaucuagaauucagaguccuuaucauuauuuuaaugcuuccuacuguacacauaauaacaauuuguucaguucucuuuggucaguguuauugugcguguuaguccgacauuucuuuuuacacguuuaacauauuggaaaggaaauucuagcaggcagugaaacuucaaacuucaugagaucauuauguaucagaauucuaauguuauuaaguuuuaauguaaucagaugaguuaauauugcauuugcuuugugccuuccuugguaauuguuuuuuuuuuuuuagccauacagaaguguauacauaguacaugaugagagaaaaauaucccaaugagcuaaaaaagcaaguccaauacuaccugcaauucuuuaucaauauaagaaaaucugaaaauaaauccaaagucacacaacaaaggccuaugauucuuauuaacuauaaccaaaaauagucuucauuuuuaaauuuuacucaaauagguauuucuaccuaaauuuuuaugaucugauuuuuguaggaagacaacaggauguuucauuuuuuguaaauugugcuggaauggaaaauacauauaguuuuuauaugcuucaguuaauuacugaaauauaaaacuguuuacaagaugauuuauuauauacuuuauauauguagcuuaaauuauucgccuccacauuaacucugcacuucauaaagccaggcauuuaaagaaauaacauauauuuucagcuaauuuugucuauuaucugaauuugcauauaaaaaauacuuuauuuguuaacauuccuaaaauucuaaggguuuaugaucucugcauagaucaguaucuuuugaucugaaugaaucaauaugaagaucuuucuuucuuucuuucuuuuuuuuuuuuuuuuuuuuuuuuuugagacaggguuuuacucuugucacccagguuggaaugcaguggugcuaucacagcucacugcagucucaaauuccuggacucaaguugauccucugacuucagccucccaaguagcuuggacuacaggcacuugccaucauacccagcuaauuuauuuuuuguagagacagagucuccuuauguugcccaagcuggucuugaauuccuaaguuccagugauccucccaccugggccucccaaagugcugggauugcagcacugagccaccucgcgcauccaagaucuuuuuuuaaaacaucacuuaguuuucaucuuuaucauuaggauagcugauaauauauagauugguaacaaaacauauccuuuuacuccccaccaauagacagaauuauuaacccuccaaaauguuuuuggaaaaaagggaaaaauccacuaaccuacuauauguaaacaauuuuuuaaguagauaaaauguaauaugcauaauuauuuuuguucugucuucauugaggcagaggauugggauuuaguuauagaagcauucaggagauaaugugcgaggaguuauuuaauacaucccaagauaagcuaguguuccagauacucuggaauagaaguagguaguaucugucuugucaguaacaucugagaaaacauuugguagcaaacccuucccuuuuuaccuuuguccuuccuuuucuuguuucuucuguuuuucucauccuucuuauugucuaucuuacucuuccuagccugucuuaccuuuauucuucauauaaagccaauguacauucuuaggaaguuauuugguaaauagccucuaaaugcauuaauuuuuuacaaguaaacucuuuauguugcucaucuagaacauaaucucugaaaacaaauuguaggauuugauucaugguuugggguauaaaaauaaaacuuuuaacauauuauuuaauuuauuucugcagauccccaaguaagcccuuggcacggaaauuaauggauugggaaguaguaagcagaaauucaauaucugaugacagguuagaaacacaaagucuuccaucacgaucuccaccgggaacuccuaaucaguaagugugaauuuugugaccaacaucaggugugaauuuugcuaauuucuaauuauuggcuguauauuuuuaugccugaagacaaagauacgcaaaaauugaauucuuuuggugaaacaugauuuuuguugcuccagagcauuauuuucucuuugccugcugcucuuugcagaaguaacaugguauagacuugcggaaugagaguagcgcauugaauaaggacccuccacucucacucuccucaacaguuaacuuucgcaguuaagagucccugauaaaugaagaucuguuagacuuaaaaucuuguaugguuguuguugacauacucauuuuucauguggauucccagcagaauuucuaggggagcauauauuguuugaaaaugcuuugcaagugauugggauucucuuaaacccccagcucaaccauggcuucagcacguucuauggccuaggaaaagggguuuccagcaccaguccccauaagcuuagcucucccugagcuaaaaagcacugugugauucagcacuuaccguauauguacuucagucugacauugcucacaaaaguuguauguuuugguauaaaugauuauaaguucauaaacuagccaaauguaccagccaaagauguugauuaucuuaauuugauaauauuacaaauguuguauguaauuaagauaaugguaaacaauugugugccaccauauuaacauacuuaguuaacccauaagguucacuuauaaaauacuugaauuuugguaugaaauauaauauuugaagaugucuuuuuucauaaauguuuuacacacauuaauguuuaauaaauuuguauaaaauucuaaacguggcugggugcaguggcucauuccuguaaucccagcacuuugggaggccaaaguguguggauuccuuaaggucaggagcucaagaccagccuggugaacauagugaaaccccaucuuuacaaaaacauacaaaaauuagcugagcaugguggcgugcaccugucagggggguggggcagggauugcuagaacccaggaggaagagguugcagaguugagaucacaccacugcacuucagccuggaccacagagugagacccugucucaaaaaaaaaaaaaaaaaaaucuaacagcuagagcauugaaggcuauuaucagcugaagaauaaaguucuaccauaucagaacaguuuauacauaaacaguuugguucacagagcuuuaauacuuaacguguuaaaguuacuccuagaaaaaaauggacuuaguaauuucugucuugccaauuucagguugcuuuuaucauuuuuucuuauaaaugauuacauauauucaaagccucauuagcuugucugaagaaaauucagaccuuguuuuucucuucccuuuugcacaaacagccauuucuccauuuguaccagcaacacuaaacaauaauagcaaguuauagaaaauaauagcaaguuaagccaaaguacucaaguaacuaauuaacaguagcucuguuuaaguuuucugguuaaugaaacaauuucagguauaaucuaaaaagauuuuuuaaaauucugaagagauaguacaagguggugguuaagagcaugggcccuggaaucacuguaugcuugaacuugggcaaguuaaucucugucucauuuuucucaucuacaaaauuauauuuauaauaaugucuuucuuauaguacuguuaugaggauuaaaugaaaugcuuagagaaaugucugacacauacauaaauacugaaauauuguaauuaaaaauuguaauaacacuacuuugugugacugucaagaggauggcaauauaguauucaguaucuacucuaaggcuucaaagaaagucccauaaauaaaaacauuuauaacaauuaaaaaauaauucagacuagaauauauuucuaaaugauuuauucuaaucccuuuauuuuauaaaugcugaguaagacaaaaucauagugacuaacaccuagaaacaugaaggcacuuagagauaguagguaacuuuauggguagaauccuuggcagauuguugauuguaacucagaucacugacuucccauucucuguucccucuguuuauaucacacugucuuuuucagagauugcuuagucaacauggcuugacuuaaaaacacauacccccuuucugauguaaccauauauuaagaaacuuggaaauuuugaauugaagcauauuuuuauucaguuuuucucccucuuuauuuagucgaaauucuacauucacgcaggaaggaacccgguuacgaccaucuucaguuggucauuugguagaccauaugguucauacuuccccaagcgaaguguuuguaaaucagagaucuccgucaucaacacaagcuaauagcauuguucuggaaucaucaccguaagagcuuuuuuauuuugcuuccucuguauuuucaaaugccccaaauugcuuuacuuaaaauaaucugggaaauuaggauauucgauacaagauuuuaauuaugcaacuuuucaaaauguguauguuugcaauuaugcucauuuguuccugagaguucuuguugccucucccuccccgacccagucacuauguuguuauuuuguugacuuagacaguucuucaguuuuuaguauauaaacucaaauauuucugcagaugauguagcacucuggucaaggaggaggguaguuaaagcagaguuuccuuaauauuuuuaaaggaaaagaaccauaaguaugaguaaaaaguguugagaaaauuaaaauacuuacaagauauguagauagguaagaagauuuuuuaauuuaccuauguagauagguaagaagauuuauuucuugagaaggagaaauugguguaagauauagugagugcgaucagggguaaagagugggcccaagagugguagguggaagagaguacagguguagggucauguuugucccuggguaggguaaaccaaggaagacuggcugagcuaucaaaacaaguaggaguucagccugcgugauguauaucuugguaaaacauuuugauuguguguauauauuauuaaaaauggagaaauaggacagauacacacuguacaaugauaccuguggggaauuaguuggcaagaaauaggauugaugggagauuuaauauuuuauuacuuuagaaguuauaauucuaaacuuuccaguugauuuuuaauaauuauauauguucuaauuugaaaacuuuaaaaaguauaguaauuaaggacaugauugaaauauugauuugauuuuuaaaauuacauacuucugugacauaaaaaugaaucauaugcaggaaucaaaaagccuaauuauuacaaaccaaaaccaauauaauucuugaggccuaacaaaauuaucuuuaucuauuuuuaaagggccuuuuccaaagaaagacauauaaacgcaauugaauauuuccacauguaaauuuuuuuuuuuugagauggagucucgcucuuucacccaggcgggagugcaguggcgcuaucucggcucacugcaagcucugccucccggguucacgccauucuccugccucaaccucccgaguagcugagacuacaggcgccagccaccacucccggcuaauuuuguguaucuuuaguagagaugggguuucaccguguuagccaggauggucucgaucuccugaccucgugauucgcccaccucggccucccaaagugcugggauuccaggcgugagcccccgcgcccggccucacauguaaauuuuauagauucacaaacccccaaaucacuugcugauaugguuuggcucuguguccucacccagaucucaccuugaauuguaaucuccaggugucaagggcaggaccagguaaagguaguugaaucaugggggucauuucucccaugcuguucuugugauaaugaaugagucucacaagaucugaugguuuuauaagugucuggcauuuccccugcaugcacucauuuucucuccugccgcccugugaagaggugccuuccaccaugauuguaaauuuccugaggccuccccagccauguguaacugugagucaauuaaaccucuuuuguuuauaaacuacccagucucagguauuucuucauagcagcaugagaauggacuaauacauuugccaucucaaaacaccuuuauucuacuuuccugacuugaguggagaagcgaguucaggguagcuuggaacugugaagaguuuuugcuucuucucucuugugcacaagaauauaaaaugcuuggagccuucuccuuggacauauauuuuauaagguuuauguguuuguauuccauuuugaaucuauauuacugcauuugacauucaaccaguuuuuaaccuuaagaauaaugagagaguucugaaaagauaagcuuaauaauaauaacuuacuuaguugcuuacagucacuuuuacauaaauuaucucacuguucuauucaggagaauucagugaaauaggaaagauauguaauauccauuuuauagauaagaaagccacacuuagaacacuugucccaauuuacagaacagaaacucgggcuuucuguagcaugagaaucagccaggagaacuuuguauccccaacaagauguuauagauguuuuuugauuugcaauuuagauaaaauacuuugcagcuuggaauccauagauuucaguuuuucuguuguccaaaugugaaaagaauuuaaaugauguauuggauuaagcacagaacauuucaacauguaaugaaauagauuuuuuuuaagguuuuucacauauaccuuuuuuuaauugucagauaaaaucaucuuaccaauuauuuauuuaagugaguacaggagguugcuuauacuguuuagaauaaaguuaccauuuauaggcuaaggauaaaguaaaggagaccacagucuacaacacagcaugugaauuggaugguuaaauuuauuagcauacaaauuucuaaaggcggcaacagagagcugcauuaacugcaaaauaagcuuuuuuucacugcuguuguugaagcauuuauaagaaaauuuaaagcucaguggacugaaauaaauugugcacauuuuuucacacaucuugauugacauuucuaacaaacuuuugcuacuaugugacaauauauugcucugcuaccagcauaguacacucgaauauaacauuuucauuauuuacccuccacuuaacauuuuccaaaaugucagauugccaagugugguggugugcaccuguugucccagcuuacucaggaggcugaggcagaaggaucacuagagcccaggaguucgaggauguauugcuccaugauggugccuguggauagucacugcaccucagccuggacaauacagcaagacaccaucuuuuaaaaaccaaaaccaaaaaaaaaaaaaggucagaguuuaagauaagcaaguuauuuuugguaaaaagccccaauaugaauguugggcauuuggaacacuuuuagaauuauauugccaucuuuccuuucucuuaacaaccgaaaguuaacacgaauaguacuuuuuuuuaaaugugggauaauuuuuuuuuuuuuuuuuuuuugagacaaagucucacucugucgcccaggcuggagugcaguggcacaaucuuggcucacugcaagcucuaccucccggguucacgccauucuccugccuuagccucccgaguagcugggacuacaggcgcccgucaccacacccggcuaauuuuuuguguuuuuaguagagaccagguuucaccguguuagccaggauagucucgaucuccugaccuugugauccacccaccucggccucccaaagugcugggauuacaggcaugagccaccaugccuggcuaauguggguaaauuuuuuauguggguaaacuguguacaguauguguuuugagcccuggugcccccuccuuuaguacauuuuaggcaaauuauugguuuuaaauauguuaaaacaauugaguuagaaauguuaucaauuaaaguuaaauauggauguauauaagcccugauauuuacuaaucuugcuuucuguucauuaaaauauaagugauuuguguuagaauuuaaaauauagcaguauuaccauuuauaaccaaaaaaagggauuuaaaauagucauauucuggauauauucugauaaguucugggaguucuguugaggccucagauacugacaggggugggggaugcuuauuagcauuuaucuguuuuauaaauuggcuucugagaaacuuuuuuuuuuuuagaaaaagauuccacugccacaaaaaguuuggaaaccucugauuuaaaacaacuuuccuccuuuuugcaguuacuuuguuuuagaugcaacuauauaucauaguguuuacgagcacaagcucuggauucagacuagguuuaaaacgugguuccacuacuucuaauuaggugaccuuuggugaguuauuuuaucuccguaagccuguuuccucacuguuaaaaaacagggugauaauaauaucuaccucaaagaguugcuauaagcauauaauaauuauauagcuuuuuucaguuaagcucuugggauauauuccaacaacuuuuaauauauuaucaacaguuugucuggauauuugaagugugagcaucugguugaagacagugaagaauucuccagauucucaacuuuauucuuacauuccuaaucacaagauauucuagacagacuucauaauccagaaguggcuuuuuguuuguuuguuuauuuagggacagggucuugcucuguugccuaggcuggagugcagugguguaaucaccgcucacugcagccuagaccuccugggcucaaguaauccucccaccucagccucccaaguagcugagacugcaggagcaugacaccaugcccagcuaauuuuuguauuucuuguggaaacaggguugcaucauguugcccaagcuggucuugaacuccugggcucuagugauccaccugccucagccucccaaguuguuugggaggauuacaggugugagccaccgugccuggccauccucaaguguuaaauccaguuccccgagccauucuuuccuggacuauuccauucuagucuuaucuaaugaaucuccgcagcuuugucuauaccucuucaguuccuuuugcuuggucuucaaagcuuugccuuuccuccaccccucucagcuacuggcacugaugauuuccaucuacaacucaguuguccccaauuccuauuccagucuugaucaagucuagcaauauauugugaacucuucaaauacuaggcuauucuaggacaaggaaguaaaaaaaucgaagguuugaauagaaggagauaucaagccauggggacuuagagaauguaacauauuagaugcuguuguauucauggcuucaagacuaauuacagguccccggacacuguagcugcaguaugcuuaccuaccauucaucucuggcuaaaggcucugucacuugcacuugggagcuaagggcagacaccuugaguuugguugaaaccaagaaucucagguugcugggaggcuuauucuggaauagauuccuacuguuaaaaucacaugacauugucaguucuauucuuagauauuacucauaucccugauaguuuacacgagcuuuuuaaagugccuugugcguuaauugguaaucaaccugaagugacauuuacuuugaaacacugucauuaucagaauaaaguagccaaaguguuaagaagccugaauuuugaaucagaauuuuaucuguaucuaauguaauauaaguagaguauaaguuggguuaaaugcguaauugaagacuagaauaacaguagugguuauaguuaaauaagacauguucucuugaucuacaucuuagaaaauaaggguuuguuuuuuucuuuaagagacagggucucuuugucucccaggcuggggcauaguggcgcaauuauagcucaccacagccucaaacuacuguucuugaaugaucuucccauuucagcauccugaguagcugggacuacagguauacaccaccauccccaguuuauuuuuuuaaaaaaauuuuuuguagagauggugucuugcuauguuggccaggcuggaaaauaagaguuuuuuaaagagccaucaauuucuggcacauuuguauuagugucuaacaagaauauaguuuuuguuuucuagucuauuggaauaaauuuuaugcuucugugacagauuucuauguacaauugugccuuuaccguuuuuuaaaaaaaauucaugauuuucaaggguuguucauuuuucuuuuuuaaaaguaauaaaauaaucccuucaggauugcauuuuuuucucacuuucccuaacucagaucuuuuccagcucccuuccuuaaagccaguaaaugcuggccuucuuugaaaauuaaaggucucuuucuugaggguaccagcuguaauuucugacagggcuguguuucacuaugcugccugguuauucuccaaauugcaucaugucucuucauucucuuauacuuggcagauuuuugugugugugcacuuagaaauaguauuguuuuuaagaauuggacuguuucaugacauuauuuuuaauguaucauuucuaauuauaaugcaagguuuaccuaugaaaaucaucuuccuagauaacuguuuaaguaauaaauauauaugauagcuguacaauagaaaugaagaagaaaguuauucauuaaaguaaauugaauuaauauucuuggaguaugucuuuuaaaaaauguaauugauaaccuuugcccaauauuugaauuucaggagucuguguugacauccuugauuacuuuuauagacuucagaguguguguguguguguguguguguguauagaguuugguuguguauguauacaguuugguuauugaaauuagaaguauagaaaagggaaacaguuacagggauuacugugagaguacauaauuaaauuauaagagcucccuagacuaaccuaacccucugcagcagucaggcauauggagagccugucugccacucucugaaaaguuacuuuaauaagaaaguuacauaagacagugagaaggcagguagcucuguccugaaauccaaaguuuuacuguccuuucgucuucaucuuaaucuauacuucauucuccucaccuuuuccuuauaauuuggcuuaaaucccaaccucagcauuuauacuugggcucuuuuccuaucuguaucuuccugcuugauuugauuguuuaaaaagagguuaaaagagguuauucucaaauaccuguagucuugcaaguagcacgggauggagauuuguguagauuauagagcucaugcugcaucuaaagacagcagcugccacuuggcuuuauacaguguuugacaacugguacugcaggcccauucuuuccggagcuuccagauuuuucaucuugaaaaucuagauuuguaugcaauuuuaaaaauguaauuguuuaacucaauuauuuuuauaaaaacaaugaaugguccaaauguauguuggccaaaauuggcccauaauccaugaauuuauaacugcucuuuuaggacaauaaugucuaaucauaauugcgcaauaaaaaccaccucuggagguguuucuuguaaccccagaaguagagauucaacaguuuuagcaaaauguaccauagaaucagugcugucccucucauguaacugaguauugccacuguuaggcccauacugaguaugccacuguuaggcauaacugaguauugccaccgauaggcccauacagguuuggcucacuuagauauaccacugcugaucaggcuugaguuucuccuguauauuuuggugcuguauuuaaacugauagcuggaccaagaauaaggaagguuucccugacuccauuuucauauguucuccaccuuacucccuuucccacaggcuuuuaguuuuaaauuuuuuuucucagcuuuuaaauuuagcuuuuaaauguuuccugguuaugacaacuguaugcaaagcagaaagaguuucuaauuauauugccuaagugguuacacuuagguccaaguaaggggugagaccuguuauauaugucgaguccaauuacuucugguauuuguaaaguuuuagagauucuuaucaacugccuuuuaaaaauguugcaucucuuaaguucugcuaagggauguccaucucugugugcucuaauccuauguaguaggccgugguugaguuacauaucucuauucuaauccauggaaacauuucccuagacaagcaauacuugaaucuaugggcccuuagaagcuuguauucuuggcaguugaaaguaacauaagaacuaccacauuugggagcuggaagcccuggccauuaaggcagaccucaaugaagcuuuggcugaaaaagagggauguaugcucugaugcagucuuuguagacuuggcagaauuuagagcauuugugcccugaaguauuucuaugcagacaucuaggcuaagugggcauugcuguucacuugcuucuuuugcaguuauauuuuauaccauguuauaaaauuucagaaagacucuaaucucuccuaggagaaacuucucuuuaagaccauacaaucacaucauucauuauuaaucccagcugacuuccuuggcacugaucauacuuucuuucaguuucacaacacuuauuuacuaggugucuagcagccaaccucucaauaagcuuacaccuccucuacaagggagaacagauguauccaagggucacucuggcaguaaaucucuguaucaguuaucuuguuaugcuugaucacaaaugagccuaacuuaaagagacauaacaaaaguucuuucuuucuuacauuguauguacauuaugugucaucuguggcugugcucuaccuuaucuucauucugggucccagacugguagcauucccuguuugggacauggcuagucucaugggcaagggaaaaaagaagcauaaugaaaucauaagcuguuucauuuuuuucuuuuuuuuuuuuuuuuuuuuuuugagauggagucuugcucugucgcccaaguuggagugcaguggcgcgaucuuggcucacugcaagcuccgccucccagguucacgccauucuccugccucagcccccccgaguagcugggacuacaggcgccugccaccaugccuagcuaauuuuuuuguauuuuuaguagagacaggguuucaccauguuagccaggauaggauggucucaaucuccugaccucgugauccgcccaccccggccucccaaagugcugggauuacaggcaugagccacugugcccagcccauaaacuguuucuuaaagcuuccuuucaaaaguuacacauuccacuucuacccacaugucauuggccaaagcaagucacauggccaggccuaaugucaguggggggaagaagaacuuuuuuuuuaaugauaauaucaucuaauacauuuuccuuaucuccagaccuuauagcuuggauguuaggugucccguuagucaacagaagagcagauacuagguauaaaaugugugcuucagugccacaucagcagccauguggcuugacacaguagcugucaucucucuuauaccuguccuuaggcaauaagacaguaauucuuuuaucagauaauaacgccaauaguggucaguguucuuaucaagaacaauuuuccgcuuaccuauuuaaucuuuuacuucucccaaauccacgacuucuguggaugcauacuucuuaagacacaaguugaaccacaaguuucuacuuuuggccuuuguggaaugcucacaaguaauguuuuuauacauuuuaugcuuguuaaaagcuagaguuucugaccugaaguuaccuuuaucauaucuagcucuuuuuaucaauuccuguugccacaaauugaggcuuaugcucucuaauguuaauuggauuuuguuuucucaccuuaaaucauauguucugacaauaucucaaccaguuuuggcucuggugaugaucucagcacucuuacucagauuuccaauccucacugcaucauugaauucauuacuuccaugaaucguauuuuauuucuaaauagauuaggccaaucucuuaagcuauuuaggcuggaauaguuacuuuaucuguggaacuacccaauuaucaguucuggauuuucuugccuaccuuauuccuggcuacccgugacuccucugacaaccuuaaaaaaauuuuuuuggaaagauguuuacuuuguuauaauagauuaauagguaucuucacaggaauaccuugauaauauauuuuauuauauaauuguuuauaaauuugauaaaguaggaaauuagauuuauuacuucaaaguuaggaaaauuuucauuaaaaaguggcacuuccaaauaaauaugguauuuagagccugucuccuaccagacauuguaaauauguggguugcuugacccuaacuuuuaaaaaaguuaugaaacaacuuccaaauuuguuuucuugucuagaucacaagagaccccuggagaugggaagccuccagcuuuaccacccaaacagucaaagaaaaacaguuggaaccaaauucauuauucacauucgcaacaagaucuagaaagucauauuaaugaaacauuugauauuccaucuucuccugaaaaacccacuguaaguagcuucuucagauauucucauuuuuauuugaauuuuuaaaauccuaaaugaaauuucuuuuguacuuuggcaguuuuuaguuguaaguuguauuacaguaccuucucuuuuucaucauauucuuugguccugaauugugccaugauguaucucaauauaaguucuauaauuagaagugaucauggaguacauagaguauauaauuaaauaagcugugggguuaagggaagauuccuauaagagaucaucucugauaagaacuagucagauuuuuuccuucaaagagcaggcauagaacauacugaacaaaccugcauguugugcacauguacccuaaaacuuaaaguauaauaauaauaaaaauuaaaaauaaaaauaacaauaaagaacauacugaaugaaagaagcccaggacaaauagccauguguuguaggauuucauauaugugaaauauccaaaacagucagaucugucaagagacaguaaguagauuugugguugacuaggcuuuggaggauggcaggugggaaaauggggaacgacugcuaauggauacaagauuucuuuuggaauugaugaaaauauucuaaaauuagauaauagugauguuuguacaccucugugacaagaguaaaaauuauggaaauauacacuuuaaauaggugaaugauaugugaauuauaucucaauaaagcuguuuuuuaaaaucacauauaucaagcaguggaaguaucauuugaauucauguaacacuuaugagcacccucuguauacucauacauaugaaccuggcuugcuaugagccagauucuacggauauagcaauuaauaaagacagacauggccccuguuccuccugucacuuaauagucuagcauaugcucguaagaaugcaugagaggauauaucugguugggcuaacugcaaguuauuagucaaagaauuuacucuucugaacuaaaauuuuuauuagaauuaugauuuuuuacaaacuaugcauaauauaagcauacaaaaaauaugcuuccuauauaucugaagaauagauuuuaagugaagaaaauuacaaguuauuuaauuuugucuuuuuaagccuaauggugguauuccacaugauaaucuuguccuaaucagaaugaaaccugaugaaaaugggagguuuggauucaauguaaagguaaucuggaauuuauuuuauacucaguuuuuaaauuaagauguucuuauuuugguaauauuugacuaacauuuuacuuauucucuuuuuaagggaggauaugaucagaagaugccugugauugugucucgaguagcaccaggaacaccugugaguuaucuaaauguuucaaauaaauccuguuuucaagaauauguacuuauuuuauaauucuuacuaguuuaaauaaaacaaggaauuucaucauuucuuuuauuuaucaagugucaaauguuggcugaaucucuuuaaguugcugggaaguuaguuuugacuuguucucuguaaguauuuaaaaucccuguuuuuauaaagaagcuauuuaugacuuucauugcuucuaaagcauuaacagauucuaucaaaauaacccccuuaaaaaacaaaauauagacagagguauaguuucguggggguuuuuguuugcuuguuuauuuuuuauuagaguaauuuaaguacauuauacuugccuaugcacuccuuuaaaauuuuacuuuaaauggaaaugauacuacaaggauaauuuuuaaaacuuuuuauuaugaacauucuaaacaaaaguagagaaaacuuauauauccauuaugaugaaucuccuauuacucauuguucagcuuccacaaucaugaacuuucuguucaucauaggacaauucuuaacuaauuguagguacaucaucuuuauuacuguuuuauauaacaaguauugcuuucaaauuccuauuuauguugucuacucuguuuacuuuccuuuuucuuaccuaaaugaucuucaagcaccuuuuaucauuuaacugucucucuguucuaggaaagguaugaaccagcagccugagagagggaggccagcuaugcuuuuuuuggugcuuugcagcaaccucaaaguugguuugaaaaucacaauugagauugaucaaggauaucauguuaugugguuuugguucugguuuuuaaggaccuuguuuuuugcgaaaauaacaggguacucauggaauaccccuggcaugagcauaaacacagaauaguuuauuuaaauauaaauacaucagauagcuauugaggugucacacaaaacuaaagagcaugaaugcaaucacaccucuacaggaaacuuuuaaaaucaucgacuuuucugcuuuucaucuguuucuuuuuaugugauuguuugauuccucucagugugaaugaauuuguacauugaaucagccuaccucucaagccacuccagauaaacacuccagucuaaguaaaaacaguguacuuaguagcagcuucaagcagaguuuuguaacaccacuaccacacacacacacacacacacacacacacaucagauugugacuccuaagucuccacuaaauagaaauuguguaacuaccuacugcuauugugauccucaauccauguaguaggaugugacuacuaauaacuuccagguuuguauauuaccagcucaguagcccacagggaccucucagucuaaauuauaaacuccugggauguaaacccuuaauagacccagcguggauccuauuuccuuauuugaaaaaaguccguugugacugggggacaagaccggggauauuauguauaaaaugacuccuggggacauacuauuaauauguauguaaaagauggggacaaagaugguagagauaauccaaaauuauuuauuuuauauauauuugaugggaaauaugaauaugauugggacugcagaugaagggaugaaggauugaugaauuaucuaucauguacaaaguuaauagauaauaucuaaaacagaaaagaauaacaauagagagauguuagagaugcagagguaaauacagaaagauauaucuaaaguguugaaaaaaguugccucuagagauggggaggugguagggaggaacacaaauaguuucuuaacagucuuauaaaccuagucaaaucuuuuaauggugugauuuauaacuuugcuaaaaacaaaaauuuaagacuuaaaaaaaaagcaguuguauaucuuuuggccugacaguuucacauuuaggaauuucuccuaaugaaauaguuugacuagggaacaaagaguacuuacacagggauauuaauuauaugguuuauaacaguuuaaaguggaaaaauaaucaaauguggacuagggaacaaagaaauacaaggauauuaauuacaguaugguuucuaacaguuuaaaaugaaaaauaaucaaaaugcucaucguuaaaguuggggaaacaaguuauauguugcuuugugucuauugagaugguaauguaacuauauaaauauggaaauauauccauacgauggcauuauggaaaaauauauaauuucacauauauguuugaaccaguuuauuaaaauauuagauacauagaaaaauucuggaaacgugcuaaaaaaguuaacaguggguaauggaauuacagguauucuguauuuuuuuaauugucuggaucaugacaaugagcauauauugcucuuauaauuagaaaagauaauacacauuucuuuauuuacaugacaguuguaauagucaaugacucacacgcauaaaaaaaguauucauuuuucugagcaaugaauauggauaguuuucaauuaagucaaggauucagagaauauucuauagauauauucauuuccaaacagaauucuaagacuguuaaguucucuuuuuaaucuguacauauuguugguaauuuuucccuucugccauguagaacuauguuccauaaauauuggcuggaauuuagagcaaauuaaaacauagucauucuauugggggaaaaaauuaaaacaauaggaauuuauuauuuuuguauuauuuuguuaauuuagagaucaccacaaccuucuaauuggaaaccacaguuuaggcaaucgggggaaaaggaaaagguuucuguuuuuguaugaauacauaauaguuguacauguuuaugggauucaaauauuuuauugucauuuuuuauauuggacaucuucugaaauggauaaaacaacucccaauuaaaguuaugauucucuuucuguuugauaaucuuagccaaaagccguugcugcaacaaaacucauuuuaacguaguuuauuggccgggugugaugcucaugccuauaaucuuagcacuuugggaggcuaagaugggaggauuguuugagcucaggaguugaagacuacccugggcaacauagugaagcuuuguuucuacaaaaaaaauuuuuaaauucaccagauaugguggcacacgccugugaugccagcuacuccaguggcugaagugggaggaucacuugagcccaggagaucgaggcuguagugagcuaugaucacaccacuacacuccagccuaagcaacagagcaagacccugucucaaauauauagcaagacccugucugaaauacacacacacacacacacagagcaagacccucaaacauauauuugagcaagacagggucuugcucuguauguguguauauauacacacaaacaguuuauuuagacuugucagaucagaaugaaauggaaaugaaaaauuguaacauaucugacaaaaggcauauuaacuauaagagaguucccuuuagugauaauggauacaguaagagauucauagcuauccucuuuaacacauagaccaccucuuuuuuucugccaacuacacuaugcacaaaauaaugugaggaaaagcucugucugcuauagcccauuauuacauuuuccccaguaccauuggcucccaauucacuauacuucagguaucucaaagacauuuacaaaaacuuggaacuaauugguauacaaaagcaucauacugcuagugcacagagggaauauaugaaugucugucaucuacuucacuacauaaguagacaaaaaagcaacuugagagaaugagcauaacucuaaauuugaacguuccagauuuuaaagcuuuggguugaauuaucucaucuucacaacaacucuaagaaauaaucagaacuuuucauuuucagaugucuuuucagaacuucagaugucuaauuaaucauucauuucagaagcagcagaguaacuucuagaccaguguuuuuuccacuaaugacagugccuuauuggauuuuauugacuuuguguugauaaagaauuucaguaguugugcuuuuauuucuucaugccuuuaccacaagcaguucccuuuuuuguaagauccaaccccaucauuuccuucucaaccuggccuaucauuccucaaaauucacucucauauguuuucauugcuauguucccagaacauguccauauuucuauuucuuuugucucuuuuaccuuaaucgcuguuugucuucucacuuugugcuauagugcaagacuauaaaaaugaccaugcaagaugaaauugugcaggaucuugaugauuaauaggaaaaauuaugguuguucccaugaccuuuaaauuuauugucaaaacauuaagaauuuccuuuacugucucuuauaaagguaaaaggaaaugaaaaaaauaguaaagcuaauauaggauuuuguauccuguaauucaaaacauuagaaacacugagaauuuaaauguuuuauuuucuugugaaaacucauuaugaguaguuuaaacggugcuugccuccuccccgugguacagcuuagaauaccaaaugagcuucauuucuugccuuggcaaauugucauaauacugucuacuugacacacuuucaguacuuuguccucugaacuuuugauguugugaaauaucuccaaaaguuccuuuggcugcauaucuagagucucuccaacaacaguguuaacauucccauggucaucuauugcuucucugacucuauuuaugguccauucaaacuucaccuccagcauuauucacuuugcugcacuuucaucuuuugugaucaauuuccucuuuagauuuagguuauucauuuuaauauggguuuaucacugggagacuaggaggcagcccaacuacaugcuuuccugucugcacuugaacugaaaacagaugaccaucagacuuuggaagaacugaugugacuggccacugaugaugaugugugucuauuauuuauguagugauuuuuguguacuuuuuacaguuauucacgguaaaugcacugugguaacuaaaguuugaauuguauuguugggggacugcuguuauuuaauuaaaucaugguaacugaaguuuguauguaucuagacaguguaaagcuaaagcuacuuguguguauguacuuggaaaucaucagucuuauuuguaggucuaggcacauaauaggucaucaggaaagaaauuguugcaugaagaaggaacaaaaauacucucucuggcaaagcuagauuucuacauuuuuuaaauagauaauaaaugaaagaugcuuuucuauauguaguuuaguucuccugcuauugggucuauuaaaauaaauuccugugcucuacuuucagaaaguugcaugccaaucugaaaccuuaucuauauuauauuacaggcugaccucugugucccuagacugaaugaaggggaccaaguuguacugaucaauggucgggacauugcagaacacacucaugaucagguugugcuguuuauuaaagcuaguugugagagacauucuggggaacucaugcuucuaguucgaccuaauggugaguacucuauguaguaccagauaauuuauaguaauuuauuacuguucauuacugagcacagcagccagauuucugacauaaaacauaagucaccuaaguuuccugcucaaagcacaguggcuuucauugacacguggagcagaauucaaguucuuugcccccccaccccuugcucccacucagccuugcuuacuuuccucuauucuacacuagcuuucuugcaguuacucagaucuuccaaucuaaucgacuuauuaggguuuuuauccuugcuguucccugugcugacauacucuuuuugauuuuguuaugacuuauaccuauacuucauucaggucucugcucagauaucaucuucagaagggcuuucucuccugacuaccauagcuaaaauggucucccauuuccccuaaaugguaauaguuguaguacuaguacucaauaaauacuaguugaaugaaugaguaaauuugaacucuguuccacuuuuagaaaaugccauaacaagcuauaguuaaaguguuuuuaaaauacugccuuuguuuucaguauaugaugucuacuugccuaaucaugucaucucccaaucuggacagcugacuuguuaauucauagucauagaauuccagguuuggagaaaacuugaaugccguaagcucuagcucuuuggcuaauugcacgaauuuccuccacaacaaccucaagaacauucuaccaauauagauagagcacuuuguggcuccugaaacaggucauuccaucuuuggauagcucaaacuauaaauugaacuaaaaguccaucuuucuucaguccugcuccuaagucugucacucugugcuaugcauuauaaguuuaacccccuuuccuucaguuuuuugacaauagcuaauuuuaccagaaacccaccucccuuucuccaguuuaagaguccuagagucuucagccaguguucauauggcauuguuuagaguucccucaacacuuuaucagucugcucuaagaaaaaaguuuuauaugucuaauaucccaggauuagacauauucuucugguuuuguucuauacaauuuacuauuaaucauuauuuuagccacagaauaauuauuguuaaugccauauuaccacuugaauauguaccauaggaaagugaaauaucauucgaauucuacuugucaccaccacacccaacccugcaaaauuuugcaaggauauuucuuuuuuguaaacaaaaaauaaaaaauccucuuuguaccucuuguucacaaauaggcguuuucauuuuaucuucuccacuuuguguucuuuuccauuaauggucuagaauuggcuuucuaggaagauuaaaaggacuucaacagaacauucuauuuugacuuuucaaggaacuuguucauuuagacuugauacuuaggugagucauuagguguuuucugucacauacagcuacuuaaauuuuaaaccaggaauaacauuuuuuucuguauuuauuguauuauauuuucucuugauaauagauccuaaagaacucaauaauauuagcuaauaguuauuaaaaacuuucugugcaccuaggcucuuuuguauauuuucauuuaauccucauagacauccaaugagauugaugaauuauccccauucuagagcugaagauacuuugacaccaagacauucaguuaccugcucacagauucaugacgccacagagccagaauaugaacaaaaauccauaugauggcaaagacccagccuuuuuacaauuccagaucucauccuuuugcuuuauaguaugagaggaacccaccagggucuacuucuugcaaaauaucuuucuaaauuguuucauagucaaaauacggagcagaaccugcaucuguuuucagugugggucugucuuuuccauucuuaaaguuucauauaauuaaaauuuaaaacuguguuugccaagaauauauuuuuguuuuucugaucuuuucuccuuuaauucuuauuucuucuuaggcaaaauguugucauaccuuuuugucuuuucauucuucauuucagaaauuuauuuuucuaaaaaaauguauagauauucaaggaggaaccagaucucuuaggcaaggguaaagaggccccuaccuuggcuccauguuuuagaaggcccugcuuuggcucucuuucuucucccaguggagucauaauuuuauaggaccaaaaggacaugccaagcuguaaccucccuucccuuucuauaccacuuuuuuucaaaccucaguucuggguccagauaacccugagccucuccagaucuucauggguauuuuccacacauccguucucucaagguggguucacaugguguguguauccuagcccagaagguggcuaagaggcuacaguuuguggagggacagguauagauauaucuugcaugugggcugggaucuucacauguauguuuauaagccccuauguuaaaaaaugggacugagaguggguaacgguagaauacaggccuaggaucuagggucugaaucuccucacauuaccaugaccaugaauucuggccuagaauucucauuuauagucuggccucccagguuguuuuguagauacaucacagaaagaggaugaagcauauuuuguuuagcacuguguucaaguuuuuuguaacuucucauaguuaaacauaugguauauaggucucuauuuguacucuugcccuagguccccuacaaauuaagagcggguguauucacagcugcuucucagcagcucuucuuucuuacugucucuucaaguuauagacauuuucagcaauguagccaagaacacuucuucccuccaaagguacagcaaagccccucaacuccacaacuaguuucuguccccccauagugacaccagacucagaucugguguaauucuucacaaaugaauuauuuuuugaacaaaacauuauacaguguaucugguaaauuccuaucgugugaauucauuaagauuuccacguuuugggguuuguuugauuuuuuuuuuuuagcuguauaugauguaguggaagaaaagcuagaaaaugagccagauuuccaguauauuccugagaaagccccacuagauagugugcaucaggaugaccauucccugcgggagucaaugauccagcuagcugaggggcuuaucacuggaacaguccugacacaguuugauguaaguaauaucauuauauauuaaaagcauuuugcugauauuugcuaacuaguuucauaguuucuuaagugccuaaucugugcauuauaauuucuaaacuaaaaugauauucugagaaauguuugacauaaagaguucuaaaaugccaaguuuuaaaaauugcucccaaaauacuagcuaugguuauauaaauagaauauguuuuaaaaagagggauaaggaaauuuuauacauaugucaucaaacuaaauuuuuuucuauaguuaaauagcuguuuuuuugaaagguggcagaugaagauaggcuauuauauacuuuaaaauccugagcuuggccaggugugguggcucacgccuguaaucccagcacuuugggaggccgaggcgggcggaucacaaggucaggagaucaagacaauccuggccaacacggugaaaccccgucucuacuaaaaauacaaaaaauuagccgggugugguggcaggugccuguagucccagcuacucaggaggcugaggcaggagaauggcgugaaccugggaggcagagcuugcagugagcugagaucgcgccacugcacuccagccugggcgacagagugagacuccaucucaaaaaaauaauaaauaaauaaauaaauaaauaaauaaauaaauaaauaaaauccugagcuaaaggaaaauaacuuuuauuuuugaaguuuauaccuugucauuuaaucuuuguuuauuuuucauuggugcaaucuugaaaacuggaaaaaccaaaacuuucagacagaucauuauauccaaugaacuagaaugcuucuucagugcuuauaaugugcauuuugacccacgaucacccaguggauuuugaaauguuuuauucagacuauaucaaccuaauuuguuuaaauuaauaaaccugaauuuuuuuuuuuuuuuuuuuuuuugagaagcggccucucacuauguugccuaggcugaucucaaauuccuauguccaaacaauccuccagccucagccucucaaguagcuggaauuacaggcaugcacagccaugcuaggcucccuggauaguuuuuaauguguuuuuagaaaugaccaucauuaauauuuguuguucugacauauauguuauagguaaguguuuaacuauaaaacauuuaggauaugucuguuuuuguucaaaaguucuuaguucauagacuguaaacaccuccaaacuaaaugaaaguuaaauguuuucugcagauuugcuacucacaacuucaggugcuccugcuguaagcagaauugguuucacuaguuuuaccacuuuucaaaauaugacacauaauuuauguuagaaacugaagaauucagcuuugcaaaucugguucaguacucuacuagacuaugguauaucauuguauagaugaccuauucaaaggcaaagaaaccuguuuccuguuaguguagaaacaagucugguaaacaaaagagaaauuguuuauggcuuuuguuggaauuguaccuuuuuuuuuuuuuuuuagcaacuguaucggaaaaaaccuggaaugacaauguccugugccaaauuaccucagaauauuuccaaaaauagauacagagauauuucgccuuguaaguaucuuauugucucuguuaaauuuaaucuuuuaaacauaacuuuacuaaaacauuauuucuuuuaaauuuuuuuagaugaugccacacgggucauuuuaaaagguaaugaagacuacaucaaugcgaacuauauaaauguaaguuuauucuuauuaugccuuugccauuuggaaaaauacgagccacuaugaacuuugagguucuuuuuguuaaaauccugaccuggauagaauauuaaaacuuucagcuaugaaaaauauuauugaaguaauauuaaagaaaauauuuugguacuuguguauuaauacagguagagcaguggaauggaauaguccaguucauaaauagacuuagauacuagaauuuuguuuaugguagagguggccuuuuagaucauuggagauagacuauccagugaaugggugguugggucaacugucuagaacaggagcccccaaccccugggccauggaccaguaauugucuagguugcaugcucauuaugaaaaucuaaugccugaugaucugugguggaacaguuucauccuguaaccauccccaccucccacccucccaaccccacuccauggaaaaauugucuuccaagaaaccagucccuggugccaaaaagguuggggaccacuagucuagaauacgucauuguaaagaggcauuuuuuuuucuuaccuggaaaaaaaaauuacuauuuuuuucuuaacucuguaauuagaaaauuucaaauguacaaaauuaaagcaaaccguaaaaucaaccuucauguacacaucacucaguuucagcacuugucaacugaugacaaacuugguuucaccuuuaccagguucuuuugaagcagaucuuuauaucauaucguucaucuauaaauacuuuaccucuacucacucuugaugccaacauguauuucaaauauaucaaaauguaauuuuuaaaguggaauuaugaaauuauuugaaggaaauaugugaaaauuguuuaaaaucucaaggggagguuuuuuaagcuuagauacaugucuaagcuuaaagagaugaauuugacaagguaaaauuuguuauuuuugguaugcuuaaaaacuacuaaaaucaaaugacaaauggaauuuuuuaaauacuagaaaaagcuuauuuaauauacaaagagcuucauaaaugaauaagaaaaguaagccucggcaacauauugagaccccauuucucgaauaaaaauaaaaauauaaaaauauaaaaauuagcagucaugguggugcaugccuguugucccagcuacucaggagacugaggugggagaauugcuugagccugagagguugaggcugcagugagccaugaucacaugacugucacugggugacagaacaagacccgucuaaaaaaaaaaaaaagaacaaugaaaauaauggaugaaggacaugcaaagacaauucauagaaaaggaaauuaugcaaaugacauuuuuaauagucauuuuuaaauuuauacaaaaguagagagaauaguauaaaagaguccccccauaccucuuacgcaguuucaagagcuaucaacuaguggccaaucuuagcuaaauacuaaccuccaaauuauuuuuaagcccaaauauaucacuguauaugucaguugaguuaauucucaccauucgauguugucaugcucuagaaagucuuuguacaugcuaaauuagagacuauuuaaucauugcuucuagggaaaauacaggguuagguucccccaggccaaaagucacaacauuuuaauuagcugaucaauacauacuguuguuucuguuuaaagacacuuuauuuaauauauagugcugauucauuaacauuuaacucauagucaacagcacuauaacucaugccucaaggaagcuuaucuaacacacauauuuucuccaugagguauaucacauccuucuugcacuuagaaacacuagucagcacuuuaaaacuacacuugggggucaguuuuaaacagcaaaaucaccaguaaaaaaacccaaaagguaaaaaguaaggcacuacauagaaugcaaaaaggccacuuguuuacaguaugagagcuaaaacaaaaugaguugguuuguuugaucucaccuggaaaugugcaugucuucagaugacucaaauuuuucacugcucuaaguaugucuacuagaugaccaagaaaucccugcagcuguuuugaggguuaugaauaaauuuuagcaaguagucaaauuugcaaauagagaauccuugauggaggauuagcuacuuaggaauauaucucugauaaggccuuuuuuuuuuugguagcaaaaccacaauacuauuuuaacacuuagaaaaauaauaucagaguuaaaugaaaaauacgugcaguuuacaaaaagaaaagugcaaaugaaaacuucaaggaauuacuauuucaccugagauugaaagagcaaaaguuugguaauacuacauguagguccacauccuuuaugugaaaccuuagguuaaauauacuauggggccaggcgcaguagcgcauuccuguaaucccagcacuaaagagaggcauaagcuggaggauagcuucagcccaggaguuugagaccugccuaggcaacauuaggaagaccucauucuccacauaaaggggcagugagugggaggguguagaaaaauaugcuuugggauuccgaauuuuuggaauuuugaaaggguauuuaguacauauacuauaauaaguagcaucgcuggcaggcuaugggacaagugcuccauaaucaauauaucugaauaguuaacagcaaacuauagauauucucccuaaguaagacuaauaaagagugcaaauagucuuaggucaguucaggucagauuuugcugucaaaugagcacagguuggggcaaguuuacagaaauaaaaaacaugagggccuuaaaucugcauuaaauauuuucuuguauauuuauacaguagagccauuuaaaagaaugaaauuuuauuuacucaucaaacaucaucuugaagaugaaguaaaaaagacaagcagaacaacauuauauauauaguauacuaccauuuuuaagcaacaguuuuacagaaaagugggaaguugcauauauguuuauauguuguauauagaauaucccugagaaggcuauaugacaaacagaaaaagauuaccuuccuggcugcaaacuagaagcugaaaugggagaagagacuuucuuuauucacucuuuguuauucuuugaauugucaugugcauauaucaccuuuuuaaaaaaaauuuaaucucaaaauguaguaggauaaugacugaugacucaacuuucccaaauacuaucuuaccucuuucugaaaauuaugaauuuaaaauauucugauacccucuaaaguuacuuuauauguaaaaauucaagcuaaaaccaauggcagaauuuuuguuccucacaaauuuuaccaauaaacuauuuacagauaaguauuuuuuauuucuuuaccaagucucugccucugaaacaaaauucuguguuaagcugcuuuuaaaaaucauaaucggccggguguggcucacaccuguaaucucagcacuuugggaggccaaagcaggaggauugcuugagcccaggaaaauauuuaaauucuuauuuccacuaauuaaaagauaaauacauguaacuguugaacauugccaugaaauuucuucuacagauaaaauaagaaauuguuaauaaagauuuguuuuacugacggcaguuuauugagguuaguuguauucacuauaacaguuaguggaugauuuuccuauuccugauuacuguaaaaaguaaugcaaaacauuuuauuuucaugcccuuuucuuuuuagauggaaauuccuucuuccagcauuauaaaucaguacauugcuugucaagggccauuaccacacacuuguacagauuuuuggcagaugacuugggaacaaggcuccucuaugguuguaauguugaccacacaaguugaacguggcagaguaagucauaguugaaucuuacacauugcuuggacuuuuuucaaauuauacugcacauauguagucaaaauauucauauuuauuuaagccuuuguaaccuuuaaucuucuuuucuugugguuucuuguuuuaaaucaucauguuuaagugcauaaaacugugacuaacacauaaauaaaugugacauaaguguuagccauuacugucauuguuauuuaaagggauuaauauacauuuguuaagggucuugugucuaacguauauacagaacucuacaguaaaauaaauaaugcaauuuaaaaaugggcaauggaucugaauagacaguucuccaaagaagauauacaaauggcuaagaagcacacgaaaaggugcucaacaucauuaucagggagaugcagaucaaaaccuuaaugagacuuuauauccuagaggauggccaaaauaaaaaggacguauaaaaacaaguucuagggaugauauggaaaaaacagaacccuccuauuguggguuuguaaaaccauccagccauuuuggaaaacagucuuguaguuccucaaagaguuaaacgucgaguugguauaacuuaguacuuccauuccuaaauccaaaagaguugaaaaggucuguccacacaaaaauuuguacaugagcauucauaacagcauuauuuauaauggccaaaauguagaaacaacucaaauauacaaauaaaaugugguauagucuuaugguuggauauuauuuggcaauaaaaaggaacgaaguagugauacauacuacagcauggguaaaccuggaaaacacuuagcauagugaaagaggucaaaaagaccacauaguguaugauugcauuuauaugaaauguccaggauaggcaacucuguagagacaugaaguagaucagugguggucuagaucugggguaaggaugggggaacggaugaggaagaaugaacaaugacuacuaauugguauaggguuuauuuuggguguaaugggaauguucuaaaagggauuguggugaugguugcacaguucugugaauauacugaaaacuauuguauacauuaaacgagugaacgguaugguacaugaauuacuugucauuacagcuguuuuaaaaaaucuuaagauuuaaugaggauuuuugcugccucaaaauauagccagauuacuuacuauuaaaaagggaaaaaagugacaaagaaaaaaugucggcugggcgcaguggcucacaccuguaaucccagcacuuugggagacggaggcagguggaucaccugaggucaggaguucgagaccagccugaccaauauggugaaaccccgucucuacuaaaaauacaaaauuagccaggcuugguggcacaugccuguaaucccagcuacuugggaggcugaggcaggagaaucgcuugaacccaggaggcagagguugcagugagccaagaucgugcuauugcacucuagccugggcaacaagagcaaaacuccaucgcaaaaaaaaaaaacacuagucagcagaucgagaugaaauuuauuaaauuuuucuuguaacuuuuauauguuugaaauuuauuaaaaaaacauuuuuaaaaauuggagaacaugaauccauauguauauaauuuuauuuauuauuuauuuauaucaauaucagguuaaaugucaccaauauuggccagaacccacaggcaguucaucuuauggaugcuaccaaguuaccugccacucugaagaaggaaacacugccuauaucuucaggaagaugacccuauuuaaccaagagguaagaaggcaggauaucuguucauuagaacuguuguguucaggguaaagacugaaagcugaaaauguuuuuaguuugaguauugguugcuaggaaauacuauaagaauuauugaauuauuuaucugcuuuaaugggguacuuuggaauuuuauuaagaguauuauccuauucuauuauaaaauuaauguuuuucuuuaguuucuaugacuaaauaugaauggucagugaaaaaguagucugguaaauaauacuacuguuacuacuuugcuuauucagaacaacuguuuagauauguuucauuauaaaaaaaacuuuuacuccaaguaguaucaguacaguauuugggugugucuguggaaauggaaaaaacaauugaaagcuauuaaauuauuuuccuuuuuuaaaagaguagaggagagcaacuucacaguccccuaccuauuaagaaggaaaagguuguaaccaggaccuucugacagcagaugggguguagauuucuaauugccagcucuuaauuuugccugagucaguccucuuggcuucaaaugaaacugauuaauaaaugauggcucaguaucccaauuggaagauguauguagagagcgucaugcugccaguucugucaggcugcuagagacagugcacccuacuuucucugccugcagcuagcuaucccccugccaccaucuuugguuuugaaagggacuaaaagaauaacugcuagagaagagcaaauagcccaagcuaugagugcccaggacuaucccaucaauggucaagccuuuggaaaugagaacuccccuccaaccccaagagcaugauuaaaggaaaccagagagacagagucuuacugacgaaaagggaagaagccagaaguugugcugauuuauagaaaaggaaucuggcauugaauaaagcuaaaaugacaagaauuuuaaaauuucaaaauuuuaugggcuagaguccaucagaaugaauuuaggguuuggggacauauacuguguagcucauggucuaauguaacaggucaagccaauaugauauuucuucauuuucucaaauagauaaugaaagauaggcuacguauguuuauauaaaauaaugucuaucuuuagcauagucucuauuauacuccaccuguagauuauccaugacaguuuuauauaccauaguggcuuuucuuuacacacccugaguacauuagaacuaagacaugaguuaguuucuaaaguuugagccaaacauaauugggaaaaugaguucgcucccauaaauacauacauacauggauggauuaaugauagcagauacuaccucaagucuugaauaccuuuuacuuuuacucuucaggaagcucucuucaguguaaauggcaauaaccauaguuauaauuauaguguugaaugacuauagcaaccauuuauugaguauauggugccaaguagcugauggggugauuuacagguccucucauggagucuuuuuagcauaagacugauccuuuaaaguauagauguuauuucauuuuucaguugaaggaaauuauuuucugaaacacugaaugcuguaacuggcagagucaagauuugaaccaagauguaucuaaacgcaauacucuuacugucuccguuauaccaaccuuggcucuccaaaaagaauuaaucccacugauuugacuuuguguuuuuauuaacuccaauuuuuaauauacauuuaucuugagauuuuauuuuucugauuuccauaauuucaucugcauugugugaggauuaggucagcuuuguucacaaaaaauguuuuuuacuuuaccauuuuugcucacccaagaauucauuaguuuuuuuuaagcauuucucugggucuuaauuuguuucuaccuauguacuugauuaucaucuuuaaaauacuuuacacauauagaaauugaguuauaaaaagaguaguaauguaauuagccauacuuaaauggauacaacuauuucuguaaaauaguuucuuuccuuuuuguugaaauuuugcauuuuaaugaguuuauacauaacuuuugguggagaagaggagugguugguuuugcuuuccuucuaaaauuccaaugacaugaauauauuuuaaagauaaugucauaguaccaacagguucauauuccugcugugcaauaacagacgaauacacugagacagcagggaugcagcagauaaagaguuuaaugaucgcaggguaccgagcaaggagaugggaggagacccucaaaucaucuccccaaggagaugagaucugggaugggguuuuuaaggggaugguggagagcaaggggcugggaaguuaagaucguugauugguugggauaagguggaugaaaucaucaggaggugcauucuuuggugaguuagcuuaccucaggguccuuuagaccaacugagucaguaguuucaucaguaugcaggacccaaaagaaugucucaaaggggaaaucuaacauuucauaaugucccaaguuguuaucuguagagcaguuaaggggaacuauaaucuuguaaugggucugugggauucugaggcaacaggcaccaaccaacuaugaggacgcgggucagagagcagcugaccuagugaucaaugcuaagugugcugcaagcuguguuuaguuuucuaucucccccucccuucuuuccugaugaauuuuaugagguuuguagggacaauuucaauaauacauaagucaaggugcauaauuuuucauuuguucuuagaaaaaugaaagucguccacucacucagauccaguacauagccuggccugaccauggagucccugaugauucgagugacuuucuagauuuuguuugucauguacgaaacaagagggcuggcaaggaagaacccguuguuguccauugcagguacucuguuuuccgucuuuuaugaguguauagcugaacagauacgucauuuuuaaaagagaguacauauuuuguccuuaugguguuauugucacuguaauaauuagaacucaaagcuaugcucugaagguaggaggcaaaggauauguucuaacauaugauuggcaguaacuuuaucauaagauauaaaaauaauacugauugcacugauucuuagaugcuccuccuuuucauauuuuaacaccucugaaauuggucuuaacaauuuacaauagauuugaugaaguacaguacugugggcugucuuaguccauuugugcuauguaacaaaauauucgagacuggguaauuuaaaaggaacagaaauguauuucuuauacuucuggaugcugggaaguucaagaucaggguacacacagguucucaugagggucuaaugaggacugcucucugcuuccauuauggcacuuuguugugucauucucuggacgggaugaauacuguuuccccacaugcuagaagggacagaaggggugaacccacucucugaaguccuuuuauauaagcgcuuuaaucccaucagcccucaugacuuaaucaccuccaaaaggucccaccuuuucuuuuuuuucagucggagucucauacugucacacaggcuggagugcaauggcaugaucacagcucacuguaaccucugccucccaggcucaagugauccuccugccucagcccccggaguagcuagagguacagguguaccaccaagccuggcuaauuuuuguauuuuuuuguaaagauggguuuuugccacguugcccaggcuggucucgaacuccugggcucaagggauccaccuacuucggccucacaaaguguugggauuacaggugugagccaccgcgccucaccgguuccaccuccuaauauuaucacauuggugauuaaguuuuaacauaggaauuuuaugggacacauucagacaacagcuuaggcauuagguuacagccuaauauuuagauucccuuccuucuuccuugccuguggcuccucuuaggacauucauugaguacuccuaccucucuugaagugacccuaccaaaggcuuugcuacuucuaaaagcuuuaaguaaacagcaggcuacucuuucuuucuuugagacccaaguccccuucugcccucaaagggccaaauacagugacuucagucuuuacugcuacugauccagagauuaggagacaguuguuccucccuauuacggccaccuuuguuaagugauuuauucagaggauaucuugagguaucucuuuauacuuagacuuuccaacacacuuuaagaguagaguuucaaaucuucaaaacagauuauagaccaaaauuugagagguaaaguagcaagaauggugaaacaccauuuuauaucccaagucccugauaacuacugcauucguguucacagauuagaaguuaaaaaguuguucuuggcuaucccagugguaaaguuuaauuuaaaaucagaccgggagcgguggcccaugccuggaaucccagcauucugggaggcugaggcgggcagaucaccugaggucaggaguucgagaccagccugacaaacauggugaaacccugugucuacuaaaaauacaaaaaaaauuagccaggugugguggugcacgucuguaaucccagcuacucgagaggcugaggcaggagaaucgcuugagcccaggaaguagagguugcagugagccgagaucgcaccacugcacuccagccugggcgugagcgagauuccgucucaaaaaaaaaaaagauauauuugaguuuaaaauauuguugucuuuugugcauucguugaugguuuauuauugucauucuaucauuuugcauuuuaaggaguugcuccaguaagcuucuauuccuuguucagauuuuaaaaacuuaaauuuaacuccuuuaaaauaguauuuuuccaacuaacgugguagauggaagauacagaacaaguaauugagucagugcauuuuuuuucuguuuucaaaauauucuguauuuggcuuacuacuuuuauaauuaaaauauuaaaaugauauuguucuucuguguuauaauucaguuuuaugcacaaaagccacaaguaguuuaacagaauaguaucgguaagaucuugccuauauuugucuuuuuuagugcuggaaucggaagaacugggguucuuauuacuauggaaacagccaugugucucauugaaugcaaucagccaguuuauccacuagauauuguaagaacaaugagagaucagcgagccaugaugauccaaacaccugugaguacuguacuuuauauacaaguguauauucuuaacaugaugauuuuuguugccaaugcauauucuaaaucauauuuuuauccuuuuuuaucuuuucaauuccuugccauggucaaauaaccucuagcacagggguaagcaaacuacugcccacuagucaaaucuggccugccacuuguuuuuguaaauaaaauuuuaguggaacacagccaugcucauuuaucuaugccugcuuugauauuauagcugcagaguuuagaaguugcaacaguaccauauggacugcuauuucuaaaauauauuuaauaucuggccuuuuacagaaaaaguuuugcuaacaugcaaguugccuggcauauuaaaucuugagugcuuaaacaggcacagaggaacuugcuuuguauuauuuagucaagcugaaugcugagaaugauaguaucccugaacuggagagucuugauagaccugcuuucugugaaauagcuguggugaaauuguuuuucuuuuuacauaaaaacuugcauugcagcggccgggcgcgguagguagcucacgccuguaaucccagcacuuugggaggccgaggcgggcggaucacgaggucaggagaucgagaccauccuggcuaacacagugaaaccccgucucuacuaaaaaugcaaaaaaaauagccgggcaugguggugggcaccuguagucccagcuacucaggaggcugaggcaggagaauggcgugaacccgggaggcggagcuugcagugagccgagauugcgccacuguacuccagccugggugacagagugcgacucagucucaaaaaaaaagaacuuacguugcaacaacaaaaauuacagaaauuaaguuacuuuuuagugcauucuacacugaguauuaauuaugcuucaggagccaaaagaagaaucauggaauuuuaguguuaaaauuaucuuuugcacugauuaagacacugugaaauaauagcauuguugguggaauagguuacuugaaggaaauugaccuaugugauccaguaagugccuauaauuuuuuuguuuuuguuuugugagacaagagucucacucuguugcccaggcugguaugcaauggugugaucauaacucacugcagccucagccucccaagcuuaagcaauccucccaccucagcugggacuacaggcaugagccaccacauugggcuaauuuuuuuuauuuuuuguagagaggggaucucacuauguugcuuaggcuggucuugaacuccuggguucaagcuguccugccaccucagccucccaaaguguugggauuacaggcaugagucaccaugcucagcuugguuuuuaauuacagaaaauuucaaacauagacaauauaaugaauaucauguuuauacucagaucccacauuugccauauuguuucaucuggauagcuguucacuuucccuguauuugaagcaaauccuagauaucauaucauuuuguucauauuuuaguguguaucucuaaaagauaaggauugauuuuccuuuuaaauaaaaccgcaguacaauuaucaagaaauguaaucaauuucuuuuuuuuuuuuuuuuuuuuuuuugagacggagucucgcuuugucgcccaggcuggagugcaguggcgcgaucucagcucacugcaagcuccgccucccgggaucacaccauucugcugccucagccuccugaguagcugggacuacaggcacccgccaccaugcccugcuaauuuuuuguauuuuuaguagagacgggguuucaccauguuagccaggauggucuagaucuccugacuuggugauccacccgccuuggccuuccaaagugcugggauuacaggcgugagccaccacacccggccaucaauuuguuaauauuaucaaauuggcaguauuuaaauuucuaguuguuuacuaaaaaccgucuuuuuaaauuuuauaacagcuuuauuaaaauacaauucacauaccauaaaauucagccgcuuaaaguauacaauucaguggguuuuguguauuacagaggcuugcaacuauugcuacuauauaacuuuuauuuuuauuuuauuuuuuauuuuuuugagacagaguuucgcuccuguugcccaggcuggagugcaauggcaugaucucagcucgccgcaaccuccgccuuccggguucaagcgauucuccugccucagccucccgaguagcugggauuacaggcacccgcaaccacgcccagcuaauuuuuguauuuuuaguagacacagggucucuccauguugacuaggcuggucuugaacuccugaccucaggugauccacccgccuuggccucucaaagugcugggauuacaggcaugagccaccaggcccggcuauauaauuuuuaaaacaucuucauucccugccaccaccccaccccaaaaaaccccaagcucauuaacaauuauucccauuuccccucauacccucucuaaccucccccaacccccaaccuccaaucuaggcaaucaccaaucuacuuucuuucucuguagaguugccuauucuggaccuuuuauaugaaugagaucauacacuuuggucuuuucuaacuggcuucuuuuaaguagcauauuuaaagguuuaucuguacugcaguauguauuauuacuuuauuccuuuuucuuguucaauaauauuucauuguguauauuuuuaccacauuuuguucauccguuaaucuguugauggacauuuauuugguuuguauccacuuuuugguuauuaugaguaaugcugccaugaauuuuuaugugaacauacguuuucauuuaucuuggguauacccaggaguggaauugccaggucauguuuucauucuguuuaaccuuuugaggaacggccaguuguuuccaaaauuucuguaccauuuugcaguuccucuagcaguguauguggcuuuuguuuucuucacaucaucaucaacacguguuacugucuuuuuuuauuuuagccauccugcuggguaugaaguaguaucucacugugaauuuguugugcauuucccugauaacuaauuguauuagucuguuuucacacugcuacaaauaaacacuugagacuggguaauuuauaaagaaaagaggcuuaauugacucacaguuccccaggcuguacaggaagcauggcugggaggccucaggaaacuuacaaucaugguggaaggcaaaggggaagcaagcaggucuucacauggccggcgggagagagacagagaaagaagcaggaggugcugcauacuuucagacaacuaugucuuguagagaacucuaucacgagaacagaaagggggaggucugcccccauuauucagucaccucccacaaggccucuccuccaacacugggaauuacuauuugacaugagauuugggugaggacacacagcuauaccauaucacuaaugauguuaagcaucuuuacaugugauaauuagcuauuuauuuguauauauuuuuuggagaacuguucaaaucuuuugccuguuuuugaauuuggccgccauuuuauuggcgaguuguaaguauuuuuuuuauguuuucuggauaaaaguuucugaucagaucugugguuugcaaauauuugcuuccauuuucucuuucuguuuucuugauuauaguaguugaugcacagaaguuuugaauuuggugaagucuaguuuaucuguuuuuccuuuaucacuuaugcuuuugguaucauagaugagaaauuauuaccuaacccauaaaugagucuacaaguuuuauaguuuuagcucuugcauuuagcauugauccauuuugagcuaauuauugugugugguuugagguaggguuccaacuuaacucuuuugcaugugguuacccacuugucccagcaccauuuguuaaaaugacuguucuuucccauugaauugucucagggcucuugucaaaaaucaguugagcacaaauauaagaguuuauuucuagacuuccaauucuauuccauugauuuguaucucuguuccuaugcuaguacuacacugucaucauuacuguagcuuuguuguaaaauuuaaaaucaggaaauguaaauccguaacucuuuuucauuuuccagcuugauuuagcuauucuaugccccuugcauuuucauaugaauuuugaauaaguuuauucuuucugaaaaaauaaaaaaaaaaccagcaaccagaauguucauagggauuggguugaaucucuagaucaaauugggaaguauugucauaauagugauaucacaucuugcaaagcaugaacacaggauggucuuucuguuuauuuagguauucuuuaauuuuaauuguaguuuucagcaugcaagucuugcguuuauuuaaauuuauuccucaguauuuuaguauguuuuggugcuauuguaaauggaauuguuuccuuuauuaaccaauaguuuugugugugagagagugaauuucuuaggauuuucuuuugacaagaucaugucaucaugucauuugcaaauagauauguuacuucuuuccaaucuagaugccucuuuccuuuuucuuugucuuucuuguauaaguauccuggauagaaccuccaguacaauguugaauagaagugaugagaccagaacacuugucuucuuccuaaucuuagagggacaguuuuuagauuuucacuaauuaucauauuagccauggauuguuuauaaaugcccuuuaucaaguagaagaagaucccuuuguuacuuguucauugaguguuuucauccugaaaguguguucaguuuuguuaagugcuuuuccugcaucugagauaucaugugguuuuuggucuuuuauucuauuaaggugguauaugacauugauuuuuagauguuaaauugaccuugcauuccugagauaaaucucacuuggacauaguauguaaugcuuuuuauauguugccugauuugauuugcuagcauuuucuugaggucuuauaucuauauucuuacauaauaggauuuuuaaaaagauuuuaauuauggcaaaauacacauaacauaaaauuuaccagcucaaccauuuuuaaguauacaguuuagcaguguuaaguauacuuacauuuuuuugcaaccaauuugcaauuucuugcaaaaccaaaacucuauauccauuaaaaaaaacuccccauuuucuccucuccugagcccuugguaaccaccauucuacuuucuguuccuaugaguuugacuacucuagauacuuuacguaaguaaauucauguauuugucuuuuucugacuggcuuauuucacuuagauuaaugaccucaagauucauccaaguuguagcguaagucagaauuuccuuccuuucuaagggugaacauaccacauuuucuuuauucauuuaucuaucaguggacaggguugcuuuugccuuuugccuauugugaauaaugcugcuaagaauauggguguauaaagaucucuuugagaccuugcuuucauuucuuucagguauauaccuagaagaggaauuccuggaucauagcacacaugggcuuuugguuuuguuuuuauaauuuguuuaaaaucagaauucagauauagucuacacauuuugauugguuuauaugucucuuaaaucucuuuuaauugaaagcuuccuccuucauuucuuguuuuuuuuuuuuuuuuuuuuuuuuuuugguaauuuacuugauaaacgaaucagguuguuugcaacauauuucugacggcgugaauuuugccaauuuacauccucaaggugguguucucuguguuuccuaaaagugguacauguauggcuugagcaucuuaggucauauauucuuucuucaaacgcacauaaugucugauugucuuuuuuuugugaaguuagcacccuugaguaaucaaucccugcauucauuaauucauuggauuugcaaaauaaugauauucuaauucuaucauucugucuuuauuagcuggacuacuucuuuaaagagaaacuucauaucuacuauuugguuagcaagugguauagcauguguaggaaaggcaagaaaaacauuugauucuuucccuuuaucuauaagcuuucaauauaaugaaucauuuacuagcuuccuccaagggugaugacuuaaauuuauuuggguauuauuuugaaaucaaggauuuaaacauaguugauguguuuuagcccauuguaguuuuuguuguuguuuuguuuuguuuuguuuuguuuugagauggaguuucgcucuuguugcccaggcuggagugcaauggcgcaaucuuggcucacugcaaccuccgccucccagguucaagcaauucuccugccucggccucccaaguagcugggauugcaggcgcccgccaccaggccuggcucauuuuguuuuuaguagagaugggguuucuccauguuggucaggcugaucuugaacuucugaccucaggugauccacccgccucgaccucccaaagugcugggauuacaggagugauccaccgugccuagccuguaguuauuuuucuuagugauauccagauuguccuauuuuuggccagugggagccuguucaccuuggcuucugaguccuuuugucaagacccugguaacuuugauagcuuuguugcuaucagaaaauauauccaggcccagcuuguacaucuugugccccugauuuagaaucaguaguuucuccaagaagcccgguucuuuuuauugagaaacuauuuuaggcaccaaccucugagcacuaaggacuuuuauuugcuuggguuaauuuuugucucucaaaaugauaaauggcacaaccaguaaaauacauuuaucauagguuaaugcuuaugcuuccaauacaaauucaggaccacaguguuuuuacuuagccucuuuuacaucuuuaacaagaauacugguucuuuacaauauuagcaaugaaagacuuagaauaucacaaauacuccacauuacacaacuguuucagaauaacaacacuaccacuauaaacaguauggcuaaugaaaagaguuuuccuuuuuuucacagcucuuuuugcccuuugaguauauucucccacaguaugcagucaaauuacugagguguuuguuuguuuguuuguuuauuugcaguauuuuugagacagagucuugcucuguugccaggcugguuugcaguagugugaucaccacucaucgcagccucaaccuccuuggcucaaauguuccucccaucuccaccucccaaguaucuuaggacuacaggcacacaccacagcacccacccaauuuuuuuuucuuuuuuuguagacacagggucuugcuguguugcccaugcuggucuugaauuccuggccacaagugaugcucccaccuuggccuacgagagugcugguauuacaggcaugagccaccauggccagccaaauuacuguuuuaaagucccuucagggaugggugcgguggcucacgccuguaaucucagcacuuuaggaggccauugcagguggggaucaccugaggucaggaguucaagaccagucuggccaacauggugaaagccugucucugcgaaaguacaaaaauuagccgggcaugauggcaggugccuguaaucccagcuacuccggaggcugaggcaggagacucucuugaacccgggaggaggagguugcaguaagucaagauugcgccauugaacucuagccugggugacagagugagacuccgucuaaaaaaaaaugucccuucaaauagcucuccucuauaugguugucaucaacuagauacacacauugauuaguuuuaugauauugccaaugcuuagggauuuuaagauuuuuauaauuauaugcuauauuuacauuauuccaaaguauaaaucuaaaaaggaagguauauuuaaugaagucuagucuagucucugucccucuccugcucccauuucccuccaucccuuuauaagaaacuauuuuuauuuauuuuauuuuauuuuuauuuauuuauuuauuuuuuuuuuuuuugagacggagucucguucuguugcccaggcuggagcacaguggcgcgaucucggcucacugcaagcuccgccucccagguucacgccauucuccugccucagccuccugaguagcugggacuacaggcacccacuaccacgcccggcuaauuuuuuuuguauuuuuaguagagacgggguuucaccguguuagccaggauggucucgaucuccugaccucgugauccacccaccuuggccucccaaagugcugggauuacaggcgugagccaccgcacccggccaagaaacuauuuuuaaaauaauuuauucuuccauugcuuuuuuuuucuuaacauacaucaagauagauacuguauuuucuucccuuucuuuuauaaagguaauauaauauauuauacguacuuuaccuaccuugcuuuuuuuacuuaauaaaauaaccuggaaucauucucuaguaguuuguagacuuuuaucccuuuucuucccgacuagcuaguauuccauuuugagaauguacaguagucaccuggucccuguugauggcaauuaaauuguuuccaccuuuucuguuauaaauaauuaggcaaugaauagccuuguuugugaauauguguuuucaguuucuuuuucugguuuauuuuuuggauagauucuuagaagugggauugcugggugaagagguaaauuagguuaauuuucuuauaugcugccaaauuccccuuuauagaggcugcaguauuuuaacaucccuaccagcaacauauaagugaguuuugccaacaaaauauauugccaaacuguauuuuuuaaccagucuagacuguuagugaaaaaugguaucuuuaugcaguuuuguuuugcauuuuuuaaguaagcaagccaagugagauguuugucuuuuuuggggggagaggggacgguuuucugacuuuucugaucaguucuguuuuuuauauuuuauuuuucagagucaauacagauuuguaugugaagcuauuuugaaaguuuaugaagaaggcuuuguuaaacccuuaacaacaucaacaaauaaauaagaaagcaaaaagaucugggauauguguuggaaaacugcuuucccuuauguucacugugccauaaugcugcucgcaggaaauggcauuuuacaaaaaaaaaaugaagaacucaaaaaaacuuugaaaacuucagcacuguugcacuuuauguuuuaaaaaaugucacucuuucaaaaucuauaacucauguauuugaagacuguuucaugcuuugcuccgaacaaauaguaaauaacugaguauguucaggguaauuuaugaaauuuugugguggugccaugcaauccccuuuugguagaauugccacaaacaaggcucaaaauucucaucaucucuguuauacaccuguaucaugaaagcaaaaagaaguaaacaucaggagucagcucug

SEQ ID NO: 191141 - RNA, 68631 nt, Homo sapiens
guaauucaguuuuaauuuauuuucaucacuuuuucuucauaauccagauauuuuaaaaugcaaagaaaauuaacuuucaaugauauguucagggacuggcacuaaaaaaaauuuucagacugcaaaugaguuauacaaaugaaaauaucaaauggagauccaguuaucaaaaugaaagcacucaacauauuaaaaguucacaaguauuuguauugagcacauuacaaaagucagcuugcuaacuguugugauuuuaaagaacuauugcagaagucugaagaaaauagauuuauuaguuaacuuauaaagagauuaaagaggcugaaacaaguauuaaaaagaaauuugugccuuuauuagaauguuaggcuuuaaauaugccaauuuugauaaauuauuguuguuguuuuguuuuuuauaagaaaugacacuacagaacugcaauacugguccaacacucuugucuuuacucuucuuuuaaagcaagaaacagaaugcgaguaaucagaaagcacuagcaggcaucaguuaauccaagauacuagcucuuaguuccaaaagcacuugcaaagaaaaccuuuuggggggaagggguggagagggauggaagcacuccauaauaacuggaaucccacgaguguguaugccaagucucaugaggcuauuuuuugaauuuauccuuuacuuggucaugguuuuuucccucaaauacaauuuuucuuugacuuuuuuuccucaaaguauaaaaaguaugaaauauaaacaagcucuugcacugcacacuuagaaguguacaauucaagcauuauagagcuaucuacacacugauaaaucccaucgaaucuuggauaauucauuaauauacaaaauaucagggcacagaaagaacuaaaacccacuucuuuuuguuacacauaagauucaaauauucaaucuaaagaaaaacacaaucacuuucgcucucuucuacaucugcauggugauacacuuauuaaaauauuccuguauaaucauguuugguguuacuauuucaagucagguuuaaaaccucaaaaccagccauccagacaaaacagguaaucagaaagauuaucucuuccccaccucccuaaccccaauaacuaugaagccaauuuuacgacaugacuccaaacacuggauugugacgacaaaugcuagguccaauuucuucauaauccuuuuugguguggcauacuugguagaacucaggcugaaaacaaaaaauauguauuuuuauaagggucaaaaaucuaccaucuugaagguauauugaaauaaacuuuaagagugaugcuuuaaaauagauguuaagucuaaaauguuuauuauuaguccauucauggcaugaaagcuuagaaauucuagcagccaugacuuaaaaucagcuauaaaucuuuaucggaacuccaaaagagcaauuaacuccuguccccaauccuugucucacacaccugcugcgaggauucugaaauuuugaaaaauggaagguucucaaauguccagucuguucuguugagacuuucccauacuuucauugcaccaauaauguaaagaagcggcauucgccuaacuacagauaaaacuacuccuagucaugcuaugacuauuuuucgucuaguucuaagaaaugucuagaucauuugccuuccucauucaaggucuggaaaagauagacuguuccaugcuguguuaccucauuucucaaggcaaagucacaaacucaacuagguuauauggcccaauugaagaagacuaaaauugaggaaaaaaauaacuuucaccucuuauguuggaaaugguuuuaaauccaaaguuguacaguuauucaauaauucagauaaaagcuccuucauuuuaauauugcaugcacuaccagaacaaagcaccaauacuuccuagguuaaugguauuagaacacuagaacaccuuuuuagggggcuuuaaagacauuuuaauuuggggacaggauucuuagaauaauucccuuuauucaguguaaaacaucauacuuucuaugcaaugaagcuuaacuuuuaccuuaauguuuuuaaauacuuaaacagaacaaacaaggaccuucugaugacuaaauuaccaguuuuaacagaacuuucccuacagauaaacuuuaaaacauaguauaaaauggucacucuaaaauaaugucuagcaagcuaaaaaaaaaaaaaaaauuaaauucaaaugacuuccaauuaaauuuaaauuacuuccaauuuuuaaaauacuacaaacacauauauacaaaguuuccuauuauuuugagauacaauuuaaaggaauuugcuuuguucuucuccaaguauugauggacucuucuaucuuaaauauauauauauaaauuuaaacauaagcuucagccaggcgcagcagcucacaccuguaaacucagcgcucuuugggaggcugagguggaaggaucacuugagcccaagaguuugagaccagccuggcccaacauaguaagaccucaucucaauaaaaaauaauaauaauaauaaaggccaggagcaguggcucacaccuguaaacccaacacuuugcuuugggaggccaaggugggcagaucccaaggucaggaguucaagaguaaccuagccaacaugaugaaacccagucucugcuaaaaaugcaaaauuagccagguguggugacgcaugccuguagucccagcuacuugggaggcugaggcaggagaaucacuuuaacccaggagguggagguugcagugagccaagaucaugccauugcacuccagccugggugacaagagcgaaaguccaccucaaaaauaaauaaaauaauaaugauaaaauaaaauaaaaguaagcuucaucacacucaccguggaagccagcauugauccuccaaaccaaacugcauaucgcugcaugugguguguaaugacuuguacaucaauagguuuuggcuaaagaaagacauaguaugaucaucuucauaguaaauucaaauaacaacuucugugucauuuaaccuuaaauguacauauacaaaaauaauaucuguacuaaauucaggugguaucuuacaaaccagaaacaauugagauuggcugucucagaggaaagggguugggaacacuguggaagagacagggagggaacagagcagaauaaauggaagggaaauaacaaugagcacauguuuuauacaguucugacuuuaagaaucuaaauguuaguguuuuacauacuaaaaaauaacaccuuaaaagaaggggagguuggggcaaaacaaaguacaacaaaaacaaauuaaacuaauuguacuuuuuucaaacauaagcacacuaaggugaggaaagggacuaacacaagcaacuugugagcauaguauuuugaaucuuauaagccuucaggcugaagauaaaauauaagcaaauauugaauucuaguuuugggucuauuuuucacagugguguggauuaacaauucugaaacuaucauauacauauuccaggauuaagcaaaaacauaaacauauuauagauaauaggagccagguuucucacugucagagaagggcauuacaauauggaagggcagaaaacuagagugaaccuucuauaacuggagacgucuguaaaaauucaugguuuuaauuuauguagagaauuagauauagauguauaaacacacacacaccccuagcucuaaucacugagaaggccuagacucagugauaccccaacagcaaugagcacaaagcuugguuucuuaguaacguucuccacuaacaggaauaagacaagggugucuugaagaaagaaaaggagaaaaaaagggcugauuccagggccagaaaagagaaaguacaagaucagccugaaacaccuugcugugccgggaaguacagaaguaggcaaaaaaaaagauguggcugcaucaaaaaaaaaaaccuaagagccauuugaauaacucccacuggucaaaucugaaaaaaaaaaaaaugugggauuaaaauuaaugaugagugguauuacugauauuaugauauuacagugauauuaaagauauagaccacaaaaugagaaaucaggaguucauauagauauuacuaaaagaauaaaugaaugugggagaagggaaaacucuugcuuauaguaaaacaagucuuaaaaacauagaaggaaugacagaaauugcaaaacuccauuuagcaacuaccacaguaauaacuguuuuagggaagaaucacaauggaugcuaaaaacuagugacugaaacuuaaaagagaaacaggauagucugaaagugucuccucauuagauucuuauuaaauauaaaggaaaacauaauaacuuuauagugaaaaaaccuggcagacacaacuucaaccaaaagcucaaaauucacacacaggacaaauucuaucaugugucuacugauacaaugcacuaaaaaugauacaauaucaauucuguggcaucacugccaaaaguacauaaucugaaccuacucaagcagaaauauuaaacaaacccaagcugaaggauaugcuacaaaauaaauggcuguacucuucaaaaaugucacauucauucaugaaagacaaaaaacauugaguauguaacagacugaagcaacacaauaaguaaaugaaacaugcaauccuugauuggauccuggauaagggggaagaagguauuuuguuuuccuuuuguuauaagggacauuagugaaacaaccgguaaaauuagaaucaguucuauaacuagauaacacuggaucaagguuaauuucaugauuuugauaauuguaauauguucuugauuuuagaaauauacuaaaauguuuggggauaaugaaccaucauaucuacaauuuaguguguguguguguguacacacaccuauuuauagaaacagaaugauauggcuuuuuucaaaacuguuugguugccauuaaaaauuacagacugaaggaaaauaaagccagagauagauagauaaaggcaugcuauuaagaucuauaaaaguuacuagcaaguaaaacuaaggugaagaaggcagaguccuccaaaacacaagguuuuuccuauacaugaugagcaucccaagucugaaaauccaaaaugcuccaagauccaaaaacuuuuugagcaccaacaugauguucaaaggaaaugcucagaauuucagauuuuuggauuaaggauguugaaccaguauauaaugcaaauacuccaaaauccagaaaaacucaaaaccugcaacacuucugguaugaagcaauucaaaaaagggacacccaaucuguuucuuucaauaugucgauacgguacugaucacuggguaaauuuauuucuuauuuacaaguguaaaaagagcuuaaaaauguuaaacaaucucacuuuuuuaaaauacuauacucagaaacauacagcauuguuuuguacuuauauaucuguaaugaguuauuaaaaacuaaacagcuacuuuaauacauccauaaccauaccauuaggacaaucaacuucaaucuuuuaaguauucuaacaaaaaaaccagaacaugcacuauguucauucacauaaucaaugugguuaguaggauucucaguacagagaauuuauacuugcaaaacccaaugacuucuuuuuuagguaggagguaggguagauagauauguggguaaggggaguagacggaugggcaaaugaauggaugaaugggggugggcuggugguuugguugguugggaaggggaugcaaaagcaaacacaacauuuuaaaagucuauugaguagacuuccugaagugugaagucaugacauuauagggacagaguucaauauuuugccuuccacccaaaacauauacuuuuuacugcauuccuagggauagguuuacucaagauaaucaaaauauaggcacugacaacagucagccaucaugcaauuucucaacaaucagcaaacccuagagugcugugcuuuacuuuuaaguaauucugaaugauuauggaagucucagauaaaguccucauucuugguaaucuuccaagcagaagguauuuuauucacaugaaauaccuuuuuucaaacagcuuugaaaaaagccauaucauuccucuaaaucaacguucugcuucaauauuuaacaaggaugaaaaaaaugaagaaucuaucucuaaauauagaaaguagacaucuaagaauuuuaaauuaauuuugauuuuuuuuaaccucaagccuaaagguccaggacauguaauacaaagguuacuuuauuaaaccaccgauuugacugcacacuuugagguugcuaugugggagcuaaagucaguuuuugagagcaggcuugacuacucaacaauggcaucaaucucaacucagcuuugcuguccuucuauaguauaaaacauuuuguggauccauaauuaauuugauuguugguguaugcaaagaaaucuacuauauuaauuaucuaugagagagguauuuaaaaaaaaagucuuuccacagguauuacuaagaauuauuuuccagaaauacagacaauauccuagaagaaucaaaugauccagaauaucacagacauaaaucuauaacauuaaccauuuccauuagaauaccugacagguuccucuuauuuuucuaaaucagagugaaugcuggcaaauauuucucauccuaaucaaggaaggcacccucaaccuucucaccaauaauugggaaaaccaaccuucaaucuaccaccacucaauuccucacuuaauuucagccgggcaucuacaguucuuuucaaaucucuuugcaagcgacguccaaagucccugaacaugguugaaccuccagagaggacaauauucuaguggagagaaaauaaauauaauauuuaaaaagagaaaaguuuaaagauauaauauauaguacugaaaugcuauuauauccuuuuuaugagagguguuuaaguuuuuuuaaaguaagaccuugaauaacaauuuugcuauaaauaccuuguagagaggacgucugacaucaauaggacaauucugaauuacuucaucuacaacuucugagauagguuguguaaagucuggauuagcaaacugaaaaauaaguuggauauauaauagagaucauaucacuacugacaaauaucacaauaaaagguuaaacaaaguuuucaguucaaaaacaaaaggccuuuuagaaaccacuaauacuggucucuaacagauucagauugaagacacugaaaucagagaaaacucaaaauuaugaugauauauaccauuuuauaacuaucagaauagcaaacauguaaagucauacauauacuaugagcuggcaaaaaucuggguaaauggaaacuuucauauaacgcugugagaguauacacugauguaaccacuauggagaauaauuuggcaauaguaacauagugacauggucuggcucuguguccccacccaaaucucaucuugaauuguacucccauaauuuccacguguugugggagggaccuggugagagagaauugaaucaugagggugguuucccccauacuguucucauggagugaauaaguugcacaaggucugaugguuuuaucagggauuucugcuuuugcgucuuccucauucucucuuugccugcugccaucauguaagacaggacuugcuccuccuugccuucugccaugauugugaggcuuccccagccacguggaaccauaaguccaauuaaaccucuuucuuuuauaaauugcccagucucagguaugucuuuauuagcaguaugaaaacggacuaauacaaauagcuaauaaaauuuuaaaugcacauaccaguaacuccacuucuuacaacaaacucugaagaaacuccccaaacauguaugcuauuacauaugcauauuuacuauagccuuguuucuaagaggaaaaacccguuaaguccaucaauaggggaugaaauaaauaaauguagucuaaucucauuauucaugauuccauauuugugaauuuaccuaaucgcuaaaacauauuuguuacuccccaaaucaaaauaugguuauucauggacaugcacguguagagcaacaaaaauuugaguccacugaugugcacauuccccauugagguugaacaagaugauacucugcuaucuaguuucagcucucauacuauaaacaaguguccuuuucacaguucuauuuaguggcacgguuuucauauuuuuguuagugauuucauuauuuaaaauggcccccaagcauacugcucaagugcuggcuaguaaacacaaggaggcugugaugugucuuacagagaaaaagcaaguuagauagcuuuguucagacauguguucuagugcuauugaauauaaaugaauauacuaaaaugauauacuaaaugcagugccuuuaaaaagaaacacacaugaaacaaggguauauguuaaugggauaacaaaaauguuaccagaggcucaaagaaaccuaauacuguauuuccccuaggagcaauagcuagcucaguguucacuaauucagcgcucucaagaacuuuuuggcacaucuacuuugaauaacaaacaucagcuauauauucaaacgaugauauaccauagucaaaauaaacuuacuauuuccaaacagcuggcacucaagaaaaacauacuuuuuaaaaaacuaacuuaaacaaaaacaaaaaacaacuugaagcugggcauggugacucacaccuauaaucccagugcuuugggaggccaaggcaggaccauugcuugagacccagaguuugacaccagccugggcaacauagcgagacccugucucuacaaaaaauuuaaaaacuagcuaggcaugguggcacacaccuguaguuccagcuacuugagagggcugaggaaaaaggauugcuugacccuaggaauucgagguuacacugaguuaugaucacaccacugcacuccagccugggugacagagagagacucugucucuaaauaaauaaucaaaaucuagcucuaauuagugaaaaacaaacaaguauuguauaucuccucagccauucauuuuuaucauuagguuguccuaguugagagacauuauuccuuuauuuauuaaacugagucuauaacuguauugauaauuauuaggcaugugucaauuuuuucuuuuuuuuuuucuuuuuuuuuuuuuuuugagaccgagucucgaucugacacccaggcuggagugcaguggcgcaaucuuggcucacugcaaccucugccuccuggguucaagcaauucuccuaccucagccucccgaguagcugggauuacaagcguccgccaccacgcccggcuaauuuuuguguuuuuaguagagacgggguuucaccauguuggccaggcugaucucgaacuccugaccucaggugauccgccugccucagccucccaaagugcugggauuauaggugugagccaccacgcccugccuuuuuccaguuuuuaagauuaguucuaaauuauuuacaggcugcgcauacaaugaaaagagauuuaauguuaucaaagugacacauacuaauacaaaaucuuuucauuuagaucauguaaauggagugaaaaagacauaggauauacgaaaaagagauccaacacaagagagagggaaagggaaucccuagaaugauaguaaaggaauauggcaacucuauacugggaaccgacagaagcaaguucagauugggauguaaaagacacuucagaaaauuaaacugaugaauaaacccuauacaucugaauauccugagaagagauuuauauaacuacugaagagaguuuggaggugaaugaaugguaauuauuuuagcacuaagcaaacaguuuauuaaugacuucuuggaaaacaaaguuacuuauaggaagggaaaagauuucaugguuaacuacauggcucagauaugaacaaaauuuguggucacaaaaacauaagcacugaauuucaaccuacuugaaauuauaauguaacaaaugagaugaaaagggaauagaaagguccugucugugaugacagaagaaggauaaaaaagacaaucuuccucuuccauaguuggaauucgacagacaacgccuaacacagggcugggcacaguggcucauuccuauaaucccagcgcuuugggagggcaagaugggugaauugcucgagcccaggaguucaagaccagccugggcaacauggcaaaacccuguuucuacgaaaaauacaaaaauuagcuggaagugguggcacauaccuguagucccagcuacuugggagucugaggugagaggaucaccugagccuggggagacugcagcgagccaugacucagccacugcacugggugacagagcaagacccuguuuccaaaagaaaacaagaaaagccuaacacugaaaaaaaauuugaaguugcaauauaaccaagcaauucauagcuaaggagguaaucagcaaaagaagcaacuaagaagaguuugaagugguuaccucuagaaauacaaaacaagagaaagaaacaugcagggcaccccuaguuuuuguuaggauacgcagaccaagacuuuuaaaccaugugcauauauauaacugauuuuuaaaaacagccuuuaaaaaaaagaaaacaaaacagguuuuuuaaaaagagaaacagguuucucauagaagaaauuacuuauaaggaacauaaagcuauagacaacagaaaauguuuuaaaguuaaaaaauaaagaaaaauugguguaugaaacaauaaagguuauucaaauuaauagaaaaaaugauauaugaaacauuagcagcaagacacauuuucauccagccaacuauaccuuuccuaagcaauaugaaacacauuuuauuuacauaucuaaagcuuuggguuauuuauuuaugagacagggucuugcucuguugcucacacuggaguacaauggugcaaugccagcucguugcagccuggaccuccugggcucaagcaauacucucaccucagccucccaaguagcuggaacuacaggcacacgccacaugccuggcuaauuuuuuguauuuuuuugguagagacgggcucuucccauguugcccaagcuggucuuaaacuccugggcuugagugauucgcccaccuuggcuucccaaagugcugggauuacaggugugagccaccacaaccagccuacuucaagguuuuuaagaaagccaaggcaucagcuaagcucauuugucaagcauauuccauucaaaugcucaucuccuauaucccaugcuauuauccaucguguggucaugauccuauucaugcaggacauuugcucaggaucuucugcaauuuucuaauuccuguccccaacuuggagcuuuaauauucuucucuaagauuucaauuucaaguuaauugaugugccuuaaaugaaaugaggucugacacacuucuauuaaucuacucacauauaaauggcccauacaaaaaucuguccuaacuuccagcuacaugugguuaucucucccgucucuugacucuccgcuaaaaugacagcaagagaauuaaaaggaaagguaaaugaccaaggaugaaucagggggcaaaaaaacaaugaauacaauauuucaauccuguuuggaaaagaaacuguuaaaauccucuauauagaaugagacccacccuccucgguucccuuccagaccguguauaacaagaaaguuaauucaaaccccaauaaauaaaugaaugaauaaaugacuguacaaacaaaaugaagcaaauuauaccauucuggacacggguaugggcaaagauuccaugaugaagauggcaaaagcaaaaaaugacaaaugggaucuaauuaaagagcuucugcacagcaaaagaaacuaucagcagaguaaacagacaaccuacagaaugggagaaaaucuuugcaaauuacacaucugacaaaggucuaauauccagcaucuauaaggaacuuaaauaaauauacaaggaaaaaacaacuccauuaaaaagugggcaaaggacaugaacaauuuucaaaagaagacauauauguggccaaaaaucuuaagaaaaaaagcucaacgucacugaucauuagagaaauguaaaucaaacccacaaugagauaccaucucauaccagucagaauggcuauuauuaaaaacucaaaaaauauucucacaccaucccuccuaaaaaaugaaggaaagagaaaauauuuuuaaaaaauaaauacaauuuaaaaagaaaaaaaaaggugcuggcaaagcuggaaagaaaaagaaacgcuuauacucucuugguguauauuagguguaaauuaguucaaccauuguggaaaacaguguggcaauuccucaagaaccuaaaacauaaauauucaacccagcaaucccacauacccaaaggaguauaaauuguucuaucauaaaggcacaugcauauguauguucacugcagcacuucacaaaaauaaagacauggaaucaaccuaaaugcccaucaaugguagacuggauaaagaaaaugugguacauauacaccauggaauacuaugcagcuauaaaaaagaaugaggucauguucuuugcaggaacaugcauggagcugggggccauuauccucagcaaaccagugcaagaacagaaaaccaauuacugcauguucucacuuuuaaguggaagcuaaaugauaaguaaacauguacauacggagggaaacaacagacacuggggccuaucggaggguggagagugggaagagggagaggaucaggaaacauagcuaacggauacuagacuuaauaauaccuggggacaaaacaaucuguacaaccuccaugacaaaaguuuaccuauauaaaaaccuguacauguaccccugaacuuaaaguuaaaaaaaaagaaaaugaagcaaaugaauaaacaaggugaaaguguaggaaaagcugaauuuuaagggaaaagaaucacauuacacuacuugccucaaaagugaacaacagucucagguauaauacuauaaauauuacaauacuauugauuuaccuaauaacaauaaccuaacauguuggcaggcuggaagaaaagagagucuagaaagaacuaaucugaaaggaggcuagcauuuaaaccacuaacagugacauaucaagaaacagcuccauccauguuccugcaauaccaucacaguauuuagaaaucuggggguuacuaccaagagcaauaacuaaaagcuaguggaugcucuauagaacacaauggcagcaggagggugaagagcugcuaauuuuaagucugucaguguuauuugaccuuuaaaauuguguguauacauccucuuaaucuuuauguuuugauaaagugcaaagaaaauguaccaccaaaaaccuucacacuccaguauacuagucugaccacaauuccuuauccuucucaugcucacuccucugcuaccaauucacaauuauuaugugucauuucaucaugaucuccaauaccuguacccucacuaucccuagguaauucagcuuucaggacuugcucucuccucuaugcuguaauacuuuaaucucugcuuuaucaaaaccuuuuccuccuuucccacaacugucugggggaggcgagaggacacuauugcacaacuaaaaguuuuggguaucuaaccugcuaccuugaguaaagaauggaugccccauacuauuaauauguacucacuagucacccucucaauuccccucaacaguaaauaugaaagucauuauucuucacaagcccucaauuuuuuuugaaaugaagucucgcucugucgcccaggcuggagugcaguggcgugaucucggcucacugcaagcuccaccuccuggguucacgccauucuccugccucagccucgcgaguagcugggacuacaggcgcccaccaccacgcccagcuaauuuuuuuuuuuuuuuuuuuuuuuuuuuuaguagagacgggguuucaccauauuagccaggauggucucgaucuccugaccucgugaucugcccgcuucggccucaauuuuaguccagucccuucucccaaaacauaagcuugauuccaccucauaaaaaaauuaaaacuaugaacuaugaugaugaacuucuucaacuaccuaccugugcuucugcccuuccuaguucauuuuccuguaccuauacuuaauuccuucccuccuguaacuggaguaagcccucuuaaaaauuuaaaacuaucuugagccuuauucuugcaacugaauucuuacucguccacugucuuuuucuuucauagccaucucucagaauguccagacugcugauuuccaaaccuucaccucucacugagauaaguaacaagcugcucuaacguaucacuccauugaaacgccuccccuaugaucaucaauaaccuagaugcugaaaaacuccaaguacuucuaagguuuccucuaauguuacuucacugcagcaacuggcacuauuuacccucccuucuugaaacauucacuucucucaauuuuaugaccauaauccuuuagcuuggcuucuaccucucugucaucuucaguauucuuugcaggcucuacuuacucagccuguccacgugucuguguucacgaaggcccuauucuucaccuuucuacuccacagccccuucucagccaaccucuuccuuugugccccacaaagggugaugacuuuacaacacccaaguguuuguuuuugaaccuuuuaaaagaugcauauaauaaacucaucuuugucuauuucaccuacuccuccccuucaguauuacaaauuucaguggauggcacacuggguugcccaaguuacaaaccugugaauuaucacagauuccucauauucuuacuccccucauaucuaagcaauuacugauuauguugauucuauuuuucucucaccuccuuccucauucucacugacccacaaauacuauucaucuuucaucuaaaauacuauaguaaaaucaccuauuuccaacacaauucacaccucuguuccaacccguccaaaccaaugcugcgagaguaaccuuucuaauaugguacacaauuaucuucuaugcuuaaaauuuuugcaugacuacagaaucuagcuaacucccuugcauaacauaucugcccuucaagacuggguccaugaauaccuaucuggaucccucuccuaccaaucuguccucuauacuuuucuuuccagcacucucaugucuaagaccucugccuagcuaaccuucugacaaaaauacauauacuccccuaccacacaugacugacaaacacccauucauccuuuaagucucaguucaaccauuaucuccccugagauguucucccaagcagacuuacaugcucuuuguuccugugcccucagcagauacauacacucauuaaagcaacuauaaccuuacguguuuaaauacucaucucuuuuauucuuugagcucaguaagagcaagauaaaauaauuuuucaucuuugaauacccagugcuuaagcugagaucaugaaaauucaaaccauuuaacauuugcugagugaauaaacaaaauuuuaaaaauaacuauucuuaacauuaaauaagcagaguaaguacguaauauuaguaauucuauuaauaaaguuacaauucugauacuaaguuaccagaagaauuuuccauuauuaaaaguauguauuucuuaauuuaauaaagccuuuauguugcuaaaacuucauagacagaagacuauuuugcuacuaguuauauauuuuaaugguuaauugaagguucuuuguauaauggucauuuuacacaaauagggagggggggagcuuucuagaaccuuucccaaaauauuuuauuucaauuacaaaacuuuaccugaguccaugauggagggaagaaaaaaaaaauuuaagggcucuccucuuuucaugacccccccauaagccacacauauuuuuuaaaaaguuuuuucuaaaucugcaaaaaauagcaacaauuuugcuuauuuuaacaaaagcaaauuuuuucuuuaaaaaguucauaaaauguuuuauaaacuuuucauaaaaacucaaacuuuuaguguacuaauaaaaguuucugagauuaauucucucugaauaucuauuaauucauauuugcugcugaauacuuuuaaacaauuccguuaaaaaaaauuaccucuggaugaaaaaagauuucaggucccaaaaaucucucauaaccaacaucgauagaaaacucuuucuuugagauagcauugauuccaguauacuguuuaauccauuuugacccaucuguaucauacuuguuaaauucuuuuacuaaaucugggcagacauaacuauagcgcuccugaaaaacaaagaaacaaaaguaacuuuuuuugcuuauuauaggaacaguaaagaagaauggcauguuuucaguaaacuauaauccaauaaaaaaaaaaaacucuucagaaaauaaaauuaggaaauuaagcuggaagaaaaauuuguuaggauauuaucauauguguaguacaaauaaacauacucaucuccuacacauauuuucugacuuuaaauauaaacaguauuugagagacuggagagcugacuucuacuauuucaauguuauuuccugaaaauguucacuaaugucauucaacauuuucugucucaguaauaaugaaucuugugcuguagguaaggagaauaaauaaaauacagaacugaagaauaaguaauaauugugauaaccacacaaauuaauauagauccuuaauaucuaucugaaacaaaacugauuacggucugaguaaauaaaagagcaaagaaaaaaggcuaaaaauauaaauuacucuauuuuguugcauauuugguuauaugaccuaaguaaaaguuuucaucaaaaacacugaaaaauauauuauagauuauaacaucauauuuguaauuuauaaacucccaacugccaaccaauauuuguuuuauuuuuuuaaaaaaacuuccuuuuccaguauuuuuacacaucacaggcaccauccaagauagaugcaaauauuaccaguaauaaucaaaauacacaaagagaaaaaauacuggaauccgaagacauuugauuacacuauuugaggucuucuccaaaccuuggaagugagaaugacaaagaaaugauauuccuuuaaagacauucagaaugaccaucaaucuucucuggaauagauuuaaaucucugguguuuucucguuuugcuuuaauuucacagauuucccaaagauguugaaucaguaguauucacauuaacuuuuuauauauuuaauucuuaugccaccaacuugggguaacuuuugguagucauuuacuaauuuacuaccuaggaaguaguugauaaauuuucauucuuaagcucugacgagcaaggaaaaucccauaaacaagcaaagaggcccaggcauggugacucacauccagcacuuugagauuccgaagcaggaggauugcuuaaggccaggaguucaagaccagccugggcaacauagcaagaccuccaucucuacaaaaacuuagccagacauggugauaugcaucugcaguccuagcuacucaggaggcugacgcgggaggaucacgugagcccaggaguuugaggcugcagugagccacgagugugccacugcgcuccagcuuggguagcagaacaagaucccaucucuacaaaaaaaaaaaaaaaucaauaaaaauaagaaauuaaaaauuuuaaaaauuuacagguaauuaaaaaaaaaaaaaccauggaaacagagacaaguaaguuacuuuugccauggcaguucugcuuuucaaaacacgugaaacccacugaaauuuuuugguuauguggcaaauaauaaguuugaaagacgaugcuaaaguauuuugauaguuugcaugaagcacugauauaauacuuacauggcagaaaaaaauuaauaaaauacuuuagauagccuucauguuuuucuucuaugugcccuaucacuugagccaagcacugcuucuauacuauagcacaaugaaucaauuguaucaaaauaauuuuuaugacaaaagcuuuuagaauuaaaauaaagaauucagugaagaaacugagaugcaaggacuuuauagugaaauaauuauuuauuuuuaauaaagagaauaaucacaaaaauuuauguuaaugucauuugguaaaauguucuuauauuacuccucucaaauauaaaauaugaagaaaacagaagacaaacugcuguaauaauuuucuuuuaagaaacacaaagaaaauguaaauauauuuaaggguaauaauuuauaacugguuaacaagauuauuucaaguacucuucuucuauuaaaaauuucucacguuaauguuauaaaugugauuuuaauuuuuaacuaaauuacacuccuaucacacuuuuuaccuuuacugccuuagcaguuuccaaggauuguucuggagggauuccuacuucucggucucucagcaguugcugaauaaaauauguuauaucucguccugcgauuggaauguguuuaauacagcugccaaucacauacccuucagccuagagaggggaaaaaagauaccaaauuuacuuucaauguuuugaaaauuaauauaacccaaaaauaugaaccaauaaagaccaauuuauuaaguuaguguauuuauagucucaaguacugcuuuaucucagaacuuaccuuuauuccucagaaacuauaacuaagaauggccagcaacuuagauuuauuuucccacugacaguuuauaacuaugacuaaaauaacucaacaauauagaaauaauaaauuucaaaauauaaauaucaaaugguuuagauagcagacuuuauaucagaugguacuauuuuuaaaucauuuauaauuucaguaaaaaauuuagauugcuucauaagaaaugugacaaagugcuuaucauuuuccuaaucaaguauguauccauuucacaaaccugaagcuuuccacacaccaucauaaugccaaauaacuaaauucuguagaacugauucacaaauuuacugaugugucagaaguauaacaaauaguguggcaaaauuaaauuucauuaggaaagaauauuaaggaugccuucaucuggcaugacagaauauuagggauugaacuuacccucucaauuuaaagagaaaacaggacaauuuauaagaaauaaagguuuucggccgggcgcgguggcucacgccuguaaucccagcacuuugggaggccgagacgggcggaucacgaggucaggagaucgagaccauccuggcuaacacggugaaaccccgucucuacuaaaaauacaaaaauuagccgggcaugguggcgcgcgccuguagucccagcuacacgggaggcugaggcaggagaauggcgugaacccgggaggcggagcuugcagugagucgagaucgcaccacugcacuccagccugggcgacagagcgaaacuccgucucaaaaaaaaaaaagaaagaaagaaagguuuucagacauuugacaaucggcagaguagggcagagauacuuucuaagaaaagggaaacaaauaacgugaauguuacacucuauccuacugccuagggagaguuacuaggccacaacaauaggaaagagaacucaaacuggucucauuaaguuagggauauagaauuuaaaggucagaaaggccaaaguggcugaaguuuguaggccaaauuauuggagggggaggaguugaaccaacagggagcugggaagaugugaagagaguaccuccuuaacugaauacugaucagcacacuccugugaggaaaccaucaaggugagagaaaggaccucuagaaaaaaguagacagaaccaccaccagagcucacacauagccagaaauaguuccugaucccacuagccaaaguugaaagauguuuucaaacacaagacaugaaguagaguccucagaagaauauugccucaagaauggggacaaaccagcccuggacaaaaaccuguuacggaccugcuuaauaacauuuaaaaggagccccugagaggaucaaacuaguuccugguaucuuaacuaugucccaggaaaaaauccuaaauacuuauaaagaacuccaaaaauacaauacacaacaauguauagagugccaaaucaaaaauuauaagcaugcaaggaagcggaaaaacacaacacuuaacgaggagaaaaaccaaacaauacagaggaaugacaaggacaauaaaacagcaacuauauacuccauauaaugaagaaggucaacaaugaggaugaggaagagagaaauggaagauauaaaaagacccaaauggaacuucugaagaaaaaaauacaguaucuaaaauuuaaaaaucuaccagaugaaaagaaaaacacuagaugagauuacaguggacuacacagugaagaaaaaauagugaauuugaagacagagcaauaaaaacuauccaaaaaaaagaaaaagauuauaaaaaaauaaauguacagagcaucaugaucuuugagacacugugaagcagccuaauauacaugugauuagaguaccuaaaggagagaaaagaggaagagaaaaaauauguaaucaguaacagacaaaaacuuuccaaauaugaugaaaauuacaaacuauauauacaagaagcucaaugaaccccaaggagaagagacauaaagaaaacuuuacuuagguacaucacaaucaaauugcuaaaaaccaaugaaucaggaauaaaaagaaaaucuugaagacagccacccaaauaaacauuacauucaaagaaacacacacaagaauaacagcugacuuauuuucagaaacaagguaagccagaagacaguggagugacaucuacaggggaaaacugucaaccuucuauaccaagcaaaaaucaucuuucaaaacuaaaggagaauaaagacuuuuucaaaggauguacaaaaguugaaagaauucaaagccagcagaucagcacuauaagaaauguugaaggaugucauuuugacagaaggaaaaugauacuagguggaaaucuggaccuucacaaaggaauagagagcacuagauaugguacgugaauaaaagaacucaauuucaaggcugggcacaguggcucaugccuguaaucccaggacuuugggaggccaaggcagguggaucacuugagggcaggaguucaagaccagccugagcaacauggugaaaccccgucucuacuaaaaauacaaaaaaauuagcugggugugguggugcacaucuguaaucccagcuacucgggaggcugagacacaagaaucgcuuaaacccaggaggcagagguugaagcgagcugagaucgcaccacugcacuccagccucggcgacagagcaagacucugucuccaaaaaaguuaucuuuuaaagauaacuuuuugcuacuggguaaauuguguuuuuccuccccaccaaauucccaugcugaaguccuaagcucuaucucagaacgugacuguuuuuuggagauaggguauucaaagugguaucuaguuaaaaugaauucauuaggguugcuuucucuaauccaauauaagugguguccuuaagaagaggagauuaagacacagacauguauggggaggacuaugugaagacauauaaagaagauggacaucuagaagccaagaagaaagucuucagaagaaaccaacccugccaaaauccugauaccuauccuuucccacuccucacauuguaguuauaucacaauuuuugguucuaaccuccagaccugugaggaaauacauuauucuuuagguacccagucuguaguacuuuauuacgguaguucuagcaaacuaauacaccacucaaaaugaaacaaguuaacaauguauuauugaguucacaacauauaaaaguaaaaugaaugacaauauaagaacaaagacuagaaggucaaagcuguuguauaauuauuauuuaugaaguaguagaauguuauuuguaauuagacagugguaaguuaaagauguuuacuacaacccauacaacaaccaccaccaaaaacaaacaaaugacaacagauauagcauagcuaauaagucaauaaagagaaaacagaauaauaaaaaauacucuacuaauucuaaagaaggcgggaaaaguaaacaauaaaaaggaauagcacccccccaccaaccuuuuuuuuuuuuuuuuuuuuuuggagacagggucucacucuguugcucaagcuagagaagcuagagugcaguggugagaucauggcucacugcagccucaaccucuccagggucagguuaucuucccuccucagccucuggaguagcugggacuacagucaugaaccaccacguucaauuaauuuuugcauuuuuuguagagacaggguuucagcauguugcccuguuggucuugaacuccuaggcucaagcagucugcccaccuuggccucccaaagugcugggauuacaggcaugagccaccauaccagccagaauacccacucuuaauguccuuacuaaaacucauucuuuuacauauugauaacuucuauucugcaaauuaccuauucuaauuaucaacaugcugauaguacugcucagaugugcagcuguuaagaaaagacugaagaaaggcagaaccaggucaaauccuagccucacuaccuauuauuuggugaccuuaggcaagucaauuauuugcauuuuauuaaugaguaaacugagguacucaaagaaaaauauaauauuuaucacagacugauuuucagauuuaaacaauaauuuuaagaugaaaaauuauuuuauguaccacuaagaaagaaaaauaaacugccaaguaaacuaaaaaaagcuaucaaaugcuggacacguccuaauuuccaagcuuacuaaaauccucccaaaggcuacauaaaaucucauauauccacauaaugaaauauuauuuggcaauaaaaagaaaugaaauacuauacgugcuaaaacauggaugaaucuugaaaauguucggcuaagugaaagcacccaguuacaaaagaccacaguguuuaacuccauuuacauaaaauggccaggacaggcaaaucuaacacagacaaaaaguagauucgugguugccaggggcugaaggaaucaaggggaaauggguggugacuguuaauaguuacaggguuccuuuguagggugaugaaaauguucuaaaauuguggggacggauggacuuugugaauauacuaaaaaucaaugaacuguacacucuaaagaagugaauuguaugguauaugaauuuuaucuuaagcuaucguuaaacaauggcaguuauuacuaaaaccauuaugacauaucaugagggugaaagugguggaggaccaggagucuaauccaaagguagucacccugaggauguaaucuuuaacagacauugccugaugcauuaaacacuggagugagaauaaaaaaaaaaaaaaguucaaaauaauguaaauccuuaagugauauucauuauaauauaaaaauuacuuuaaaagauaaaccuuucucuauauacccauuuaauaauaaacaguaugaauucuaguagucauuuugaauucauuaggcauaauuuuuuuaaaacuugauguaucauuaagaacugaagcacaacggccuuggaagaaaaauguuauuucugacaaucuaauuugaugcauuuuucuuaauaugcuuuauuaaguacaaaccauaaagcaucuacuaaaguucagguacuuaaaacuaacuguuauacaguuacccuguacaccagucugaaaucuguuaauuaugaauaaaagaggucaucaaauggcuaacacacauccaacuggaaaacagaaugaaagccauuaauauacuuccauuccagauauugcaauuuguaauuuucuuaauugcaguacaaaccuacaguaaaagaaacauuuugaauuguuuauaaaaguuuuaaacggugagcaaaacauagcuauaacuggacaaauggccaaauuauagugcagcauuuaaaguuuuuuaaaaguaacauuaauucguauaauuuaacuuugccagauguguuauuucauguucuguucaguaacuguaaaauagccuuaccacaggaaugacaugagugacaccaucuccacugucuauuaccguaccggucaacguccguucuccuacuugucuugagguccaagaugcagcuaaggcaagaacagccuugagcacaaagaaagaagaaaggcaaaaaaacaaaaaaaaaaaacaaaaaaacaaagaguuaaucgaaaaaaaaaaaacuaguucccuggaguacuuuauucaauuuuaaauguaguaucuguggaaagaaaauacauaaaauuaauuuuguauuaugcaauaaaauagcucacucccuacauuuuauuaagacaaacuuagagguuuacauuugcuuuuaggagcaugauuuguaagauuuacauauuuuauaaaggcuauuucuguccuaaagcuaaaaauguggaagauugcauuaaacaguacagaacuaacugucuguaaucccagcacuuugggaggccgaggcgggcagaucacgaggucaggagaucgagaccuuccuggcuaacacggggaaaccccgucucuacuaaaaaauacaaaaacuuagccaggugcgguggcgggcgccuguagucccagcuacucaggaggcugaggcaggagaauggcgugaacccgggaggcggagcuugcaaugagccgagaucaugccacuguacuccagacugagcgacagagcaagacuccaucucaaaaaaaaaaaaaaaaaaaauuguauagaacuaacuugccagaacuuaaacuauguccacgugggcuggccuguuacaaacugcaauguaaggcagaaaguacacaaccacccuaccuccaguuauucaauacauauauggcuauaaacaacuauuacuaaaagauuaccuucuuuuucuuuuuuucuuugagacagaguuucuuucugucacccaggcuggaaugcaguggcacgaucucggcucaccgcaaucuccgccucuuggguucaagcaauucucugccucagccuccggaguagcugggauuacaggugcccaccaccacacccggcuaauuuuuguauuuucaguagagacgggguuucaccaucucagccaggcugaucuugaacuccugaccuugugauucaccugccucagccugccaaagugcugggauuauaggcaugagccacugugccaggccuaccuucaaauuuuuuuaagguaacauguguuuaggacuauaugacauacagaaaacgccaucgcacaccuccaaauacuacuaugauuuaauuauggagcaacguugauaaaauuuuucuaugaaaaaccuugguacagacaauacaacacaauucuuuuuuaagugugagaauuaagaaauuaacauaguucauuuuuuaaaaaacuaaauuucuuacaauccaagccucaaacaaaguauaugacuaguaauuaaaaacaacuaaacuuauacuggacuuauuuuaccuaccuggacuguaauagcuaaaagggaccuagaaagcuaucuaggucacccuccuaucugaacacaagaucauauuaacacaaucaccacauaaucacuauaggcuaacagaacuauacauuauuuuuugacaaucuuaaaaugaaaaauuccauccuaauacuaguuauauauauauauacuguuuagacuucauuaugagauauccuuccucuauaaguaaguucaaaacuaucaucuacaaccaagaauuaucucugaucacuuuuacaagucuuuuguaaacaguuacggucccaaacuagaauagauauguaucagcacaucauguuacagaaauguuauugacuacugaacaucaacaaaacagaacagagauuaaauaaugaaauuaagagcacucagaggccacuaaggaaaucacugaaaaaccaaauuacgacuccagaggaaugaaacaaagcucaugaugccaguguuuuaaaguaagcuuuaccugacaauaugguuaaacauaaguuuauuauauuuaacauaggaugagaagcaaaaacucccaagugaaagaugaauuuucccaacuccucauuuuauucauauucuaagaacuaaaaaagggccucccacucaagacugaauucuucuauaaaguucaugacagguuuaagugacuccuuaaauauuuuuagcagcagagaauuuaaaaggcaguucauuaaauuuauggauugcauuaaacauuaaaaaguucuuugcuauccaaguuaaaauauucauccauaauuaucacuuauugauucuguguaccguggaguuacaaaaaccagugugaucccaagaaagagcaaagucagacagaccucagcugccugguaucacagcuaaccauuuaauuaugaauaaagugccuuccagcuuuaguuuucuuccuccacaaaaaacagaaacaaaaauaucuacauuuaauagaaauaaugaauuaauacacauauaaagcauuuguguuaugucagggauuaccucugcuacaagggaaaaaaaaaaaaaaugaggucagcucugauccugaggggugggagagaagcuguuccauacagauaaacguacaaauuaagagaagugaaauauuagggugucaaauauaccuaaagauaagucaaucaaaaaagacuacaauaaaggacaaaaagauuuauaaggauaaaugauaaaggauuauuuacaaggauaaauauauauacaauguucuugucacagagaaagcauuccauaaauauuaguuccuucauuucuguccuaugaaagcccuugaaauacccaaacaccacuaacuuacuuuuuuaacacuucucuuuuccugacuaaauaucuccacuucccauaauauuacuucuaaauuaacaauucaggagagaaguauaacaugcuuugacauuauguuuaaaccuuugcagaaaaaaaaaaaaaguacguauuuuaggcagcaaauuaaacuagguuaaaauguaagaaucaaacuuagaaaguaugaacuugcuuaccugcacagcaauguacaagccuggaacauugaaggacucaaacauuauuucagcaguauauucccuguuuucuggaguauucaauggagguucagucuauugaaauaaauaacauuuuaaauagauaauaucagauuauuuugauaacuuucuugacaauuuuuaaaugagaaguaauuuauuucaaacauuuuauuuaaaaugcauuaaauuuacaaguagaaagacagacacagagaucaaaggaaaacuauagagaauucaaacauccauacauauaugaaaacaguaugguaauucacauuuuaaaaaaaaaauacccugaaugccuauaucauaccacuuauacagauuaaacauuaaaaagaaaugaagcagggagagagaggguuggagguagggaaaaggugguccagucaaaucauccuuuaaauaugguaaugacaaaccuccagaaaaaacaucaaugguauuugccagugggagagcccucaucuaaguaaugcuuuuagaugaauguccccgaaguauauaggauuacaguaaacaagccgagauucuacagaucuaaugguacagcuuucugaaaaauguuauauuaauuuaccuguuaagagcauagaaucaagauguuugcagagcacucuucuguuuaugugacuguauacaucacuuagaaaccucacagguuaagucugggacagaacacacucuaaagaggcaaggaaggacucagagaucuggcagucuuggacuucauauuucaccuaugccucaugaucacuuaaacuguuucaauuuuuaaagauuaacacuggguaagaccucugauucuugugagucugacuggcaaucuaauagguaucucaaauacuuaaauguaaaagaaaaauuuuuaaauuuaaaaaagacacagaauucucuuuuugaccuuaagguaggaauaacuccuuaaauuucugaaguacaaaucacaaagggaaaaagugauaaaacuugaauccauuaaaaauuaaauauuuuuaaaauuauuauuucaaaagaaauauaaagcaaaacaacuaaguauacuguuaccuuacauaaaaccuuuauaagcuaaacucccugugguguuuaaacuucuuuagaagaguucuggagcuauguuuaaaagucuggagauaauuuacugaugaauacauacaaaauuaaguaaacuaaaaaccaaggcagugaaauuauaaacuccaagaaaaaaaaucuacauaaaagauaaucagaggaccccacaaaggaaaauauacaaauagcuaauaauaacaaucguacaugaaagacugcucaacauaauuaucagaaaaugaaaauuaaaauuaaaagcaaaugaaaaaucguacacacccaccagaacggcuaaaauuuuaaagacugacaagcuagcagcgcaguggcucacaucuauaaucccagcacuuugggaggccgaggugggcagauuacuugagacuagaaguucaagaccagccuggccaacauggcaaaauccugucucuacuaaaauuacaaaaguuagccaggugugguggugcaugccuguaaucccagcuacucaggaggcugaggcacaagaaucccuuaaaccugggaggcggggagguuucagugagccaagaucacaccacugcacuccagccugggugacagagcaagacugucucaaaaaaaaaguauaaaagauugauaagccaaaucuugaauagagcaagcagauuacuaaugcaucacuggggggugugcaaaaagguucaccaucuugggaaaaguucccaugaguuucccuaaaaaaccaaucagguaccuacccuaugacgcugcaauuccauacuuacguauuuagacaagagaaaugaaaacauauguccacaaaaagucuuguagaagaagguucacaauggucaaauuauuuuauuauaaccaaaaacuagaacuaagccaggcaugguggcagcacuuugagaggccauggcgggaggaucacuuggagcccaggaguucaagaccagccugggugacaaagugagacuccaucucuaaaccagaacacauuacccaggugugguggcccgggccuguguguccuagcuacucaggaaucugagcugggagaacuguuugagcugggaggucaacacugcaaugagccaugauugauccacugcauuccagccugagcaacagagcaaaacccugucuuaaaaaaacaaaaacaaaaacaaaaaaaaaacaaaaauagcccagguauucaucaacaggaaaauggauaaagugaggcaaauuuauacaauggaauacuacccagcaacaaaaagcaacaaaucaccaguauaugcaacauaauucaaucuccagauuaugcuaaguaaaaguguuucaccaaaaugcacauauugcaugauuccauuauuugacacucaaacaugggcaaagcuaaucucagaugaaaaagaaacagugguugucacuagggcacgggggcagagauuaauuacaaaagggcaugagaaaacuuuccacgcugauaguaauuucucuauaucuugguaagaguuuagguuacacagauguauguaacugacaaagauuggacaaaucacaucaugcauccugcaggucaaauacagcccaccaccuguuuugguaaaaaaaaaaaauuuauuggaacacagacauaccuaugaauuuaaguauugucuauggcugcuaacaugcuacaacagcacagcugaguagcugugacagggaccauuguauaaaaaguucucauuaaguuuccucagggacuauaaccccugcaaagccaaaaauauuugcuaucugcucccuuagaaaguuugccaaacccuggucaaaauccacugaauggugcagaccggugauuuuaugauauguaaauuuuauaugaaaagaauaaccauacacaaaugauagcucuaguugaugaaauacgugcuaaaguauuuaggggucaaaugacucccauuugcaacucacuuugaagugauuuaaaaacuaaaaugaagugaaagauggauagacgucaugaagcaauuauagccaaauguuaagguuaaucaucgaaucuagauuguggguguaugaguguccauaguaugguucuuucaacuuuauaguccaucacaaucaccgaaagacacagaauauugauuuaaccaaaaauugugauguaacuacaaugcgaggagugggaaaggauagguauuuuguguugagggagagaaaagguaaaaagggaaauucucauuuuuccuauuaggaaguugguaaauaauguauaauauucuuaaagacagaagaaauaaaaaaaaaauguuaaauaaaagaaacauguuaaaagauuacuagcagggcaaacuuuguuaaaauugaaaauguuugccuccggggaauaugaaccaaagguugggagagguaagaaaggaaaguguuauuuuguuguuuuaaaucuuauaaagucauuugauuuuuuaaguuaugaacaugcacugcuuuaauaaaaagauguuuaauaaaaaguuagauuauauuguauuuuuguuaugaagaaauaccaaugauauaauaaucagacuauuguuuuuuaagcaaaaaagugccacagguuuccaacauuuuucugaacauuacuuacuguuucuaucauaaagauuagacauuaacuaccaaaagcacuucuuaaguguuuaacauguggugcuuugacauacuacuauucuccuguagccauaacuagauggucuuaaagaugauacagcuuuauuacaaagucauuuagacauaugacaauuuaauaaccaaaguauaccaaagaaguaugaugaaaauguucucauuaaguguauucaaaaauuuccucagugaaauuauaacuuguaacuuaccaaaagaaaauaauggucuucagguucugcccuuaaauauuuaaagaucacuugcuccauaaaccuuuccauuaagucccaaucuucaacuauaccauggcggauuggccacuauuaaaacaaaaagggaaauacaaauuaaaucuuauuaauauaaaaaacaaauaaaaauacaaaaaaggaaauaucagaucauuaguggauauuagaugaggauauauucauaggugugauacuauagaacauccuuaaaagauguguacuuaaggauuuaaagauaaauuaguucaauaacgcauugucagauggaugguucaauaaaaacaaagugaauaugucaaaauguuaaaaacuguuaaaucuacauggaagaccauuguacuagucuuucuagauuuuaaaaguuuuguaauaaaaggauaaguuagccuacaaaaauuaagccuaaaaaacuauacuuuaucacaauuuccuuaauuuuuaaugcauuaggccauuaacaaguauuuguuguaugccgaauauaaaaagugcaccuguaaguacauaccuagaauaauuguaagaaucaagcacauaaaauguuauaagaaaaguuuuauaaauguuuaagagucaugcuuccaaaacugugugcuaagauaccuacuaugauuuggaugugguguguucccaccaaaacucauguuaaaauuuaauucccaguguuauaguaucgagaggugguagggccuuuaagaggucaucaggucauuagaggaauuaaugcaguucucagcaggacugaguuaauucuccagaggguugaaggcaggcuguuacaaagugaaguugucccuuguauuuugucccuuuccucuuccauuccccaacauguuaugaagcagcaugagguccuuaccagagguugaucagauguggccaacucaucuuggacuuccucaccuccagaaccacaagccaaaauaaaccucuuuucuuuauaaauuacucagucucaaguauucauuauagcaacagaaaaugaacugagacagcaccccaguguacuaccauaaauucacaagggcgccgcaaaguuauuuuaaauuuuccagggaaauauaguguuacucaacaucaguuggacacugcgugaucuacaagucacaguaauucaguuucaacaauaaaucaaacuauuauauauuccuuucaaugacauuauuucuuacagaaguugguuugucagcaguugcuggcauaaaaaccaaguuaucacauaaaauaacaucgauauaaaacaagaaaucaggguggcaaugucccaucugauuccagguuugagaagcugagcgaugccuaagcauccuaacagaaaugugauuacucagcagugaaauaacguuuccaauuuaagugucuuauuuuuuucaaguggcuacuaaguugccuggaccuagguauuuaauaaacagaacuaucagacauuucuuucgaucuagguggcacagugaaaaacguuacugagacccuaacggcacugagaaaguuugugaaccucugcaacagaauauaauuccaugaacauaauacacauucaauaccuaaaguuaaacaaauuaaugaacaaagaaauaaauaccuugcaguaucaaucccuaacaucuacuucuuacucuaguuuccacacuacuuuuuaaggcauuauacuuauaaaaggacuucuacuccccaguuugcuuuaaggaaggaaaaaauugcaguuuacuuuaucauucaauuuuuaacauuauuagaaguuuacaaauucaaauguuuuaaguauuauuuauucaucaauuauuacuguguaccuacuguaagccacuggcacaaaugcuaaggacacagacauccagcauacaaaaaacucagucuagcaaaagaaauauauacgaacaaauauuacacuacagguuuuuaaaaaaaauaaaguuccgacugggcgugguggcucaugccuguaaucccagcacuuugggaggccaaggcaggcagaucaccugaggucaggaguuugagaccagccuggccaacauggugaaaccccgucuccacuaaaaauacaaaaauuagccaggcgugguggugcaugccuauaaucccagcuacucgggaggcugagacaagagaaucacuugaacccaggaggcggagguugcagugagccaagaucacuccauugcacuccagccugggcgauagaguaagacucugucuccaaaaaaaaaaaaaaaaaagguggcacgauggcucacgccuguaaucccagcacuuugggagguugagguggguggaucauuugaggucaggaguucaagaccagccuggccaauauggugaagccccaucuccacugaaaauacaaaaaucagucaggcaugguggcaggcaccuauaaucccagcuacuggggaggcugaggcaggagaaucucuugaacccaggagucagagguugcaguaggccaagaucacaucacuccacuccagccugggcaacagaguaacacucugucaaauaaauaaauaaauaaauaaauaaauaguuccuugaauaagaugaccaccuuguuuugugagagaaaagguuucgcugaggaggucauaucuaagccgggucuuaacucaguucugcuuucuggcuuuuuuuuuggcaggggaaugagagguauggaggaacuuguggagaacagaaaaagauguauagaaagacaaacacugcaugguauacaaaaacaaaacugaaguuaucaaugagaaauuuaugugccaaaagauuugaaggugcguagagagauauaccaguucuagaucaaagggacuagauucucaaaaauuuuccuuuuauuuagguuuuauucuauaagaaauaaaacagcagagaaauuuuuaagcaggggaauaagaacagcuuuaauuuuuaggaagacuauuauagcagcauugggaaagcucaaaugaagcuuaacagaaccaagugagaacaagaguaccaauagugguauggacgacaaggggccacauugaagauuucucagucaauaagaauaagaaagggcugggcaugguggcucauaccuauaaucccagcacuuugggaggccaaggugagaggauggcuugagcccaggaguuugagaccagccuaggcaacguagugagacccugucucuacaaaaaaaaaaaaaauuuuuaauuagccaggugugguggcacacaccuguaguccccgcuacucaggaggcugagguggaagaaucacuugagcccagagggucaaagugauuguggagggucuugcagugagccaagaucucaccacugcauuccaacaugggcaacagggcaagacaccugucucaaaaaaaaaaaaaaaaagagaaaaaagucagaagaugccaacagguuuccagcuuugaaguuaggauggaccagauccauuaaucaaaacauaaaaauuguguuuugucugaucuuggaauaaacaagaguggaguauauauaauacguuuuguuuuagauauacuaaaacucaagagccaggaaauagguaggugaagauguagucaaggaacugaaaguagagaucuggucugugguugcagacaaaggaauggaggagaucaccuagagaaagucuuuaaugaaagaauaaaacauugagucaccccauuuuaugagaagagaaaaaaaaaaaaaaggagaacugaaagcagugccuagagaaaccaacguuugaguaguggguaaaggagaaaucagugacaauagaaacaacaaauaaaaacaaacaaaacaggccgggcacaguggcucaugccuguaaucccagcacuuugggaggccgaggcaggcagaucacgaggucaggagauugagaccauccuggcuaacacggugaaaccccaucucuacuaaaaauauaaaaaauuagccgggcacgguggugggcgccuguagucccaacuacuugggaggcugaggcaggagaauggcaugaacccgaagucgaggcugcagugagcugagaucgcgccacugcacucuagccugggcgacagagccaggcuccgucucaaaaacaaacaaacaaacaaacaaacaaacaaacaaauauuccauguuaggaagauaaccauuagaguaauccugcaaaagaaagacaaaucaagaaggaugaaaacuguuacauauaauuggauuuaacaaagagcauaucaaauaucuugagacucacuaagaagugucguuuuaaaaggaaagagaaaaauagcuaaauugcugaggacagaagguaggaauaaagauugagagaaguuuuguucugguuuguuaguagcacuuagaagacuuaaaaaugcguuuaaaaugaguggacagaaucaguggaaaggaacucuggccucucgacugacugacuucaucacuuucagugguaucucuuuuccauuuuggccacaguauagaucuuauaucaucaucacuaucaccucucaaucgcugaaaugcagguauacccuucucugaucacaaccucuuauuauucuagcauacucaaccaccucaagagaucucuucugaacaccaauuaagacuuuugguccacugguugcuuuaauuauucccuagccaucaauauacacagucuagauuuugacccaucaccuuuauuucacauguucuuuuuucauccugucuaccaaaauccaacccagcauauaucccuaacauaaacuugccuauauccagaaugcugauuauaccgcagaagcauuugcacuagggugcuaaagacuaagaauucauagucauuauucucaaauggaccuaaccuugccuggcaagccuuuacucuucuacucuguuccucuuuacucuucacaaugacgagugucaaugccgccccuaccgcuaagauuucaccuucuccccacauccaugaccagcagaugaugccaccacauauuucgcagaagcagcagaagccaacagucaggaauucaaaucuguaaaauggauuccauacuuagccuuuuuucucauuuacuuccauuauaauguaagauauuccgcaugucaauucagucaucuguguucuggaucucaucccuccagcuuuuucagagaccuugauuauaccuuaucuuuccuguuacuuuaaucucuaauaguucuuucauauuagcauucagacaugucuuccaucuuaacguugaaaugugucucuucaucucucucucccucccaaucacaauugaaacucaaugaacaguacucuuacuguuacuuuuuuccuggccuaucacucaaaagccuacuuucaucuagcccaacuacucuucuaaaacuauucucauucagguuacaaaucaccaccuuguagcgaaagacagcaaauuaucuaugggcucuagcucaucucagcaccauucuacaguguuuaccucuacauaucuacccaugcauucucagucucuuucgcagacuuuuccuccucuacucaaaccuaacuggcacacugcucugucuuaguucucuuccccugugauauguuccccuagguaaugucaacccgucuaagguaacugacacuuucugaaucucugucuccagcucugccuuguuucuuaccuccaaaauccacauauuugacucuaacaaaaucucagacgucucacaaguaccucaaacacaauguguucaaaauuaaacuuauuuucuccucucuacacuacccagucaaaaguguuucuccuuaugaaacaagaccucuagcucucaccuuauacaaaaaucaacucaaaaugaauuaaagauuuaaaucuaagacccaaaacuauaaaaguacuagaagaaaacuuaggggaaaccucucacaacauugguacgggaaaagauuuuacaaauaagaccucagaagcacaggcaacaaaagcaaaaauagacaaaugggauuauauuaaauuaaaaugcuucugugaggaaaaccaucaacagagggaaaauacaaguuauggaaugggucaaaaugcccgcaaacuguacaucugacagaggauuaacauccagaauauauaaggaauucaauucaacagcaagaaaaaaaaaaaaaaacacugauuuuuuuaaaagggcaaauaaucuaaauagacauuucucaaaagaagucacaucaacggccaacaaauacaugaaaaaaacguccaacaugacuaaucaucaggaaaaugcaaaucaaaaccagaaagaaauaccgucucaccauaguuagaauggcuauuacccaaaagacaaaaaaaaucacaaaugcuggcaaggaugugcagaaaagggaacucauauauacuguggagggaauguuaauagguaaagccacuauaaagcauaguacagaggcuccucaaaaaaccacaaauagaacuaccauaugauccagccauccuacuauuggguauauacccaaaggaaaauaaauuacuauaucaaagauaccugcacccucauguuuauugcaguacucuucacaauagccaaaauaugaaauuaaccuaaguguccauacggauauguguaguauauaugcacaauacuauucaaccauaaaaaaagagugaaauccugucauuccuggcaacacagaugagcccaaaggacauuaagugaaauaagccagggacuaaaagauaaaaaauugcauguucucauucaugugcaaaagcuaaaaaaauugacuucauguaaguagagaguagaaaagugguuacuagaggcuggaaaggguaggggaaagaagggaauagggagagcuugaauaaaggauacaaaauuacagcuggauagcaagaauaaguucuaguguucuauagcacuauaugaugacuacaguuaauuuauuauauauuuucagauaguuagaacagagaauucugaauauucucaacacaaaaaaauaaguguuugaggugaauaugcuacuuacauugacuugaucaccacacacuguacauaucaaaauaucacuacauacuccauaaauauguacaauuauuauaugucaaguaaaauuuuuuuaaaagccuggcacaguggcucaugccuguaaucccacacuuugagagaggccaacaugggagggucacuugagcccaggaguuugagacgagcaugggcaacagaaggagacccugucucuauaaaaaauaaaauaaaaggccggacgcaguggcucacaccuguaaucccagcacuuugggaggccaaggugggcagaucaccugaagucaggaguucaaggccaggcuggccaaauggugaaaccccaucucuacuaaaaacacaaaaauuaguccggcgugguggcacaugccuguaaucccagcuacucaggaggcugaagcaggagaaucgccugaacccaggagguggaggaugcagugaggugagaucacgccacugcacuccagccugggagacagagcaagauuccaucucaaaaauaaaaauaaaaauaaaauaaauuagcgaagcaugguggcacacgccugugguuccagcuacucaggagacugaagugugaaaaucucuugaguccagaaguuugaggcugcagugagugagcugugauugugccacugcacugcaaccuaggugacaaaguugagaccuugucuuaaaaauaaaauaaaauaauuuuuagauguuuuuccuuuaacauucucaauuucagcagauaagggauaaauaagacuaucucggagcugggaauuacccucaauugauacaucuagcuuaucaccaauaucccauucaucacgcccuguuacucuuuaauuauccacuuuuuccuugucaaaacaaacaaacaaaaaccucccauaaaucuaaucagacuuacauuuaacuaccauuuacaacaaaaaaaaguaaauauaggaaguaggguaccauguuaaaugacccaaugaguauguaauaaucagaaucccuagaauauaggaaauuuuacaagacaucucaaguuuuuuuccauaaauaaauggcaagaacaaaaaagaaaagaaacauaacacacagggaaaauaaccuauagauaaaaagagacuuaagagauuuaucaacuaaauccaaugaguagaccacauuuuaauguugauucaaacagaauaaccaauauaguaaauaaucaaagaaauuuaagcaaugacuagauaucagauaaagaaacugcauacuaaauuaaggugucauauuuaccuuuuuuaaaagccuucauauuuaagaguuaaguauuuguuaagugaaauaguauguacaauuuacuuuaaaauaauugcagguugaggguggaaagauuauauagacaaaaugagauuguccauagauuauaaccaccaaaguuguaugauaggcacauggggguucauuauauuauuuucuguucuuugacaugugaaguuuuccacaauaaaaguuaaaugucugugugugugauugcacuuacacaauuuccauuucuauccccacugccgucacuaauaucucuugcuuagacuauagcaauagucaauuaucugguuuucccagaaucaugcuuaccuuacccaaauaauuucucuucauugucuauguggccugaguaaucuuuucuaaguaaaauaagccaacauauauugaguaaccauuauguucaaagcacuagaguauaacaauuucuuuauacacaucuccuuaagccuuauaacaauccuggcccaggcgugguaacucacaucuauaaccccagcacuuuggcaggccaaggggacaaauugcuugagcccaggaguucaagaccagccugggcaacaugaugaaacuccaucucuaccaaaaauacaaaaaauuagcugggcauaguggcaugcaucuguauuccaagcuacuugggaggcugagguaggaggaucacuugagccugggauauucaaggcugcagugagucauguucaugccacugaacuccauccuggguaacaaagugaggcuuugucuuaaaaaaaaaaaaaaagaaagaaaagaaaaaaaucuucaaguacuaauaauaucuccauuuuacagacgaagaaaucaaaauucagaaagguuaagucacugaaugauaucacaaaguuagaaauuagcacagacaggauucaaguucaaacaggcagauuccaauauuugcacuuuaagugcaaaaauuauuccucuagguauacucauuaauguugccaauaggauaggguucaaauucuuuaacauggucuaacaacauauucagugcucuuuccugccuaccuauacagccuccucacuucuuuccaccucguucuccaugcuucaggcauauuggucaugcacuucuagucccucucauacuguaaagccuuuucauauauugguuucucuaccuaaaacaacucagccugcccaccucagcagcuaacuccuauuuuauucuucaagccucagcuuaaagauuuacuccucgaggacauuccugauuccccacacuagguuagcuacuccugugauacaugcacagagcacuguguguguguuucccuucuucuaacccccaacacacuuguaauuauuucuucaaugucuuccuuuccaccacauuauaauagccuugcagucggggaaauuuuuuuauacaccauuuuacucacgauacauggcaaaguauuuuacacaugguaguuguucauuaaugaauaaauuaugagaagggaagaaguacaaaggaggauauuugcaaaucagacaaagucagugucaaaaaauaagaugauaaaggucagaauagcauuuauuuuuuggugggaauggaguagugacugugugaacaagcacaaggaaagcuucaggguuacuagauuuguucuguuucuuuaccuguuaugauuacagucauaaaaauucuucgaacuguauaauuaacacuuacauacuuacaccucaauuaaaagagggagggaaaaggguagaaaagaaaaagggaaaaagaaaaagagggagaaagagaacagcacuuacagauggcauaaacuucaaaaaagagaaaaaugguguaaguuugaauaaagauggggaaaaaaaguuugcagaaguagcaauguggaaguaaagguaauuuuauugagggcccugagauccaguggguguggaaaaauaaauacugcucauuugaaagggcuaaaacuuuccucuuagggguuauuaaaaaaaagaaaaaaaaaaguuaaagcaacagggaaggaugccauagggaaaaagaaauuucuacugagaagagguuugaggauauuaauaaggucuauuauagagugaauuccagagggcacaagcaucgaacaaacuauuuuuugaaaauguuauuuauacaaaucauaaaaacauaccuuuguugcauauguagguuuuucuauugcuucaucaccaaugaagaagucuaggucaucaacaccuuucaucacccuccuuugagcuugaucacccacuuuugcugacuccuuaauagcaauaccuuuaaaauaaguuagacaugucaaagaauucauuuuccucaaaugagaaaaacuuuuaccuuacacuucucccauuacaaaguacuacaaaguaaaacaugaccuagccuauuuaaauugucaaacuaauucacaaaagucauaagaaaccagugacaaaauucauuucacacaacgaaaccucaacuuccacucagagacaagaccucaaaugcaaaaagccagaaaaacaacaucugugggaaaguuucaaauauauauuuuuuaaauuauauaaauccuccuuugauucucaguaaaacuguaaucccaccaaauccacauaugcuugaugaacaacuggaaagaaaaaaacugaaaaacacaaaugagaaaaaaacuucaagaauaauuuuuuaaacuuucuuuacaucucuacccuaucacuacugggucuaguaauagugauugggucuaguaacaguaauuacuauuguggucuaguaauuuaaauguaauacagaucuguuaaacuacauauauaaaaggaaaucucaauucauuuaggugaaacccacaacaauauccuuaaauaauugcagaaauccagcauacaguuugaaagcuaaaacuuguuauguauuuuuagauuaaguuauaaauguacgaauccaucaaguucaguucuucauucaaaauaauugucugaaugcacuuaaacugaucuggcauucaacuguuacuuucauuuaguaacagcuauauccuuaagaaagugggcagaaaauaacuggaagaaaaaaauuuuuaauccaccaucuaguccuucuaaaugcuagaaauucucuccagcaauuuacuuacaguguacauagacauccagguggcucacuauaaauuuccuaaaaauaaauaugcauguauauaaaaaaaaccuugaaccacuugcacaggcuuuccagaucaaauaucaauacucauuaguaaaagacaguggcaaugucucuaucugcuaauuauaaacacuguaccugcagcauuaaaacugggugggugagaaaaaacacucaaaaaucaaaaaccuucuuacagcaggcaaaugaauuuuuaacauacugcaacuagucauggcaaagacuucauauuuuggcagagagauaagauaaaaaauggauucaauagugaugagauccaaugguucaaaaaaucaagauuauauaggccuccaacaaaaaguuaacacagccauuuacgaauauaaccaaaaccaauuuugcuaagauggcagaaauaacuuuaguagucuccugaaauauacaaucacaacaaaagauuauacacaaaagauuaaaagucaucagcauuguuacagguugaauuguguaucaccaaaaagauaugaaguccuaaccgccaguaccucagaauguaacuguguuuggaaauagggucuucacaguuaaaacgaaguuaucaagguggccccuaauacaauaugacuaguguccucauagaaagggaaaauuugaacacagauacagaaggaugaugauguaaagacgcacauuaagaagacagccaugugacuggagugacgcaucuaucagccaaggauccugaggaaacaucagaagccagaagacaccagcaagagcaugacccugcugacgcauugauuuuguacuucuggacuccagaauucuaaguguuuguuguuuucagccacccaauuuuugguacuguguuacguacgguagcuuaaagaaaccaguaaguacauacacgauggucuaacacuaaacugaaauacgacuaaagucaaguacuagcccaaagaaguaccucuacauuagucagcaauaaagccaacauguaucaccgaauucuuaauaacagacaaaaaacaaucaacguauugacauauaaaugugagaaaaacuacaaagaaaagcaaaccuauucuucauguucaguagauaacaaacaugcaugaauaaaauauuuaaaagguaauaauaaaggccacuagacacacgaaugagcuguuucaucaauaucaacuaaaauccauucuggguuuuaaagaaguauuagauuuaggcaguagccuaaguucuuacauaauugauuccuagaaaaguguaucaaaauaggagaaacacacaagucaaauaaguuuguuucuagaaagugaggaguagauaaaaacccuaaaaccauuuccccuuuuaggugcaauuuugaaaguguauuucuuuucuuuuucuuucuuuuuuuuuuuuuuuuuuugagacugagucuugcucugucaccccccaggccuggaaugcaguggcgccaucucagcucacugcaaccuccaccucccggguucgagcgauucuccugccucagccuccugagcagcugggacuacaggugugcaccaccaugccuggcuaauuuuuguauuuuuaguagagacaggguuucaucauguuggucaggcuggucucgaacuccugaccucgugaucugcccgccucggccucccaaagugcugggauuacaggcgugagccaccgaucccggccagacaguguuauuucuuuaaugccacacacuuaauuuuguucuuacuacacaaaugacaaaacaguugaccucuuguguccaaugagugcucaagugauacuaaagauccaguuuuuggcaaagccuaacaucuuauucucaacuucauugauucugaaacauacacugcuuucauuacucucuacauauucauuuuuccauuuucuuauuuucauaaugaauaacaaugaaauacaaaaaauucagucacauaaauaagauugugaaaaaucagugacacucucaaaauuaaaaugucuaggagaaccacuaagcaacggcucaaaagguuugucacuugguaugcaaaaguuuuaauuuggcuguaagacaaauagaucagaaguguuacuauauuauguacaaaaaacgugaacuguuugcaagucaaaaguguaaaaguacguuaaucaaggaacagaccuaugcuaacaaacgagcacuaacaaaccaaugucagaauauuuuuuaaaaacuacugaaaguuaauggucagcuuaagcaagauuaacaaaaauaggauaaaacaaaaauacucuaaagacauacaacaguaugguuaugggauauuagaaaacagcugaggucaacaucucuaaaggugagauagugagauauuguccuuccauccauauuuugaaacaugggcacuuagugaggacgucaacagauacgggcccuacaaacaguagucauauccacaaaccaaaggacagucuucauagguauaugauggggaauggacuacuugauaauuaguuauacccccauacuguuaacugcaauaucacccuaaaaauugggguacuguuucauuaucagcuaauuucuuuuuuucuuuaaaaagagguauuuaguagacauggcaaauggggagcuaaacauaaagcugaaaugaauagucagacauacaaaaaugaggccacacuuagaaccuggcaaaucauguuuuuaaaaggacuaaaucuuuuaggauuucagaacugauuacuucuuuuacuuaaauuauuagggaaggggaucuuuuaaaucagcucauuuguggcuuaaaagaaauacuuacaggaagggaugauaaacugugguucuguauuuccagcauauccuaguuuuguauaccugcaaaacaaaauaauuuauaaagauuucacuaauauuuuagcaauuauacauuucuuucuuagaauuucauuuguuaugaagugagauuccaucguagguaaauaauauaccaaauuccauaguuucacuucauuuaaccccuacuuucacaauucuaucaaaauuauaaaugcacagagcuucugaaaagaaauuccacuucaagaaauugauccuucaggaauauaugugaaauaauacacaaucaaggucauuagcuacaaucuugcuucuaacagcaaaagacuggaaauaaccuaaauaucaaucaaacuggaaacuauugaaauaugcuaaguuuauacuauggaauauuaugcagcuacaaaaaauagaaugaggaagcucuuaguauagugauaggaaacaauucccaaaauauauuacuuauugaacaaagauacagaacaauguaucaaguaugguauaucuguauaaaacuaauggggaggaguaaaaacauaugaaauauuuuguauaggcacaacguaucucuggaagacuacacaagaauaauuuugguugucuccaaaaaagggaacuggggcaugaugaacagaaaugagaaggagauuuguuuucauuguacauuguuucauaccauucaaauuaauuacuauucaaaaauaaauauaagauuuaauguuuugucacaguagacuuggccuacauucuucuaacaaaauaacaacauaaauaaggauuagaaauuauaaaagcugagcucugacaagcaguaugugggggcuacuuaggagauaguggggcauuuuuuagcuaugugggaaaagcuauuaacuauaagcaggcuuuaaagagaauguaacauuuuauauuauuccauauucaaacucacugauaaauagcagacagguaauugcugugacauucuuggacucuaauaucugaagaaucuuuuuucuaagauaaaaugaaaaaaaaaaaucugcugggggccugacgugguggcucacaccuguaacacuagcacuuugggaagcugagguggguggaucaccugaggucaggaguucaagaccagccugaccaacacggugaaacacccucgcuacuaaaacuauagaaauuaggcugggagcaguggcucaugccuauaaucccagcacuuugggaggcugaggcagguggauuacgggaccaggacaggaguucgagaccagccuaaccaacauggugaaacccccaacucuacuaaaaauacaaaauuagccaggcaugguggugggcaccuguaauaccagcuacuugggaggcugaggcaagagaaucgcuugaacuuaggaggcggagguugcagugagccgagaucacaccacugcacuccagccugggagacagagugagacucugucucaaaaaauaaacaaauaaauaaacaauaucuuuggggaauguuuuagccuccaaauuaaguucaagaacugagugugccaaggccgaggagagaggaucacuugaggugaggaauucgagaccagccugaccaacauggugaaaccccaucucuauuaaaauacaaaaauuagcagggugugguggugggcgccuguaaucccagcuacucaggagagugaggcaggagaauugccugaaccugugagacagagguugcagugaggcaauaucaugccacuguauuccagccugggugauaaagcaagacuucgucucaaaaaaaaaaaaaaaaaagugugccaaauaagaguaaaucauuaaaaauaaggggaaaccauaaacuguugaaaaaagugauauuggucuacugacuaaccucuucaacaguuccccacuguucacguuuuaaaaaaaaaaaacgaaaaacaaaaaauuuccuuguaauguauacaaaaaagucccuuuauuauuuggccucugaccucucccagcugcccugacaccacauuaaacucccuaaccauaaaaacagcugacaauuucucaacacuccaacucauuucaugccaccaagccacuauuaacacugcuccuacuacauuagaugcucuccuucccauccaguauaguuuaauaccuuaccaguggacaaauggaaaugacuagucuacuauaccaaaauaaaaacuuguuuaauacaaagcagucugaaacuguugaaccaaaacacucuaccuaaaagccuacuacuaucuaaccaauagugaauuauuaauaccuaacuauuccuuggucugaucccacauauuaaucucucuacuuuuauucuuauuugucaccaccacaauucaagcugcuauacccaacaauacccuaaaacaggacaaaacaguauuuccaauucuagaacuccuacaaaggacaagagaauaauauaccuaaaaacaaugcucuaauuguuuuuuccucugcuuacacaccaccaccacagcaaucaacacagaagacuucugggaccaaauguguggaggguuucucccaacaacaaaaaagcaaucaauucugcaguggacacuagcuggguguucuguaauucaauuccaauacuaucuaccuggagauaacaucagaauccacagguugaaggcucaguccccaagacugccccccuucuucagacaccagucacaagccccagacucuggaacuucugacucaccugcuugaagaugaguuucccauacucccuccuugaguucaauuaauuugcuaaaguggcucacaaaacucagagaaacacauuagcugguuuauuauaaauaauacugcaaagcauacagauaaagacacacacagggugagguguguaggaagagacguagacguuccacacccucucgagcguaccacccucccagaaccuccacguguucagcuaucugaaagcucuccaaacucuguccuuuggguuuuuauagaggcuucagugcauagacaggauugauuaaaccauuggccacuggugaucaacuuaaccuucagccccagugguuggaggguggggcuggaagucccaacucacuaaucaugccuuggucuuucaagugaccagccccaucuugaaguuaccuaggggcugccagccaacagucaucccauuagcacucaaacagacgucacuuuggaguuucuaagaauuauaggaguuguauguccgaauauggaguugaagaccaaauacauauuucccaauuucaaacggccuaacucaaaaaucuucaaaugaugcucuacuggcuacaagauuaaguacaagcuuguuuccauuucuguaaaauuguucauuguaaaauuguuccuaaaggcccauccacaugaacaauuauaucauucucugauuccuucagcugaauauuaaaguucuccauaaucauuuccaauuuuuauaagcaucugcuaucacuugcuuacauaaacccagcucuaagcauacuacaccugcuacucuuuuuucccuuauaucuugucuauucccuauuccccccucacauauuaucuacgcucacacugcacccucccaaaaaaaaaaaaacaacaacaacaacaaaaaaacuuuuaucacaacuuaaaacuucuccaggaagucuuuccugaucauuuuaacuaucaggcauccuuucuuuugacuaaucuucauuucaaccauaagccacacauauuuuuauguguguaaauaucgucuccuaaauauuacaguaauauuugaaguacagaccacauuacaguagaaauucccuuaagaaacauucauuuaaccagcuuaccagacugaucaagaccccauucuuggccaaaaucaaauuuccuaggcugaguauauucaucaaugaauuacuuucaaaauaaacaccaaaaggaucaaaugaaccuaauacaaaacagucaauauguaaucaaaacaaaaaugcucuucucaaaacacaagaauaaaugcauacaguauccaauuguauggauauaccauaauuuauuuaaucacuucuaauguauuuuaaaugccacagcaaaauaaucuacuacauuuuggggagcaguaacuaauguucuacuaccuuagauuuaaauuuuaaauaucccaaaagaacuaaaucauguaaagucugucuacauuaguuaggcagacugcuaaauuacagcauuugauaauaaucauagacaacaauauuuucaccaauucuuaaaaaauaugaggggaaauaucacaguuuacuuaacuucauaaguugcuuagacucuaaaagcuaauuugguuccugucucaaaaaaaaugugguacaggacacaaucuaaaaaaguaaaguuaucuacuaaacuuuaaaaaagguuuugaaggcucaaccuucaaaaagucacauuuucucccgcagggaguaaagugcugaaugacaaaaaaaaucacucuuuaaaaccacucgcuuuauacuacuagcaaacuuuaaaaauuaagauuugaaaauuaaaaaaaacaagucaaaguucagagaauaagcguacagaaaauacauugcaauaauuuuaaaaauaagaacagaaccguagaaaucucagacuaaaaaaauacuuuuuaaugcucauauaaaaauacuuuaaugcuuauaugugagaugagaaacauuuaaggagaggaagagguuugaaaauuguuauuagaaaaagaaaaaaauuagaaaguauauuaaauauuaaauuuauuuaaaacuccaaaauaaaagcuuuucaaauguaaacuagccuccauuaaccuaccaauucuauugaguuuuacacaugaaauaacuacauauuauccuuaagauauuuuuaugaacucuaaaaauucgauagucaccauaaagaagaaauuuuguacaaguagaugguagaaguuucucucgcuuuuucuuugacaaaaaaaaaaaaaaacugcuaacagcuaauuggcauuugacauaugaacuuuuuaaauuguaauuuaaggauguaaucacuaucuuuaaauucaaggcucuuguuuuucagugacacaaaguucaaauauuuuuguaauaauacaaauagguuucaaaugacuuuccuauuaagcauuucucuaagcauauauacauguuuguugcucucuaaagaauaaugauguucuucaggauccugaccaaguguaucacagcaacccacuuuuuuuuuuuuuuuuuuuuuuuuuugggggacagaguuuugcucuuguugcccaggcuggagugcaauggcgagaucucggcucaccacaaccucugcaccuccuggguugaagcgauuuuccugccuuagccucccaaguagcugggauuacaggcaugcgccaccaugccuggccaauuuuguauuuucaguagagacaggguuucuccauguuggucaggcuggucuccaacuccugaucucaggugaucagccagccucagccucucaaagugcugggauuacagcugugagccaccgugcguggccaacaacccacuuuuaaccuuacuuuuccaaaauaaauuuuugcuuugaauuuauaaauccuaucaguauaauuuauuuuucuacagcccuugcaauuuucuguaaagauuuccuggauauucaaaaaggucauucaugagcugggugugacggcucacgccuguagucccagcacuuugggaggccaaagcaggaaggucacuugaggacaagaggugaacaccagccugggcaacaaaucaagauccaaaucucuacaaaaaauuuaaaaaucagcuggacauagcagcucacaccuguaguccuagcuacuugggaggcagggaggaugacuugagccauggaggagcuaugacugccccacugcacuucaguugggcaacagagcaagaccccgucuuuaaaaaauuauuauaaaauuacaauaaaaaauaaacaaaaaaguaauucauaaaagcaccuucuccccugcucuaaguuacauuuagcaaaaacucucuuuuggacagcuaguaaacaaccugaucucauucccuccuaauaagcuuuaaaaauaaguuuaaauggcuucauuuuuucuuaaauuugccaucuggauaauugcauuuaguacagaauucagacuugggacaaacuuucauaucugaaagcuauuuacccaaaucgauccacagauucaagcauuucccaucaaaauccuaauaacauuuuugcagaaauagaaaaauccauccuaacauucauauggaucucaaaggauccugaauagccaaaauaauccugaaaaagaacaaaguuggagaucucacacuuccucauuuuaaaaguuacuacaaagcuauagugaccaaaacaguaugguacuggcauaagaacuaacagaaucaggagcccagaaauaaacucucacauauauaauuaaaugauuuuuaacaaggaugccauaacuacuaagaugaagaaaggacagucuuuugaacaaauggugcuggaaaacuggauauccacaugcaaaagaaugaaguuguaccuuuaccuuacaccauacacaaaaguuaacucaaaguugaucacagaccuaaacacaagagcuaaaacuauagaacucuuagaaaaaaaacauaaggugaaaagcuucaugauacuaaauuuggcuaugaucucuuggcuaugacaccaaaagcacaaguaacaaaagaaaaaaagagaaaaacuucaucaaaauuaaaaacuuguguaucaaaggacacuaucaacaguggaaaggcaauccacagaaugggagaaaauauuugcaaaucacuaucuguaagggauuaauauccagaauaaagaacaacacaacaaucaaaaaaagcccaacugaaaaaucagcaaucaaccuguaaugacauuucuccaaagaaaauauacaaauggccaauaaacacaagaaaagauguucaaccuuacuaauaauaaagaaaaugcaaaucaaaaccagaaugaaauaccccauuacacccauuaggauggcuauuaucaagaaaauaacaaauguuggggaagauguaaagaaacugaaacccuugugcaaugcuggugagaguuuaaaauggugcaaugcuguggaaaacuauaaaauaguuccuccaaaaauuaaauacaguaauuacacgacccaacaauuccacuucuggguauauacccaaaagaacugaaagcaggaacuugaacagguacuuauacaugcauguucauagcagcaauaucugcaauagcuaaaagguggaagcaacccaagcauccaucaacaugugaauggauaaacaaaauaugauauauacuuccaauggaauauuauucagccucaaaaaggaaacacaugauacaugcuuacaacauggaugaaccuugaauacauuauaaguaaaauaaaccaaucacaaaaggacaacuauuguacaauuccacuuauagaagguaccuagaaaagucaaauucauaaagacagaaaguggaaugguauuugccugggacuucgcaugugaggagagaacgggaaguuacugcuuaaugcgcagaguuucaguuugggaagauaaaaaaguuauggaucauggaggauggugaugguuagacaauaaugugaauguacuuuaugccacuaaacugcacacuuagaaauaguuaaacaguaaacuuuaugaguauuauaccacaaaaaaaaaauuuuuuuuuuuuuuugagacggagucuuguucugucgccuaggcuggagucccguggcgccaucucggcucacugcaaccucugccuccuggguucaagcgauucuccugccucagccucccaaguagcuaagacuacaggcauccaccaccaugcccagcuaauuuuuguauuuuuaguagagacaggguuucaccauguuggccaggcuggccuugaacuccugaccucgugaccugccagccucagcaguuaccaccaagaaaauaauacuggauaccuaccgcacauguuaaagcaggauaaaucuaaauguaucaaauauaaaguuuaaaagaaaaugugauauaguuuauaacccuggagugcaggagacuuucuaacuauaacuuaaaacccauacacuauaaaagguuauuucaacuauguaaaaauuaaaaacuucuuuacaaaaacacacccaaaguagccaaaagaaaaaugaguaacagagaaaaauuaucuacacaaauuaucuagacagauauaaucucuuuaacauauaaaggguaccuagauguuaaugacaagggagggaaggacaggaagggaggaaacaaaagaaggaaaggcaaaaagacacuaaccauucccagaacaacagaaaugguuauuaaaugaaaagagacucaacuccaugggauuuuuaaaaugcaaauuaaaagugcacugaggugcuuucaaacauuacuaguuggagggaggguuguauaacaacaacaacaaaauaaaaaacauuacuaguuagaaugcaaaaugaugcagccacuuacgaaaacaauuuaacuaucacuuaccaucugacccaggaauucuaccucuaguuagaaucuacuagaaacaagaaaaauaaaaacaguuguccacacaauuguguacauguauguucacaacagaauaguucauaaagacccaaaacuggaagaaaaacaaauguuuaacaagagaacgaauaaacaagaguguuauauucauacaaaccaaaauuacuucacauaggaagaaccaggaaaacauaacccauucuccugggagaagacacucaacagaaggcaauucuaacaugacccaaaugcuggaauuauaagauaaagacuuccaaucaacaaugaguauuaacauagaccuguaauugauaauaaaggaaauaucaccagauaaaugaaaauaaaggccaagcaguagaaauuauucauucugaaauuggggggaaagaaaacaaggaaaaaggaaagagcuucagggacucaucaaggacaauaucaaaaaggugauacacguggccaggugcaguggcucacaccuguaaucccagcacucugggaggccgaggugggcggaucacgaggucaggagaucgagaccauccuggcuaacaaggagaaaccccgucucuacuaaaaacacaauaauaaaauuagccgggcgcagugccaggcaccuguggucccagcuacucaggaggcugaggcgggagaauggcaugaacccaggaggcagaacuugcagugagcugagaucaaaccacugcacuccagccuuggcaacagaguaagacucugucucaaaaaaaaaaaaagugacacacuuaggucccagaaggagaagagaguguaguaaaaauauuuuuaaaaagaaauagugacaggccagacgggguggcucacgccuguaaucccagcacuuagggaggccgaaguggguagaucacuugaggccaggaguucaagaccagcauggcccacacggcgagacuccaucucuacuaaaaauaaauuaugggaggcugaggcaggagaauugcuuuaacccaggaggcagagguuucagugagccgagaucgcgcuacugcacucuagcccagcaacggagcgagacuccgucucaaaaaaaaaaaaaaaaagacaauuagcagagcauggugguguaagccuguaaucccagcuacucaggaagcugaggcacaagaauugcugaaccugggagacagagguugcagugggccaaggcugcgccacugcacuccagccugggcaacagagcaagacucagucucagaaacaaacaaauaaaaaggaauaguagcuaaaaauuuucccaauuuagugaaagacagaaauuuagagauuuaagaggcucaagaacacccaagcagaauaaauauaaagaaaaccacacuuaggcacaaaccacugaaaaucaaagauaaggaaaacaauguacucauauauggggaucuaaaauagaaccugauaaauaaguagcacggcaguugccagguauugggaaauggaggaauuggagagcuguugaucaauguauacaaguuuccaguuauaagaugaauaaguacuagugaucuaagcuauagcauaguaaccacaguuaauaacauacaguauuuuacaguugaaauuugccuaaaggcgaucuuaagugucaucacacaaaaaagguaacuaugucagguaacaaauacauuaauuagcuugauuguaagacucaugacacaagguuuacuuauaucaaaacaccauguuguggccagaagcaguggcucaucccuguaaucccagcacuuugggaggcccaggcgggcgaucaccugaggucaggaguuugaggccacccuggccaacacggcgaaaccccaucucuacuaaaaauacaaaaacuagccaggcguggugacgggcaccuguaauuucagcuacucaggaggcugaggcaggagaaucacuugaacccgggagaaagagguugcagggagccaagaucacgucacugcacuccagccugagugacagagcgagacucugucuccaaaaagaaaaaaaaaaacuaaaccaaaaaugucucuuugugaucuagagaaacaaguuaaauauauagaaaagcucuuacuauggcaguaaugaaaaaaaucuacaaugcugauuuuggcugcgaaagggagaugguaagggacuuaaaaaacaacuugcuauuguacucuaaaauccuguagcugagguuuagcuguacucaauuugcuuguauaaaauauauaauacaucauuuuacauaaaaaaaaaaagaaaaacaacuugcuuagagaaaggaauauagagaaaagaauucaaaagcacuuuugaagcuaucaaagccuuggugacuagaagaauaauaguagaaauauaagaaggcuaggugagagaggaggcuggacuggcagaaaucaacagcaaaagaaagaugaguuuuauaccaaaaaaaaggcgagucugucacaacaguaacugccucugaggaaaggggaaguggauuuggggacagucaucaauaaugcucuuuuguuccuuaaaacaagaaagauaaaguaaguauaauuaaauguucacgggucauaauucuaacaaaugcagguaucuguuauauuauugauuguaccuaccuaaaagaaauccauuaauagaaucuuuuucaguaguaaaacaacuuaugccugcauuguaaaagcauuaacauccuuugccuuggauauuauuuuuaauuuuacaaauugcaaaugcuuguacauuaaaacauguacaauuacacucucuugcuaggggcuaauauaguggugacuuugaagccaauguuccauuacaauucugaaaauuauagggcccuuaagaaugaugcuaaaucuacucugccugugccucuacauacggaacaaguuuuaacuuucaauaguucaacaaaugaaaugauauaacaaaauaaauauaagaccccagagcuuaaggauagaagagacuuuaaugaucuagcacaacucuuuccaaaaccuuaacacugacaaccacuaaaguucaaauaauucuaucuuaauaugaaugacuugcuuauacucuuaccauaucauaaaaauaaaguacaucuuauauaauuuuauguaagauaugauuaccaaauaaaucccaaaugaaaacagaguuuacuaauugaucccaaugccuacucccauaauaucuuaauucucagcuuacccaguuuucgucauacaauaccaaagcccaaaaagguaauuugguguuagaaacuuuguuguugcugaaacagaguuucgcucuuauugcccaggcugaagugcgacagcgcgaucuuggcccaccacaaccucugccucccagguucaagcgauucuccugacucagccucccgaguagcuggauucaagcaauucuccugccucagccucccaaguagcugggauuacaggcacacgccaccacgcccagcuaauuuuguguuuuuaguagagaugggguuucuccguguuggucaggcuggucucaaacucccgaccucaggugaucugcggccucggccucccaaagugcugggauuacaggcaugagccaccgugcccagccagaaacuuuuaaaacaagaaugcaguggcugauucacagggaaauuugucaaguagaguaagacaauauuagcuauaaagauaaacagcaaugguuuaaaaaacuuuuccaauucccuccaacauuuuucucaugacaugcaagucaauguuuaaccugacacaaaaauacugauggacuguugagugaagaaccuggacgccuacucugugugucaacagaaacauucuccuggucccuucaagccuaaaccuuaaaaucuuaacuccuuuucacuaguggggagaacaugaaccuugaaauaaagaagacaugacugaaugcuuguuccaccauuuacuagccugugauccugugaucauagacuaucccuaaugcaucgggaauaaaacuaaauucaugagguugucauaaggauuaaaggaccuaacagugaauaaaacucacuaaguauuugguaaacauuuccuucccaagaugauuuuccuuuauccauaggccuuccuuuaucccucuacccauuccuuuaauuuugcuuucaaagauucucaacguuuucccagucccuuugcuauacguccaucaccacugaagacaacgacuacagcagucagcacuugccccaugaaagaaaucagucacaaaaagccacaaauuguaugauuccauuuacaugaaauggccaaaauaggcaaauccauaaagacagaaaguaaauuaguguuugcuaaggguugaggguagagguaacggagagugacugcuacuggguguaggguuuuuuggggucaugaaaauguucuaaaauugauuggauuccaauaaguggcauccaggcauuaaaaaaaaaugaaauugacuggaaauaguugcacaaccuugugacuauacuaaaaacuacucaauuacacacuuuaaaagaguaaacuuuacaguaugugaauuauaacucaauaaagcuguauaaaguaaaauacuagacccagacuaauagugcauaaauuuaccuuuuaucacucuuuugcuuaaugaucuacacaauccacuacugucuaucaaauaaaucgcaaaccauucugccccauuuaaaauccuucugaaauaaggcaagaugaguaaauaaacuacuugcugucccacagcucccaacagaaauaucugaauuccaggcagggcaauuuccuaacugacccaucccccaaauacuuugaaacuccuucaugacuucccuuuaucaguaaaauauuugcugggcauuauuaaauaucaugcaggacgcuaucacuugaauagagaaugcacaaaaaagaaauaaucccugccacuauggagcuuucaauuuagcucacauccuagauuugaaguccuucuucccauauaucuaucacauccuauuuaugcuuuuccaaggaucugaucaaguucagcuucuucauaaaucauccuccaaauacuacagcccuuauuaaucugcccaaacaauuaaaugcuaguaagccauccauaauuauuucacacauauuaguuucaucuuugaaacuaaacuguaaaccucaaguauaaaaucaugccuuaguuuucuuguauauaccauaguguucagcacagaacugagacugaaauaaauacuugauuacuuuaaguucuucuauuuuuuuacuuucauauguguuuugugcagucauuaaugagcacauaauacauagugaguaaaauaauuacaguaaguaaugcaucaguggagauuauucauuuucaaauugcagcuucagaaauauguaugccuuccuuuugaagauauauguaauuagcaucauuuccuugagcugcccugaauuuaucagcaauuaucaguccuugcaauacucaaauaagcaguaagcaaauccauauuucacuuuaauguguuauagguuaaucaaaucagugaacuggucacuaagaccucccuauauguuucauauuuguacuaaaaauuaguagcuuuggguuuaaguauguauaaaauggacacucuuaaaaacuggacuaauaauuugaccacucuccuuggauguaucucaauuagggaacaguagagcagugagcucuggaaugagacuaccccaggacuaaaauucuaaaucuacuacuuaucuuugaaaugggauuauuuauaacaguaacuaccucacagggcuucugaaaagguaauaacauccaaaacaaaacgugcaaagggccuugaaauggcugauugguacacaucccauuuaauacaucuuuaauaauuaaaauccaaagauauaaaucucugaaaccauaaagaaaaauuuuuuuaaagagagcauucauuuuaugaaagucaucuguccuggcaccuacagagcacaacuuuuaaaauaucucuaaacuugguuuaaaacauuauuauugggaaacauaaaauuaguuucucaugugugccauacaguaugccucugcauuacaacgaaacacugaagaauucugauguaggcuucaacuaaaacuacuuuaacuauaaauaaaauacauuauguuauuccaauuacuuaauuucaacuauuaacucauaaaugugaacucacaagaaaauuuaagagaacucaacaauacuaucaauuaauaauuaggaacacucccaaaagacauuucucaacucugagccucuguuucauuuguaaaugaagacuggauuaaauuaucucucaaaaucccuuuucagcucuauaauucugugugagucauuaggcauuucccuuaauuuacuaaagcaaguuucacaaauacacauuaaaugcuauauuuguacccuugaguaacugaauuuuaaaaaugcuuauagcagaagcacacuagauuuaacuaaaauaaucucuauaacuaggcaaacacuuguguccugucauacacuaauacuaaaaacaugguuuacauguuuacaguagauuaagccaacccuaaacuacaaggucuucugcacccuaauucucucucuaggacuuuuauccuccucauuguaaccucuccuuuacacuaaauacugaaaagcacagaaacccuucccaagagcauugcauuuucacaaaugacacaaagucuuaaagcaaggacaaaauguuuaaaaauaaaacguuuagguaauguccuucggcaggaggaaaacauggcauguugaguauccgaacagaugaauauucuucucagguauguauuaggguuggggagcagaaggaaagcugaaagaauacaucuggccgagacggguggaucacuugaguucaggaguucaauaucagccuggccaauauggugaaacccggucucuacuaaaaacacaaaaauuagccaggcaucguggcgggugccuauaauuccagcuacucgggaggcugaggcagaagaauagcuugaacccuggagacggagguuucagcaagccaagaucacgccacugcacucuagccugggugacagagcaacacucugccucaaaaaaaaaaaaaaaaaaaaaaaaaauaacaucuggccacacaaauucaagcuauuccuuuccugguuccaaggaguauguaagaauggcuugaguuuaaaucgacaguuuggaaagaauuuugaaaauucugaaacaaaauuauuauuaaaauucugcaaaaucguccuuuaaaaaaacuagaauuuuuuuucuuuuuuuugcucugguauuagucaauuauguagguuacguuguuuccugauauaaaggcccauauaaaguuauaaaaucagcacacaaacuaauauuagucacuauccuauuucaaagaacuaaauuuaaaacaauccaauaacaucaccuuaucuccuaucuaauaauucauaaaugucguguuugguaagcuacagcacacauuuuuguagugcuauuauuacuuaauugcuuugcucuugcuucuuuaugcuacugucuaucacugauuaugguugugucauaaaaaaggcaacaagcuccaacagaauuacaagggagcauucaaaugcuuuuuuuauuauaguggaauuuuguuucaggaaacacauguugcuacauuuuaaccauuccaaacuucugcuccuaguccaauccuuuagcuguuuccacaaguugggggagcaggagcaugcuggacaagggaaauuuagcuagagcuaaacucuccuccugauuaaggauuuugccucuuagaaaauugaaugacauagguggagauaagauugucagcauagcgaucaauuaccacgagccaaucagucacugugaugcucaagaagcuagaucacauauccacaauuuuuuuaaagaagggaaacugauauucaaucuuuccguucuuuucucucugaaugcucucaucuuauuagcuucaguuaacaaauuaugauucccaaauauccaccuucauucccaaagguccuguauuuuuaauuuccucuagaauguuuccaauuauaaaucaucauuccaaauucaacaacaaauuccaauuuuacucaguuucuuaaaacuaacucccuuauugucccaaucacucaggcuuacaaucuugaacuauucauugaugccuauuuacaauccacuggaaucaacugccaaguccuagcuauaccuccuucaaucucucaaaucagcaaaaacauuuugacugugcagagaacugugugugguaggcaggccaaggccugcaggagauaagaaaauaagcauaacacacuguauuccuuucuuuaagaacugaaacucaaaaaaaaaagaaagccaaccaauuauuauauuuaaaauauauugugcccuuacugugugccaggcacugugcugaaccauuuucacacauuaucaaaaaacagaacaaaacaaaacaaaacugggcaugguggcucacuccuguaaucucaacacuuuaagaggucagggcaagaggauuacuugugcuagaaguuugagaccagccugaggcaacacagugagaccccaucucuacaaaaaauuuuuaaaaguagccacacaugguggcaugugccuguagucccagcuacucgggggacugaggcaggaagacagcuugaacauaggaguuugaggaugcagugagccaugaucuugccauugaacuccaguuugggcaacagagacccagucucaaaaacaaacaaaaaaaaccuauaagguauacacuaucaucuccaaauuacagaugggaagaaauaagaccugcagagguugaaguguauaaagucauauagcuauuaagugauagagcuugaacucaacaacagauaacuacaaagccuuugcuacccguaaauaaaauaacacgaaauauaacugccagaagaaacguaaaaagaaaggaaaaaaccaaucuuuuccuaacuuaucucuucugcuccaacuccaccgccaauaccagguuucagaauuucugcaaaguuagcccuugaaugggcugcugaagaaucaucuaggaagccuauguaaaugaauauucauaguccaacccuugagauucugagucacuggguaugggguguuucugaugcacaguuuuuuuaaaaaccauacuccuaauucuuguucauucauucauacaacaaagauuugaauuccuacuaugcaccaagccaugucaaacguucaucuucuacggaaggaagaucuaguguaguggcucugccauacuuacuugcuacaguaucuuggguaaguagcuuaaccucucuuaagacuaaauuuucuagccuauaaaacaaagauaauacuuuccagguuguugugaaaguuaaugagauaauauaaagcauuuagcacaggggcugacauacaauucucgauaaaugcuagcuauuauuauuuccugagaaacacaaccuagagaguaauuuuuuucuagagauuaaauuuaagcaaaguaacaaggaaauagucuaggcauucacauaucggcagggggguggggggggggaaccuaaaccaaguaaagauuacacagaggguuuucucuaauuaggugaaucaaauucauaaggcugagauuuuuuuuuguaagaguucuuuaaacagaaauacaguuaacuuuacuaacaacaaugaagcaacacauaaaguucugaaaaggcagucaggaguccccggaguguuaacagaaagaacacaggacuuaaauacagaacucagguccaaauagcagaucgaaccaccugccagguagacggcaucaaaaagguaauuuaaauucucucauucuguuuuuucacuuauaaaauuagguuaaaaaauagcugucacagaaagcauggccagcagguccuccacaggaccuuuccguucugugccuaaaauucugaacuguguuuuacaauaagccugaaaguucguucaccgcaauauaguauuugcaauccaaagucaauauuucaacacaaaauuggcaggcaggaaaggagggagagucuuucgcuaagucuaaguaagagucugacuucucacuaggagcaugucuguuguacuuacuucaaacagcaugcaaagcaugacucaucaaggaauaagaauuucaaugagugcuuuuugguuaagaagcuauugugaauauuucugccuuuggagauggcuaaagaaauagcauuauuaagccggugcaguggcucaugucuguaaucccagcacucugggaggaugagguggguggaucaccugaggucaggaguucaacaacagccuggccaacauggugaaacucugucucuacuaaaaauacaaaauuuagcugggcgugguagugggcgccuauaaucccagcuacuugggaggcugaggcagaaaaucaccugaacccaggaggcagaaggagguugcagugagccaagaucaugccacugcacuccagccugggcgaugagagcaaaacuccaucucaaaaaaaaaaaaagaaacagcauuauuauuaaacaauacgcacagaauucauggaagaaacaugaacuucccacauauaccuuccuucauuuacccagcuuuuccccacugcucuucaaacaagaucauucuuaucugcacuaauugcugaauuguggccacaagaugaacauacuccucuuucacugacaccuacaagauauuuaagcuuacauuuuaagauugcuaagaaguugaagucaguuagcaaaauuccuuaaucugcuccagauaugaauauauccaagacuuugaccauagggcuauauuaaccucugcuaucauaaucaguggaacuaauuuaccaauauuuuauuuaccaggggaaaaaaaaagacauaaaagggaaaaggaaauucacaaugcagcucuguaaccaagcuacgauauaacaaggaguuaauaaggagcgcccucauuuggcuugaaugauggagaaacuugaguaaaaacaugcauuuaaaaaaaaccuuuaaggcugggcgcgguggcucacaccuguaaucccagcacuuugggagguugaggcggguggaucacgaggucaggagauggagaccauccuggucaacauggugaaaccccaucucuacuaaaaagagaaaaauuaacugggugugguggcaugugccuguagucccagcuacucgggaggcugaggcaggagaauagcuugaaccugggagguggagguugcagugagccgagaucgugccacugcacuccagcccagcgacagggcaagacuccaucucaaaacaaacaaacaaacaaacaaaaaaacaaaaagcaaaaaacacauuuaaaaaacgaucccuuccaccgcccagaaaaaaaaaaaccuuaggaugaucauacaaguguuacaauguuuuuuuaaaaaauguuugugaaugccuuuuaaagaaaaugcuuuucucaccacuaauagcagguuugaguucuguuauuuaguuuucaagccaccaaugggaaucuaugugccccaacuguauuuuacaaugcuuuccaauacagaccaaaaaaguguguagauaaggguaucaaugugaaugaagcauuucuuuucaaauucuuuucaaaauaaguauucucuuuuaugaccugaaucuaggugauucauauguugaguuuugcuggacgaucccuaaaaguuuugggcuuaaguuucaaguuuccuaacucuuaacagcuuuccuaucuaagacgaucaaguuuuacagauggccacuuuuuuucagccaccuuuccccuaauuuauauaaugaaugaaaugagcaaccugauucagguuauaacuuuuuacuuaaacuaagugaguaauuguaauuuagagaccucagagcugaaugcauucucuaaagcauaaaaaaaauuagacaaauuacaggugcacaauuugcauucggggaccacagaauuuugaaauguaaaagcucccuguuaaggccauacuuagagauguuuaucucaggguccucaaccucaaggacuuauccuccaugugcaaauaaagcugaagguguaacuucccaggaggcaccacuggaaacuuguaagaccaaaaaggcuuuugagaaccaaaauaacugaaacucuaaagggggaauuucagauugugacaaaugguaaaagagagugagguggcaaggggacuccuaaucaguuccauucaaaucaucaaugugcaguuaauaaccucuccuuauuggagaaaccaauguaauaacuuaaaaauacacuauugugauaaucguaauuuuaaaacagaaauagccuagguuaaauugaaccccucuucccgauccuacuggucauucagcauguuuuaaauucaagguugcccuuuaggaaaggaggucacuuaaggacaguuuaucucaaugaaacaucuuguauacuaauucgaaacuauuucaaaagggggaaaauggagauuagaaaaguaacauacuacuugagauguuaccauauuauuucucagggccacaauuauuuacacuauuuuuuugaaaacgcaguaauuucuaaagcauuaauuauguagcaauauucgucacuuuaacaaaacacauuugaaaaguccuauccuacugacucaggccaaaucuaauuuuaaaacugaaccuagacauaaaaauacucaccaauuagacuaagaagggagaaauaaaaaaaauuauugguucagagaaaugagacugaauuaaggaaaaacuuuuaaauaaaguguucaucaaaaaaauacauagaaguuccaaggcuaguguuuuccuaggagaauauuaagaaguuggugguuucucucuaccuaacugggauuuuagaaacugccacacuagcuaguuaugagaaugaagauuaaagaaauuucacauaaagagugaaggacacacaaucuuuuaaguaacaauaaugaaaucaauaauuauaauuaauaauaaaaaaaaaagccugacaguccaccucuuacugacuucccccucaaaaaaaaaaaacugggaguguucugggaauuggagagaugucaucagcacagaaaaaaaaaccacuuuccuauaugucauccugaagcagugauucuacauaaaaauaaggguagucuauucucuaugcaguuaugagugugguacaacucucuaaaacgucuauuaauacaaaaugaacgaccacacuuuaaagccacucuacauuuucgcaaacuacccuacauaucuacgaguaacuauuugcaacuuaaacacccuccuauauaccucuauaccuuccugcuuccuucaagauaccaucacagaaugaacgaauacaacuuaaauuaguuuauuuuccagggugcuuccuuucccccacuccaugaaacauaaguacauuuuuuuaagucauauaaauggacaccaagcaccgguaauucagucucuuuaaaaccugcuuaaaaguucuaguaagaugugcucagguuggaaacuaaaaacuaccuuauaaggguauaaaagacugaaagcaggaagcggcuuugacaaaacuaaggaaguugcagcgcgcuugcucacugggggacuuuuuugaggcuacagaaguaacacaugacaucuuucucccucgaauuaaaaugugacuugguucaccgguuaaaacgcagagggagauggaaaugaccaggagucgaaaggagaagguggguggucaaaugaaagccccacuguagguucccauuuucagaguccgauucuucccuuuccccacccacacccugggcagaauguugucacagcgaucuugucaaaccuaccaggagcgcuucucuuuucuagcuccccugccaggccaguccccgagcucggccccuggguccccaaaccgacuggcaaaaacgggcgcggagggaaaggaaagccggaugggucgggcccggggaccacccccaagacgaccguccccagcgcccuuugggcggcgcugcccaccguagugggggaagggccgggaggggucgcgcggagaaagccgcugggaggguuggggguugaaucucgggcccgcgcccccgccccagucccaggagggagaaacgaggggacccgcgaggcccuggcugcgggccccaccccucgcuggccggcgggucuaggacugacagccggcggcggcaccucgccgcaccauucauuucccggccuccucccucccccgccaucuuccuuccuccgccucaguuuccccacccccgcccguaagcccccuuaccccgugccacaguccaccacacaggccggcagccgucccgccaucuuccuccucgccugcugcugcugcugccgccgucugcuccgugcugcuaggggccagagauuggcggcgggagacaagggcuaucugaccauccacagcugggccgccuucaccguccgggggguagccgggaagccgaagcaguagcaagaaagcagcaggcucggucggcggcuaucacuuccgcaacccaggcaggcaggcaguccccgcccugccccgccgcggccuccucccccucucucuucccuccuccucacuccugcccccacccuacaacuucuuccccucacgccgccuuuccccgggaagccaagau

SEQ ID NO: 191142 - RNA, 118445 nt, Homo sapiens
cuucuucccggcagccuuagcgccaggcccggcgcuccucaagauggcugccgacagugaggugauuucuuugcucccuacuuaauccuugucacuaucuaaauucguuccucaugucuucgccuuggggcuuaauuucuuuuucucuccuuccccuucccgcagcccgaauccgagguauuugagaucacggacuucaccacugccucggaaugggaaaggugagugaaucgcauuuuugguuaccagcucccaugggcccuggcguccccuagccgcuucccugaccccagacacaccacaagugacgccacuugugcgggaacgguaauaccgugggucccgggucuccucccccagucuucuuuggucaaccgcaagccucuuccgcgucucgcgucuggcaacacccggcccgcccccgucagccaaucccugaggcucaggcucucagaaaguuuuguuuucucuccugucagaccgcuucccuuagacuuugguuuucugguuguuacccacucgcaagaaaaauuuccgaggcugcaacaaccguuccgguuuucauuaccguuuaacucauuaucguaagcaguaaacuugguagguugugccgcaccucaucccguguacguugguauacccuuuucaggaggaagucuuucuucagaguauugguaguuguccaucugucacacucccaccaucuccaugcugucuuuaauuuuuuauuuuuauuuauuuuuggagacagagucucagucuguccgcccaggccggagugcaguggcgaggucauagcuuacugcggccucgaacuccuaggcucaagugaagcucccgcuuuagccucgggaggagcugggaccacaggcacgcgcuauuacgcccaacuaauuuuuuaaagaucucgcuguguugcccaggcuagucuugaacuccugggcucaagccugggccgcccaaagugcugagauuacaggcgugagccuccgcccauccugucuuuuagaauaaccuuuuuaaaaagucugcauaugguuuuggaaugcuuugauuuaaguuguuacauuaaaguggguacugugcccaggcuuccugugccugucaaauucagaugaacagcugucugggugaaacuguucuauuacugaaauuaguugaaagccaaguuuguggaggagugauagcuuagaucgagaagguuucuguuaagugucacagaaacccuucaguuuccuggguguugaagucaguguuuacgcuguuacagcauuuuauaaucuuucugguugggagaggaaauuuguggaugucgugucauuagguggcacaggaaaauauaaaagguccuuguuggaauaauaguuagaccugugguacccuucauaaaagugucaguaagacauaaccacacuggcaagacuucauugaguagguacuggguguccagagcuauauacaaagggaaaagcagaaacuugacccauauauuuuuaaaaaacaacaaacagcaaauaguuaaaauguaagccaguugguacuaccuguaaaaauaauaauuaaaauaauuauuauuuaaauaggggugauauuguggacuacaauaguuggagauauuuucauagaaaagauaggaaaugagcugggccuugaaagugggaagugguugguuaaacaugagaauggacugacauggguagagacauaggugagaaugaaucuuugaagggacugaaugaagaaauauaucuucacuagagugaagacugucuauugaagggaaauaaauaagguuaacaaggaagacgggauuggguuauggacaucuucccaaacuaaauacaggaauccagauucaguauuccuaugaccagugauucucauacuuuaauguacaucagagucuuagauugcugggccccauccucagaguuucugauucuguaggucugaggugggacugaaaauuuugcuuguguaacacggucucagguaauucagaugcugcuggucaggagaccacacuuagaaagaaccacugcuuaagacaauagugagagacccuucguuuuagaguggccaggugauaugaugaaagugguuuuaggacaugauguagaauaauggugggagacuuaacuugauucauaauuaggauggugauuuguggacuggaauacaaagggaaccuagaagggaggauuguaacauauuucagagaagauuuagguaauaaacuugaugauacguuaaaagugggaaaaaucaaaugugaacuguaguuuuuugccuguaagaaugaauguaaggaagugucaaagugagaagauuugaaccuguugauuuugaaauaauuugaugucuugaagguaguuagaaaaauguaauucaaaucuuggagggugggguagggaaacaucaguuuugaauggaaaaaugaucacuuuccccuaguuaaaaauauccugaaguggaauauuaaguccuuuagcuuugcauauggaaauaauuauuaacaccguuauaagaacuauugcaaaguagaaaauuugguuuuuggcuuuuacacuguagugugcauuuuacaauucaugagagaaaauguuaagacuuugaagucucaaaccuugaguuuaauuuuaaaugaaagaucuugugaguacaauauguuaugaacuauauagauaauuuauugagagaacuguauagaagcccauaacucuuuuuaucauuuguucauugacaauauuuauugaauccccauaugucaagcacagugcacauuacggauuuagggauguggugguuaguaaaacagguacgguuucugcuuuuacuaaaugugcagucuagugcauuacagacacaaaucaaguaauacaagucuguaauuaugaguuuauguaagagcuagaaagggaaagaaaccuggucuuauaagagccuauaacagagggaccuaauauagaauaaggaaucaggaaaugacccuucauuuccugagagcuuuuaaggaaaaaauuacuuaguuuuucuagucaaaucucaauacuuguaggauaaaguccaagucucuuagcuaguacugauagaauucauuauucauacaauaaguauuuuaagacauuccuggccgggcaugguggcucaugccuguaaucccagcacuuagagaggcugaggcaggcagaucacuugagcucaggaguucaagaggagcuggggcagcauggcgaaaccuugucucuacuaaaaauacaaaagcuagcugggcauggugaugugcaccuguagucccagcuagucaggaggcugagaugggaggauugcuugaguccuggaggacagaacugcagugagcugugauuacaccacugcauuccagccugggugacagaguugagacccugucucaaaaaaaaaaaaaaaaagacauuucuucuuuuacuguaaaaacuauauuuuaaauaguuuucacuauaauaguaauaccuuauaguagaauaaaaaauaaaaaucaccuguaaacuuaacaccaggaaauaacugcuguuaauuuuuugacauauuuccuuuuuuuuucuuuuuuugagacggagucucgcucugucgcccaggcuggagugcaguggcgcgaucucggcucacugcaagcucugccucccagguuuacgccauucuccugccucagccucccaaguagcugggacuacaggugcccgccaccacgcccggcuaauuuuuuguauuuuuaguaguggcgggguuucacuguguuagccaggauggucucgaucuccugaccucaugauccgcccgccucggccucccaaagugcugggauuacaggcaugagccaccacgcccggccgacauauuuccuucuaacguguguuaaaaacuuuuuuggaucaaauauuaauauuucuuuuucuuuuucuuuucuuuuuuauuuugagacagagucucacucuguugcccaggcuggggugcaguggugcagucuuggcucacugcaaccucugccaccuggguucaaccaauucuccugcaucagccuccugaguagcugggauuacaggugccugccaccgcgccuggcuaauuuuuguuguauuuucaguagagacgggguuucaccaucuuggacaaacuggucuugaacuccugaccucgugauccacccgccucagcucccaaagugcugggauuacacgcgugagccgcugugccuggccuuuguauauuuucuuuugauugacaugauuuuuauugggugcauauuaguccucugaguggauuaauuuacaaguauuuccugcaguugggcauuaagguaacuuccaguuuuuuuagcuucguaaauauaguauacauuucaugcaaauuuuugcuugccuguggauauauuaaauuuuuccucuuugguaaacauguaaacuuguuucuagagcacugauuuucaaaccuaguaauugucauuugacugaccucccccaugaauuaguguaugaauugauacugcauuuaauuuuaaagaggaauuaguaagaagccucagaugaaucauagauuuauuauuacuaucuuaaaacauaauuauuaguucauauuaguucauaaugucacugaaggaaaaaaucuguugccuuuccauacaguuugacuagaauuaacucuaguacucuagcaguacuuccagguguuuagagagcaauguugcuguuagauugcaucauacuuagcuuauauaagaagucaacuuagaguaagaauaauucuucugaaaaugucuuugacugagacuugacaguuuucauuuacugauguugagcauguugcuacucaaaauucaguucucuuuuuaauaggccuucuugaccauuggauuuaaagauuggugacuaguuuuaagaccugucacuuauacuuaaaguugacauauuuacuugcaauuucuugucagcuguccauuaaaacuuguuuuaguuucaugaaccaaguuaccaaauaauauuuucuuuuuuuguugggggcuggggggguaaaucggaauuccuaauauauuuaaaggaaaaguuuauuuaaauaggucaguuauuguggguaggagagagaugauugguuucauaauuuuauuuauuuauuuauuuuugagauggaaucucacucugucgcccaggcuggcgugcaguggcgcgauguccgcucacugcaacguccgcuucuaugugauuuuugugccucagccuccugcguagcugggauuacagaugugugccaccacaccgggcuaauuuuuuuuguauuugugcugggcuggucuugaacucccaaccucaggguuaggaauucaaagggcuggaauuacaggcaugagccacugcacccagcccauaauuaucuuuaauaguaucauuuuagucugucaguuuuuauuugugccccaaauuuguuuuauucguuuuauuagagauucaucaauucuuaauuuacauuuuauagaaggcagaaugcuuuuguuggguaagcaauagauauaaaugaaucaaaaccuaagaauucuugaaugaaagaagauuauuucucuuaccccauauccauaaauuaagcuagcaauacuaaauguacugaguccucucuggucaaauuguuaaaauauaaaaaauaccuuuuuaaagaaauuacauaauaauaggaaaaaaggugugcuguuguauuuagaagcuuucucccuacuuccuagguuuauuuccaaaguugaagaagucuugaaugacuggaaacugauuggaaacucuuugggaaagccacucgaaaaggucagaucuauuugcuggugucucuaaaugacuauuuacuuugaaaccucuauuuuccagcccuuugcugcauuuggcacauuugaauuaaauguuuuuuaaaguuacguauaaucuauaaacaucaaauagcauuuggaagaauuuggauuuaaaucuguggcaaaugauauauguaagacauuugugaaauguuuaauaaaguuauauauauguguguguguauauauauauauauaaaaugucauucuuugugagugauucuuugugagugaaguuugcuucucuuuugccuucucccuuggaauguuaaaacauguuuuuaaaaguuuuuuauuuggucagagaaacauugcagugaccaucuucuuugguagcauauuuugcuuacuaaugaggaaaauucuaguacuuaccauugacuuacuguaguuaacaacuauuucacucaguuuuuguauuuuauaauaucacuaauaacaucccccuucccuuuuaagcuuuuuaacuuauggauguuuuaaggauuuuauuuaagaaugaaaaaauuacucuuugaaauugagguagaaaucaaauucuaaucuaaaguauugguaguuuuauucauaaaccacaccccaaauguuuacugaagaauguacucugagaacaaaccuggauucacugugaagggaucuaacaauuugauuuuaaguuuauguagaugcuuaguuuguuagauaaauucuuuugaaauaaaauuuaugguugguuuuauuacaacucaauauuacuaacucagugauaacuuauuaacucaguaauuauuaauucaauaguaauuuaauuauaauuuacccuguguuaggaacuuugaguucucaauauuugcuagggguuuucagcuuugugauggugauacuaucaaaaaagagacugucaaaaugcauuaggaagccaggcaacauggugagacccugucucuuaaggaaaaaaaaucuccuuauuuguaucaauaugaacagaaaaaguaagaccacauauaaaaaauacaucauucaaagacucuuggcaauauauacauugauuuacuacacuacaugugugaauaaagaaaaugugacgcuuucaaacacgggucauucuacuccacuugaaacaaauacauaacaauugauauagaugccaauaagauuagaggcaaaauaagcuggauauagcuagaauaggaaaugauuuacacuacuaagaagagagcuaaaccggguacuuaugagcucugauauucuuucauucuuugauuuacauguauuuacugaguaccugcuaugugccugaugugaagaaauugugaacaagauaagaucaguguugccauugaacauaaauucuagugagggugaucaguaaagaaacauuaaaauuuuauuuuauuauuauuuuuuaaauugauauaugauagauguacauauuuugggguacaugugauaauuugauacaugcauauaaucaaaucaggguacuugggaacccuuaaauauuuaucuuuaugcuaagaacaugcaaguuacucucuuuuagcuauuuugaaauguacagucaauuaguguuaacuaaagucacucuaaggguuaaaguuuuagaugcuaaauucaguuuugggauuuaaguggguaguuauuuaaaguagguagcauacugccaggcauguaguagaggcuaaugaagucauagcuccagucuguuucucccuacuagauaguaguacauaaauaagauacagaaaauaugggcagauuucaaggugagcuguaacuaugaugaauaugaagaaaguguagaggacagggauuguuugguguagaaaacaaaguuuagagacuuccuuugaagauuuuaacuuauaugaaggacagugauuauuaauuuucuccuccacugagggggaauuaagggaaauuauuuauuaaaaaccuuuaauuauggaaaauuucaaacauauaugaaguaaacagaauaguauaaugaacucccauguacccaucacuuaaugucaacaauuaauacuuugccauuucuuguuugagugguaccucuguuuacuccccuaccuccacuagauuuuuuuaauaguuuuuuuuuggguaagauuuauauacauuguaauggacaaaacuuaacugcuugauuuuuuuuuuuuuuuuuuuuugagaccgagucucgcucuguugcccaggcugaagugcagugacaugaucucagcucaccgcaaccuccaccucccggguucaagagauucuccugccucagccucccaaguggcugcgacuacaggcacccgccaccacaccuggcuaauuuuuuguauuuuuuaguagagacgggguuucacuguguuagccaggauggucucgaucuccugaccuugugaucugcccgccucggccucccaaagugcugggauuacaggugugagccaccgcgccuggccaacugcuugauuuugacaaauguucacauggguauaacuuacacuccugucaagauagaggucaucucuguuaccccaggaagauccuuagugacccuuucuaguuaauucccaugcccuccagucaucugcuauuauuauuauuguuauuauuauuauuauuugagacagagucuugcucuguugcccaggcuggagugcauuggugugaucuuggcucauugcaaccucugccucccggguucaagcaagucauaugccuuagccucccaagaagcugagacgacaggcauaugccaccuugccuggcuauuuuuguguuucuaguauuuuguauuuucaccacguuggccaggcuggucuccaauuccuggccuaaagcaaucugcuugccugggccucccaaagugcugggauuacaagugugaaccacugggcccagccuuuuuuuuuuuuuuuuuuuaaauaaacauaaauuacugucaccugcuuuagaacuuuacauuuaggugaccauaaauguccuugacauccuuuacucacgauaauguuuuugagauucaucuagguuguuguacauaccagaauuucauuucucuuuauugcuguguaguaagugaucuguuuuaugaauauacaugguuucuuucacuuguccacauacguacuauuaggaauaaagcagaacauuauuguaugaggccuuuugugggcauauguuuuuauuucucuugaguaaauaccuaggauuggaaucacuggguaauaggauaggugcaacuuuauaagaaacagcuagagcuuuuuguacuguuuuaccugcccaccaucaauacaugggagguuguguugcuauacauucucaccaacaaucaguuguuugcagucauguauauuuuagucaucuuaauggguauguaguuugugcuuuuaauuuauauuucucauuuugguuuuagucuguauuucugugaugauauuaauauugaccacuuugaauuuucaugcauuuauuagccauuuguuuaucuuccuuugugaaaugucuuuucaaguucuuuauccauuuuaaaaauuggauuuuguuuuuauugaguuguaggaguucuuuuaguuuuuuuuugguauauauauauucugcuuuuaagucuuuucucaguaguuuugcuagguugugaagauguuuuuaaugcauuuuucuagaggguuuaccaauuuaucauuuaaccuuuguuaaggucuaugauuuauuuugagcuacuauauggagggaaguagggaucaaguuucuucuuccuuuuuuuuguguauggauauccuguuguucuagaaccuacuuuggaaaacacuuuuuccauugaguugcuuugucaccuuuauugaguaguugaccuaaguggucuacuucuggagucuguauucuguuucauuagucuauuugacuauccuuaugucaauaccauauugucuuuuucuuuuuuuuuugagacagagucucacucugucacccaggcuggagugcuugaucuuggcucacugcagccuccugccaccauguuggccaggcuggucuugaacucuugaccucagcugauccgcccgccucggcuucccaaagugcugggauuacgggcaugaggcacugcgcccgucguauauugucuugauuacuguaguuucagguuuccuaaccuuggcacuauugacauuuugggccacauuguugugaggcugucuuaugcauugucaaauauuuaauaguaucuuugguuucuaccugccagaugccaguaacauguuuccaguugugacaaccaaaauuguauccagauauugccaaaugcccgcugaggggcaaaauuggccccagcugagaaccauugaauggauuuuuaguaaauccugauguuaauguaaauucuccauuuuuguuguuuucccaagauuuuagaucuuuuguguuucaauuaugaauuuuagaauaggcuugcuaauuacuauaaaaaggaguaugauuaugcugagacuguaauugggguuggguugaauuuguagaucacuuuggagacauuuuaacaguuuugaaaguucuagucaugaacauggcacaucucuccauuuauuuaggucaucuuuaauuuuccucagcaacauuuuguaguuuugguagaggucuuguauauccuuuguuaaauuuauuacuaaggauuuuauguuguaugaugcaaaaauaaauggaauuguuuuuuaguuuuguuuuccaguuguucacugcuaguacauagauacaugguaaaauuuuguauguuaacuuugugucauaacgccuggcuaaacgcacuuauuaaucgugaucauuuaauuguucugcauuuuucuacauuaauaauuauguugcacacaaauagggacaguuuuacuuucuuuccaauuuuuauaccuuuaugacuguuauuguacuaucccagaccuucagugacauguugaguagaacugcugcaaguagacauccuugcccucuuuaaaugugaaguggggggaaauguucaaugcuucaaaacuuaaguuaacuguagguuuuuuaauagguguccauaagacugaguaaauuauuuuuuuaguuugcugaacguuuuuuguuuuuauuguaaaugaguagucaaguuaguaaaaucuuauuuagcaucuauugagauaaucauauaguuuuucuuuuuuauuuucugaauaugguaaauuauguugauuaaaaauuuuuuuguuguaaaauguaagauuuaccauuuuaacgauuuuuaaguguaaaauuuaguggcauuuaguacuuucacauuauugugcaaucauuacuaccauccacauccagaacuuuuuucaucagcucaaacugaaacuacccauuaaacaagaacucuuuccccacccucaguccccugguaaccacucuucuacuuucuguccaugaauuugaccauccuagguaccugauauaaauggaaucauacaguauuuguuuuuuugugugugugucuggcuuauuucacauagcauaaugucuucaagguucauccaggguuauagcacaugucagaauuuucuucguuuuuaaugcugaauauuaauauuguauguauauaucacauuuuguuuaucuguucaucuguugauggacacuugggucgcuucuaccuuuuagcuauuauaaauaaugcugcuaugaacgugaauguacaaauaucugucagguuccugcuuucaguucuuuuagguuuauacccagaaguggaauugcugaauuauuugauggugcuauuuuuaacuuucuggggaacugccauacuuuuggcuggcuacaaauuuuguuuuuguuuuccugaaagauuuugccguauuuuugaaggauaguuuugcugaagagugcuggcuugaugcuuauuuuuuuccacuucuauaaagauguaguuccauugucuucuguucucuggaguuucuaaggagaagguagauauauucauauuuuuguuugacuuuguuguuuuucucuggcugcuuuugagauuuuuuuauuuaaaaaaauuuuauuucagccaucugacuaugaugugcacagauacguuuucuuuguauuuuugcugcauaggguuuauauugauauuggauaaauuuuuguuuuucaccacauuugggguguguuaggucauuauaucuucaaaauuuuuuugccccauucucuacucuuuuucugugacuuaagcuauacuuaacauuugacuuguugauccugacccacaggugggucucugagguucugcugucagucuuuuuucucucuguuccuuagguugaauaauuuuucuugauuucgaguucauuuuuucuuucuucuuuuguuuccaacuugcuguuaagccuaccugcuguauuuuucaauucaguuauuguacuuuuuagguuuagaauuuucauuugauucuuaugaaaaacuuccaauucucugagauuacuuaucucuaaguuuguuugaaacuugaguguauuuauuauagcuuuaguccuugaguguauuuauuauagcuagucuaaugccaguugcaugacuaggucuuuuugggguugguuucuguugauuauguuuuuuuuuuugaguauagaucacauuuuccuguuucguuuuguuuuuuuccugagguguuuuguuuuuuuuuuuuuuugauauguguauccaguaauuuuaaaguuucaugcuuacauuaugaaauguagagacgaaauguagucuacauuuuauuuauaauguaagcauaaauuuucauucauaaaauuuauaacauuuauguuguguuccucugaagaguauuuuuuuuuuuuuugguuguagagagugguuugcuuggcuagauuaaaacugcauucucuuuucagugauggcagcagcugaaaucuuuucuuuccagcuuuuucuuugucaucguacccuagaaucuccucugcacaugcaugguuuagcagauagccaagguuugggacaguuuauauauaaauuugggggacuuacccccuuuuggcuucuucccuuccagaauuuacaccucaauguuagaacuguccugucacccucaaacuuuguccggugucaccuaaauucaguaaagcuauaucuuucugcuucccgaguuguacacagauuagagcccccuuagaucagcaauucucagugugugaucugaggaccguugucugucucugagaacuuugcaaggggugaucagggucccugccuuuuccaguuagguacguguguacuugaggccaaauuuucuucauauacuucaacuagaacaauggauugcagugauucauugcagaagcagauaugagaauauaguuaacuuuuuaaaagcuauacauuaaacagauuugcaaaaagguagaacaggguuacucuucucauuaauauuuuuguuccagaaaaugucauuagaacuuauauguuaaaauauaaaaaguucaucauuauuuguaaugaauuaauaaauuacaauuuuuuccuuuucaauuuuuuuguguuuucaugucagaugguaauguaccaauguugugacaauguuugagggaggcauaucucauauguaugcgugaaaacuuaaacgucacgcuuucgaacuaugaaaggaucucuuaaaauuucuaauacgggaucuucacuaauuuuuuuuuuuuuuuuuuuuuugagacggagucucacucugucaccaggcuggagugcaguugcgcgaucucggcucacugcaaccuuugccucccagguucgagugauucuccugccucagccuccucaguagcugggacuacaggugugcgccaccaugcccagcuaauuuuuuuuuguauuuuuaguagagaugagguuucaccauguuggccagaauggucucaaucucuugaccuugugaucugccugccucagucucccaaagugcugggauuacaggcgugagcuacugcaccccgccaguaauuuuuaagaguguaagggugucugaguccagaaaguuugagaauugcucuuagacaaaaagguauaaacaagugccuguugucagauacacuuucuuuuucucaauggguaaacucuucccagcuucugccugcauuuggucucucuccagagcauugaaaaaugguguuuuuguccagauuuuauaggaaaguuuaucugacaaagcugcuuugccauuaccagaacccaaagugcugggaaaugauuuuaaaagggaaggaaauggcaauuauugagcaccagcuaugguauugguaucaugcacuauaguugggacugugucuguuaacuuaauccuuaaacagacuucaacaguuaguuauaacccuauuuuauggaggagaaauaaggcuuugaguucaugugguacuguaauuuucccagugucauuuugccaguaguuuugguauaagcgggauuaaaccuaggucuugccuucagaacccauguucuuucuauuuuacucuguccuuuuugguuucagaaauuuaaguguguguaaaauuacuuccagugaguauuaacauagguuucuaaggcagauuuugggauucuguugucuggggcuuuauaaaauagauaaaaaucuuggugguaugaguaugauccuugaaggcaagggaaguaaagaaaugaccuuuuaaguuccuuuuagccuuguaauuuuaugauucuauuuagcuagcaaaaauuuuaaguacuuuuaaugaaauguuaaguuuagguaugucaugauccaguaauauaacuguuuagucagugacugacucguaucucccugaaaaauucauggaagaagaauuagcuugagaguauuaauagaauaauaaugacuacaaugauguugaaaugaguucacauuuuucauacccacucaguagaugggaaugacacuucaguacuuaaaguucauauggcaaauuuaaaaugaauuugaauuauaaauuuucucaauuagaaacuucccaaacuaaguuauaacaauaagucaaauuugggacuuauauaaacuuuauauaaacaguuuagauuccuuuauuugcauuaucucagaacauuuaguuuuuuuauggaguauuaaaguggaggaguauauguuuuaucaaagcugaaguuuuuggaaacuaaagaagguugaggaucagucacugaugggaaugcaguguuuuugaaauucaguaaauaaaaacagaagcaacauugagcuacucacaaccuuguuuggaaugggacauguaagauaagguuuguaguuuguuuuuuuuccucuucauuuuuauuuuuccuuuaaaucguaaccauagugucuauagcuucuuuggauauuauguagaagaaaaaaaauagguguuuuguuauaucucugauucauucaaauuggaaguuuugggaaucuugcuguuauuguugucaacauuuuuauuguaauauaaaaauggcaggagauaucuuuaagaggcagaauagcacacauaggugaugaagaguaugcacuucaaagugguacagcuuguguuggaauccuaguucuguugcuuauuugcuuuguggcauugugcugucucaguuacuguuagucauuauuuauuguuuuugccuuucugucuuaauugcuguuauuauuuuugagagagggucuugcuguuacccacgcuagagugcgguggcaccaucuuggcucacuggauggagccucaaccuccugggcucagguuauccuuccaccucagccuccugaguagcugggacuacagguacaugccaccaugcccagcuaauugguuaaauaauuuuuuuuucuguagaaauaaggucucacuauguugcccaggcuagucuugaauuccuggguucaagugauucucccgccucagccucccaaaaugcuaggauuacaggugugauccacugagccuggccucucuuacaaguauuuacuagagucaguaaaaugauacuugcuuaaguagaguagaauauaaacauagaauuauuuaacacucuauugcaauaaaaacgauuguuucuuagagcaccuaucaguuaaaagcauagcaccuagcugggggaaagcuuuauguaauauauucuggcugaaaaagcucaaguuuaauucugagauagauaagaauuaaguaucuuuuuagacauuuuuaguucuauuauuuccuaauucuuuuauauauuuuuaaugauuugcuugccauuuaguuacagcacaauaacuaaauuugugauaagugaaauuuucaauaugcauuaugaauuucacuuugaacuuaaauuugguuuaagguauaugccacuaaaggaaguagacuauaaaaauuuuucuuaaaaaaaaaaaaagaggcugggcgccguggcucacgccuguaaucccaucacuuugggaggcugaggugggcagaucaccugaguucaggaggucaagaccagccuggccaacauggugaaacccugucucuacuaaaaauacaaaaauuagccaggugugguggcaggcaccuguaaucccaacuacuugggagacugaggcaggagaaucauuugaaccggggaggcagagguugcagugagcugagaucacgccacuguacuccugccucggugacagagugagacuccaucucaaaaaacaaaacaaaacaaaacaauccaugcuuauuuuagacacuguuugauguaaugaaauuucucuguaauucuaaacaacaaacaucaaucugcuaugagaguuuuucauaaauuaauacucauuuucauuacacgacgugcuaacuuaaauuuuaccacuuggcuggguagggaucacauuuuguuauaaugaaugcaacaaaaaagauuuuucacaaaaaauaaguuaacaaagccauaaucauuuacgggagauuuuggcaguuacaucucuauugcugugacucuuaaccuuuuuuauggucuggcauacagaggguguaauuugguaucauuaguaauaacaguuaauuugauaauucauuuauuacauacacaacacauugccugguauaugcuuaguacauguuuguugauugacuccccagaauacacgauuaaccccuugaacuugucauguucccuuuguauaagauaugcaguguaaacagaccacauuuacuuaccugggaauuuuguuaaaauauggugaugguggcauuuuuaaaagcauuauacagaagauggaaagucuucuggauggucuuguaccuuuuaaaauaacuguaguuuaauuuuucugcauuuaguuuuauaauuaaccauuuucuguacuuuuuuuucuuuauuuagucauuuuucccuuuagguuuuugauuuagugauuugauuuuuccuucuaaugaauuucauauaaauuggcaaguuuuauggaugagucauuuucuaaaacuuuguaaaaaugguuguugagaauuucaauugcauuuuuccauagaacagauguguuuaagauauguuuacaggguagcaaauaaaauauuaauuuuuucucucuacuuuuggggccaugucauaaaagauucuucaucaucucaacuacuucuuuuuguucguuuuauucauuuuuuucauuuauuuauuuguagagagccuacugugcaguaggaauuaucccccucacuuccuguuuauuaaaacaaccuucuaccccugcccucccucaccuccagauuauuaaacccuuuucccuuuacuccacagucauuuuaucucagcugucauacuuucugugccucccuccaggaaaggaaaaaaaauuuuuaucugaggaaugggagcuucuuuaaauuauccaucagaaagagucauuuaaaauguaacagcagucucaccucuccugagcuaaauaauuaccuugaagccacuugccauguggguuguuaaaugaugccaauggccauaaaaugccauacgauggguauuauaauucauacccuguaguucaacaauguauagccaaucacuaaucaguguuaucucuguaaaccaaugagaauuccugucaaacaacuugguaucagcucacuccuuguuuccuuuaaaaaccuguuuguaacagaggcagacagacagacagaacaccccccaaggcaacuuggaaaugugucccgggcugcaguccucaacuuuggcccaaauaaaaucccucuguuauuuugccucagcuucuucuuuuaggucaacauguguaacuaaugacuuggagcuguucaggcaguuagaguucaaccaguuuaaaagccacauagcucaucguggauagaaggacuuuaccaugguauauaauggguguucuuucugucuuuaguuuuuuaaguagagauagggucuugcaguguuguccagacuggucucaaauuccuggccuauaaaaggaauuauuauuuuuauuuauuuauuuauuuugucagccagcuggagugcaguggcgcaaucucggcucacugcaaccucugccucccagguucaagcaguucucuugccucagucucccgagugucuaggauuacaggugcccaccaucacgcccguccaauuuuguguuuuuaguagagaugggguuucuccauguuggucaggcuggucucgaacucaugaccucgugauccgcccaaagugcuaggauuacaagcgugagccaccacgcccggccuguaaagggaauucuuaauccagagucuugggucucuuuaaauuguaugcauucuuaauuuugaaugugaauaugcacaauuuucuugggaggugguccauagcuuuugucagauacucaaaggagcccaugaccccaaaaagguuaaauaaaagcuaacguuuaaaaauauuuugguauauauucauuauuuuaaaaauuaauguauuucauguugacagaauuuauauauacaaaggcuuacuugaacauguacuuuugggacagcuuguaugauagagacuacagguuuguguggaagccacaguuuaugcacauacaggacugguaguuuuuaaguuggugaaauuuguccuugauacccuucuaccaucuuacccuuuuucauaauccuaguauccuggccuugaggcccagagccucauuuuacuggcccuuaaaugcuccaaaauuacccacuuuuuuccuuuguuuccagucucuaccccccuaacuucauccccuguccaaaauauuaugcuaauccuaaucaguggaaagcaguuuuauuaauuuauuuaaaauauuugaauggaugguaauuacuugauguuacaaaaauaguuugguuucauauuuuacuaaaauagucacagaaacuucuuuuaggcuccuaucuuugaauuccuuucuguuguggguacgacuggcuggggcugguguugcagguaguaaaauaauuuaccaagacagucguagguuaaaaaaaaaaaaaagaauuauuagagaaaguaugaagauacaaagauauguugcaagggugcaagugcagcacaacagaaaaggggcugucugcaaagaggaaggagcuggaggggccuaaaugcaggaugagguuauguuccuggggcuacaugcuccccuuccauguuguuguuuaccuaucaggucuccacauuccccccacagcagaacaaugaugacaagucuuugacauugaggguagaggucucaucucccaaccacuuccugcuaaccauggguauggcaauggcccugccaauggcuguuggucugucaggagacucuguaggucauuguccuggauugugggacuuagaauauuguauugaaucuuucuuucuuucuuucuuucuuuuugaaaugagucucgcuuugucgcccaggcuggaaucuaguagugugaucuuggcccauugcaaccuccaucuccaggguucaagcaguucucgugccucagcuucccaaguagcugcgaccacaggugugcaccaccaugccuggcuacuuuguuguauuaguagagacgagguuucacuguguugaccaggcuggucucaaacuccugaccucaagugauccuccuaccucagccucccaaagugcugggauuauaggcaugagccacagugcccagccauauauuggaucuuguuggaggaagggacuuaucggagagggggagcauguuaagacauaacuagcauucaacugaauccagggaagauucauaaaaguagcaggcaucauuggggagagacuuauaucccguuugcaguaucauuuguaggugaaacuguagaauucuagaagauaaaguuuuguuucuuaagccaguuaucaaaaaggcaaaaaaccuuuugcagugugacuuuuuguccuuauuggaagcccauuuggguaaccuggaaguuaaacuugaugaaaaaguguuugaauuuaguuagacacaacauagggaaccaauuuuagagagacuauuaugcuuuaauuacauacaauauucuuuuuauaaauuuccugucaugauuuucucaugacuuacguagaccaucuauuauaugcuuggacuuuuugacuuguccugaacaucccuuauuuuuaaacaaugaguuauuuuacuuuaggacaagaaauuaccauacaagauccuuucucauauaaaguaucuuuuuuauaaccuuccuuaccaaaaauaccucuuuaccauuauaaccuuuaauuaggcagaaauuauuuuucuucuguuaguaaguuaugguuuguauuacauguugcugugugagccugugaaggggagcagauagggaaguugucuacauacuguagaaguuaucccccuucaagagauugcccaguuagauuuccugcuagggucugucugaauaagugugggcuauuuuuaagcccagggguaggacuauguagguugaaguuacugguuaaagauuuagguagcuuucccgggagaaauagggcuauuagagggaaagaugaauucagagguugggcacauauuaagcagacacccaucuuggaaaguauauuuuugccccaaagggguguggaauauuuagacauugccgaggacuggugagagaaugguaauuggucccuuaaguaauauaaagcagugugauuuuuuucuuuuggacagagagagggagugcauuugcccccauuacccagcaggauuuggaagaguguugcucagggaaggagauuaguacagaguaggcagcucuugaacccaaaagggaaauuuauaauuucauuugcauccucagaguugcccuugccuuuguuuuguugaugccaaugucugauuuggaagccagguagagcagagagaccccucagcucaaggccaucagugguugggauuauccugggggcccuuuggccuuuaggcagucccauuuuuaauggcugagcaugugacagaggggcaagcuguacaggguucuuucccauguaucucauuggggcaguuugccuucuaguggccuggccuucugcaccaguggcaguuaccuggaggaggcugggggcuuauaaaagcagccagcacuugagccugacuuguguuccuguguuuuucuuucucuuuagcccuguccuccucauucuacucucaguuauaaaagacugaggagguuaauuugaggauuucuugcauagcagccaugcuaaaagaaaauuagacauuucuuuuugagagucugaggguuaaauuuaucccagugcuuuaaaaugcaacccaggggugagucugagggaauugaggggcuucaucccaugaugggaccguaaaaaacgucuguuggggacgcaaacugcaguuucucccagggcaucccaccaagggaugagggauccacucacaucugcugagggacuucucgaugcacuuuccaaaggggcauuccaccuauuggaaaggaucuccuggcacuagggccuuacacuggaugaacacuaggugaaagaccccagguuagucuagguacgaauugugcugggugcucaauccagguaggaggggaaagggaugagggaagacucacugucugggugcuguuugggauuaccugguuuaagaugucuggagcaggaggguuggcugccuuacgugggagaauuuagagugagaaagaggggggucugacuuccccaaaauguguauagguuugcccuggucaagcuucugccugccaguuaugccaaacguagggauuggggacuuuccaacagaaaggacaggagagagccuuccucccuucugggcaagguggccaaaccuguucagucccuagccuucaggcuauaccagggaguggcccuggccaguugucauucauugccagaggaauauuagaguuugucugccagaagacugaaaaggaaagcaaacuuugaacucuuacccgauuggguggcgggucagacaucuuuuuacuggcccuggccaggaaccuucaguugucucugggcuuggacacuguccaccaagagguuggaguuggaggagagggaagggagacaguaagagaaagguccccaagcaguccccaagcacuccccagaugggccaccaaaauguugcaggugccacugguuggggccagugucaugggcaguaaaggauuuaccaagacaguuguagguaaagacaggcagauuuagagaaaguacguagauguauuuagaggaaguacguauuagaaaaagcacgaagauacgauacuggcagcacagcagagaaggggcugucuacuaagaggcaggagcuggagggaaguuuuauagggucaugccaaaggggccauguauggacgagauauuugggaacagaauguugugccagcagguuguuugugauuaguugucucuuggaacaguuguucucccccaccugggaccccuuccuuguugcuuacuaaucaggacuccacacuuugcaucauuuaguccucaaguuuuuaacguuuaaaaaaaaaugcuucuggaauuucaguaaaauguaagaaaaguuaaguaaacacuuuaaaauuauauggggaaauauuuuggggcaagguaucugucuaagggccuagaaggcuguccuguggagccaguccccacuguuucccuuguucuuucuuuucuacuuuuugaguaacaaauucuuucauuaaaaaauuuuagagaccuuuaauuacaaaaauaauguaaccacaccaaaugaugcauauguauaaaaaagugauagucccuuccucaucacuucuccauucaucuacuuuucagaacaacuuuuaacaguuccaugugugcacauuauaccuugaaaaaaagaugaguaacuuuuuauuacaguuaucuuuuuuuaaaaacuguaucuuggcauguuugcaagauagaacauaaacaucuauuguuacuuuaauucuugcuuuguagucuguuguaugauuaucauaauguguuuauacauguuccuauugaagaauauuuacuuuccaguuuuugcaguuaagguacuguggugguaagcauuguucuacauacucuugcauguuugccuuuuuuuuuuuaaauuuuuuuuuauauuugccuuuuuuuggggggggucacuauuuccuucauauggggguuuuccucaaauaucugacgaucucuaucuacucauuugagagugaggaacuaaaauucgugggagucauaggaucaaaaacuuuuuuauuucauuguguggucacagagugucagucucuguaggcauuuucauuugagcccaccaaucuccuugugaauagucuugcauauuuguaugaauauuucuguaacagauuucuuuuuuuuuuuuuuuuuuugagacggggucucacucugucgccaggcuguagugcaguggugcaaucucagcucacugcagccuucgccuccugcguugaagugauucuccugccucagccuccugaguagcugggauuacaggcgugugccaccacucccagcuaauuuuuuguauuuuuaguagagacaggguuucacaauguuagcuaggaugucucgaugaucugaccugcugaucacccgccucagccuccgaaagugcugggauuacaggcgugagccaccgugcccggccuucuguaacagauuucuaaaaguggaauuacucggucaaagaggacaugauucuuauuuuugauaaauacagccauguuuucugccaaaauaguugacugcauuuauacuuuuuccacauaugguauaugaaagcacccauauccucacucuguccacacuguuuauuuucauuauauuuuuucuaauauaacagacuaaaacuaucucauuuuuauuuauauuuuccugagcacucaugagauugagcauucauuaguguucauuagauauuagaauuuccuuuuugauggcauguuagauaugcugaccaauuuucuacugucucauuggauugcacaagggcuuuuauauuuuuaugaauguugacucuggguugcagauauuuucccucaucugucauuuuucuuugaaugucuuaugcuucacaagaguuuauauauauuuuuacuguggcaaaguacaucauauaaaauuuaccauuuuuaaauguauaguucaguggcauuaaauauauucacauuguugugcaaucauuaccaucauccauaucuagaacuuuuuuaucaucccaaagucuacccguuaaacaauaacaacuucacauaaguggcaucauacaguauuuguccuuuugugucugacauguuucacuuaacaugaaacaugaaguaauaucuucaagguucauucauguuguaacgugucagaauuucauuccuuuugaaggcugaauaauauuccauuauauguauauaccacauuuuaaaauccauuccuuggccaagcacaguggcucaugccuguaaucccagcacuuugggaugccaaggcggguggaucaccugaguucaggaguuugacaccagccuggccaacaugaugaaaccacaucucuacuaaaaauacaaaaauuagccaggcaugguggcucacgccugugguccuagcuacucgggaggcugagacaggagaauugcuugaaccugggagguggagguugcagugagaugagaucgagccacuccacuccagccugggcgacagagcaagacuccaucucaacaacaacaacaacaacaacaacaacaaauccauucauucaucugucaucuguugcuucuauagacuauugcgaauaaugcuacugugaacauguguuuuacaaguuucuguucuacuugcuuucaguuccuuuguguaggcugggcaugguggcucaugccuguaaucccagcauuuugggaggcccaggcaggaagauuacuugaggccaggaguuugagaccagccugggcaacauagcgagacccuaucucuaccaaaaaaauccccaagaaacugcuggugucaccucuuuuggguauacaaucagaaguggaauuguuggguccuauaguaacucuucaauuuuuugaggaaccaucacguuuuccacaguggcuguagcaguuuacauucucaccagcaaugcucaagggcuccaguuucuacacuguuauuuccugguguuucuuucuuucuaaaaaaauaaugaucauucuaaugaguaugaagugguugugguuuugauuugcauuucuccaauaauuagugauguugagcaucuuuuccuguucuuauugccuauuugucuauguucuuuggagaaauguuuauugaaguccuuugccuauuuuuacaauuggguuauuucuuuuguugucgaguuguaagacuucuuuauauauuguauauuaaucccuuaugugauauaugacuuacaaauauuuucucccauucauggguugccuuuucacucuguugauaguguacuugaugcacaaaaguuuuuaauuuugaugaaauucauuuuauuuuuucuuuuguugccugugcuuuugguguccuguccaagaaauaauugcaaauucagauguuaugaaggauuuccccuguuuacuucuaagagauuuauaguuuuuagcucuuauguuuagaccuuugauccauuuugauuuuuauauguaauguaacaagaguuuauauuuuuaaguagugagguucuuuaugacuucuagauuucauacuguauguagaaagggucucuugaccuuacuaugauaaauuuauaauucucuauuuuuuaguacuucuaaagaaggauuuuuucuuuuaacaguuagauauucuacuuagaauuaauuuuugugagugaagugaaacuuuuuguuuuuuguuuugcuauuggauagccagcuuuuccaaacugucccauugaauauguucccuuuauuauguacugaguucccauauguauuuggaucuguuucugaauucugaauaauguuuauuccuauauacauaucauuuuauuuuaauuacuauaaauuuguuauacauucugguaggacaaauauccccccauuauuuccuucuucaaucacugggcuauauuaguccccuccccuccccuccccuccccuccccuccccuccccuccccugcccuccccuccccucuccuuuccuuuccuuuugacagaguguugcuguguugcccagguuggagugcaaccucaaccuccuggaaucaagugauccucugccucagccucuggaguagcugggaccacgggcaugugccaacacaccucacuaauuuuuuuauuuuuuguagaaaugugguuucucuuuuuuugagacggagucucgcucugucgcccaggcuggagugcaguggcacgaucuuggcucacugcaaccucugcuucccagguucaagcaauucuccugccucagacuccugaguagcugggauuacaggcacacgccaccaugcccggcuaauuuuuucuuuauuuuuaguagacacagaguugcacccuguuggccaggauggucuugaucucuugaccuuaugaucugccugccucagccucccacagugcugggauuacaggcgugagccacugcgcccagccagaaaugugguuucaccauguuguccaggauggucuugaacuccugggcuccagugauccucccaucuuggccucccaaagugcugcaauuacaggacuaagccaccacaccuggccccuauacuacuuucugauugucuuuauuccuuacuucuccaugcuuuccccuuccuuaccuucucuuucucauuuguuuuucuccuucuaguguguucagaugaauucuccugaacuaaugcugucauuauauuaugagacuucacagaagccuucaauggcuuuccauugccuacaggguagucugaacuaggacugauauucauaggcuuccauggucaggucucuaauuucuccaccuuuuuucucuacuccccuauagggaacuuuagcugaguuggguuguuuccugaauuugcuguucaauuuccugccccaaauccucgucuguucuuucuuaucaguuuuaccuuaccuaaaagcuaacagggauccaauuuucuucaugaaucuacugauggccuacuuaucuggcauuuaaucaugucuuuaauuauguccuuagucauguccacuuacccuacugguaaaugagaugguaaaucauuuuaccacuuaauaguuugguaaccugggacagguuuuucagucucuuaacuuuucucaucuauaaaaugagguuggcugggcgcgguggcucacgccuguaaucccagcacuuugggaggccgaggcgggcggaucacgaggucaggagaucgagaccacggugaaacccugucucuacuaaaaauacaaaaaauuagccgggcgcaguggcgggcgccuguagucccagcuacucgggaggcugaggcaggagaauggcgugaacccggaaggcggagcuugcagugagcggagaucgcaccacagcacucccgccugggcgacagaacgagacuccgucucaaaaaaaaaaaaaaaaaaaaaaugagguuaauacuuaaccucauguaaguuuaauuuuguaugcacagggguacacacacaugaauuaucuggcuuaguagguacuuagcagaugugagugaguuccuuucuugaagagcaggaaauuaauucauacagucugcuuuuacuuuaaaaaauacuuauaaugaacuucaaguauaugcaauuggaguaauucaaauccuugcuggauauacauaaaugugauacauacuuaugagcagaugagaagaucauauauacagaggagaaggucagaucaggaaauaaaacacacaggcuuaaaaugaagccaggcuggcucagaaaggaguauagauuuugacugcuaagguaggcccaagugccuauuagaucugagugcccgagaugaugcuaaaugguacuuguuuccuuuaaagaaggcuuauuuguguuaaccaauguaccuuaugccuacgugaaucaguaccuggcuaauucuuuucccugaggauuucuuauauuugaucugguuuuucacuuaacaguuggcuguguccccuuugcucaggaucucuuccuaugacaguucuuagguaguugaauguucucugguugaauugugguucuuggugacugaagaaggacuaucucaaguuccccuuuguuucugaauuuccccuguggaaugaaagucaaaaguugcguacaaaagagcuuuuggacugagccucgauaucauuccuuucuguacuuuugugcuuuuagugggaugaucuugauccaggcugaaggccagccaggccaccuguauagaguggaauguaucuagaugacugcguuguuuuuguucaaugauuagaaacuauuuauuaaucccaaauugucaugaucaaaauaucuauauccaugucugcauaauacauauacugagcuggaaauuuugccaugaagcaaacguucauuaguguuaagaccauauuacguauuauauccaugucacagcagagaagaauuccuuaaaauagcaaaucuccauuagccgggcgugguggugggugccuguagucccagcuacucgggaggcugaggcaggagaauggcgugaacccgggagguggagcuugcagugagccgagaucgcgccacugcacuccagccugggugacagagcaagacuccgucucaaaaaaaaaaaaaaaaaaaaaauauauauauauauauauauauauauauauauauacacacacguguguguguguauauauauauguauauauguguguguauauauauguguguguguguauguguauauauauauagcaaaucuccauaacaauaugaauggugagaggaaagucagccuucuagauuaaaaguguucuuccacacuuuugcugucuuuugggauuauuguuuguggucaccagcagaccagauaucuguuggaauugagagcuagguuuuuauuugcaugcaacuuugugagcauaauugcauguuuguuuuaggaaagcugcuugaaaaauguaugguucuaggguuacuugugacuaaagaaacauuugauuuauuuuauuccagaaauagaugaaaugcucagugaguauucuuuauuuuuaaagauuucugcacauucggauuauaaaccgccuggguucuuuuaagacagaguagacagauacaaaauauugugauuaaaagagaaucuucucaguguaaauuauuuuuaauugggcugggugcaguggcucacaucuguaaccccaguauuuugagaggccgagacggguggaucacuugagaucaggaguuuaagaccagccuggccaacaugguaaagcccccaucuauacuaaaaauacaaaaauuagccaggugugguggcacacaccuguagucccagcuaaucaggaggcugaggugggagaaccgcuugaacccaggaggcggagguugcagugagccaagaucaugacauugcacuccagccugggugacagagcaagacucugucucaaugaaugaaugaaugaaugaauaaauaaauaaagauuuuaauugaaauaaaauuuauauaccauaaaauuuaccaauuuaaggcauauaauucaguggucuuuaguauauugauagaguugucaaccauuaccauaaucaauuuuagaauauuuucaccaccaccuaaagaaacucgauacuuguuagaagucacuuaccauuuuccccuaacccuacacaacagcuaaccugcuuucucucuauauauauuugccuguucuggacauaucauauaaauggaaucauauaauacacacacuuuuuuuuuuuuuuuugagacacagucuugcucugucgcccaggcuggagugcaauggugcgaucucagcucagugcaaccuucgccucuugguuucaaacgauucuccugccucagccuuccaaguugcugggauuacaggugccugccaccacgcccagguaauuuuuguauuuuuaguagagaugggguuucaccauguuggucaggcuggucucaaacuucugaccucaggugauccaccugccucggccucccaaagugcuggaauuacaggcgcgagccaccgugaccggccaauauguacacuuuuguaacuggcuucuuucacuuaacauaauguuuuccagguuugucauauuguaacauuuaucaguguagucaucccuugguauccuuggggggauugguuccaagacaccauuccccuaucccuguuguggauaccaaaauuccuggaugcucaagucccuuuuauaaaauggcauauuagcaaauguccuacacacauuaucccauauauuuuaaauccucucuagauuacuuaugauaccuaguacaauguaaauguuguauaaauaguagguauacuguauuuuuaaaauacauauauauuauuuuaaauuguuguauugauguuuuuuuuuuucugaauauuuucaacccacaguugguugaaucuaaggauguggaaucugcagauauggagggcugauugcuuuucauugcugaauaauauuccaucguagggguauaccacauuuaucuuugacuauugaugggaauuugaguuguuuccaccuuuugguuacugcgaguaaugcuaugagcauucaucgcauuaaguuuuuguguggacauguuuuuauuucuuuuagcuguauaucuaggaguagaauuucuagauccuauguuuguuuuuaaccuuuugaggaccuaucagacuguuuuccagaguggcucuuucauuuuacauuucuaccagccauguauaagacuccugagaaacacuuguuacuuuuauuuuuauuuuuuagaggcaaggucuugcucuguugcccaggcugaauugcagugcuacaaucauaguuuacuguaaccucaaacuccugggucucaagugauccuccugccucagccuuccaaguagguagaacuauaggcauguaccaacacauuaaaaaaaaauuuuuuuuuuuuuucgguuagggauggagugucauuguuacucaggcugguccuaaacucuuggccucaagcaauccuccugccuaagccucucaaaguaccgggauuauaggcgucagccacuguacccaacacgguuuuuuuuuuuuuuuuuuuuuuuuaauuauagccauccuaguagauaugaaguaguaucucauugugguuuugauuugcauuuuucuaauggcugaugauguugaacaucuuuugauguuuuuauuggcuguuaguauaccuuuuuuagagaaaugucuuuucagguccuuugcccauuuuaaauuuggguuguugaccgggugcgguggcucaugucuguaaucccagcacuuagggaggccaaggcgggugaaucaucugagguuaggaguucaagaccagccugaccaacauggugaaacccugucucuacuaaaaauuaaaaaaugagccagauguuguggcacaugccuguaaucccagcuacuugggaggcugaggcaggagaauugcuugaacccgggaggcagagguugcaaugagccgagaucacuccauugcacuccagccugggcaacaagagcgaaacucccucucagaaaauaaaaacaauaaucaauuuggguugucuucuccuuauccaguuguaagaguucuuuauauauucuggauacaaguccccaugggguacauaauuugcaaacaucuucucccguucucuauauuguagcauguaucauugugagucauccuuuuacuuucuugaugguaucuauaguuuuagcucuuacauuuagaucugcaaacgauuuuuaguuaauuuuuaagucuagaguaagaaaaggauccaacuuuauucuuuugcaugugguuaucuaguuguugcagcaguucaagacauaggaauaccuuuuggaugggguuguuugcuauuucagcuuguuagaucacaguguauauauuacugaaauauauggauauccaguauguuacugguuaacauacugguuaggaaauauuuucuaguaccuuuggaaguuacagggguuauuauuaauacugaacaaagguaacacccuaaauacauauuaagcauguagauacuguuaaguaccggggcugcaaagaugaauagaacaauagucuuugcuuuucacaaucuaggggagaaauagacauguaaauaaauaauuagaauaagguaucguucuuguauuugaacaagaugcugagaaauaaucacuaacuguuugaaaauaaucaaaggcagauuuucuauaggaauuaauauuuagguugaguuuugaagaaugaguuaaaaguauacugaaagaaugaaguagagaagagcaguaggaauagccuaugcacagguguauaaagaaagcacaccucuggggaaaaacaaguuguuaggcauaauuguaauacaaggaagauggaagguagcuguagggguaaaacuggaaaggaaaagggucagaucuguaagcuuuguauuuccaccaacgugagaaacuuggcuaucuuggaggugcucguguugaaacauuuguauauuauaacuucuaauuauguuacauuuuuauauccuuuuaaugucagguuuuuaaaauuuuuauacaauauguguaauacuauaauacauaauuggaaauaaaaauauauggagguguauaaucagauuuuuacugauagaggucacuguuacagauuauggaaagcuguugaauauuuuaaguggaggagggaacaauagcagauuuguauuuuaggaagauaaccacguggaagaaggauggaaggcuauuaaaacaguccaggaaacauauugugaagggcuuaauuaaggcagugaucuuuaucuuacugaggucuuuggcccuccaaaguuauggcuuagacucuaucuuaguuaccuaauguuuauugaguagguugaaagauaaguggaaaggaugguuggugccaaauuaugauaauuaguaccaugcuguuguuacauaauugccauuacugucuuuucuuuaggaaaaagagcaucuuccucucaccaacccucacauuuuccucagaaguuauuuuucuacugcuucuuuaucucauuuuuaagggauauuuuauugaauuuuuuauuuguuggguuaugauuuauacacagcgaaguuuacagaacucauguauguaauuguuuuaacaaauguauauacccauguuaccaccauucauaucaaaauguagaacauuuuuguuaucccagaaagauugcuuguuucucaaucccagagguaaccacaguuuugacuuccuucacuguauauuuuaguuuuuccuguucuugagcuuuuuauagauagacucauacaguaugcacucuucguaucuaacuuuuuugcugaacaugauguuuuaaaaauucacccauauaguauguaugauucuuuuuauucuauaacuauaccacaguacacuauccuuucuccuauuggugggcauuuaaauugucuccauuucuggauuauuauuaucaaagcuucucuagagaauucuguagauaucugcuuuccuuucuuuggguauauucuuaggaguggaguugcuaggucuuaggguaguuacauguuuacuuuuauuaaaaacuggcaaauucuuuucuaaaguguuuuaucauuuuaugcucuuagccgugcaugagauuucaaguuccucuguguucucugugacacuuggcauugucagauuuuuauauuuagucauucuguugggugugaaauggaaucucauugugguuuuaguuugcauuucacugaugacuauugauagugaguagucaucugguaauuaaucagaauuacuguuuauuggucauucauagcgcuuucugcugucuauucuuuugcucauuaaaaaauuuggauuguucauuuuuuuuauuauccucauauauccugguugcaagugcuuuuucagguauguauuuuguuuuuccuguaguccauugcuuccccuaaucuuuuuuuuuuuuuuuuuuuuuuuuuccuuagagauagggucuugcuuugucacccaggcuggagugcagugguacaaucauagcucacugcagccuuaaacucuuggucucaagugauccuccugccuuagccucccuaaguagcugggacuacaggugcacaccaccaugccuagcuaauuauuuuguagagacagggucuuguugcccaagcuggucucgaacuucugacuucaagugauccucccugauggaccucccaaagagcugagaugacaggugugagccacugugcccagccaccuaaucguuuucuuaacugugucuuuugauaagcacaaauuuuauuuagaugaaguucauuuucucuauuuuuaauuuuauuguuagugcuuuuugugucuggucaaaggaaucuuugccuaucccaagguauuugcaagaucccaagauauucucauguuuucuuccaugugaauauuuaauuauuccagcaccauuuguugaaaagacuauuauuuccccccugaauuccaguagcaccucuguugugaagucaaauguaagugcgaauguuauuucuggacucuauuucauugaucuguuugucugucuuuaugccuauacuauacugucuuaauuauuguagcaaaguguuaaaaucagguaguauacuuauucaucaaaauuauuuuagcuguucuagguucuuuggauuuucauauuaguuuuaaaaucaacuugucaauuucuacaaaaugccuguugcugauguuuugauugggaucauguugaauauauagauuaacuuggggagaacugguguguucacaguguuuuaucuuucaauccauguaugugauguaucucuauuaggucuuuaauaucucucugcaguguuuugaaguauuuuagguagaguuuuugcucaucuuucauuaaguuuauuccuagauaauuucuuuuuuuaauuguaguaagguauuuuuaaaacuuucucuuuccaagcauuuguugcuaguauauaaaaauacagaugguuauuauauauugaccuugaauuucauaacuuuguaaacucaucaguuuuagucauuuguuuguagauucuuuuggauauucuacauacaugaucagguaaucugugaauagggacaguuuucuuuuaaaucuauacauuuaucucuuuauuuucugguuaggauccucaaagguaauuuuuaaugaauuacuaggucaguuuugaugaacuagaauugucauuucgguucgcauagcagauacaugccuuacuggaacuugguaucaagugacuauauccuaauggaauugaauaugggauguuagaguguuguuuaucaguugagucuguuuuggagacagaacuuggaugccuugucuuuauugaauacaaucagaucuuccucuagauaguuguugguuaagguugacaauaguaccggaauccagaauuagggacagacaguaucucuguaucauuuaaaaagauuuacugcaaacuugaaaaagggauuucucucuccuuuucuggacuuucuuuuaccuaguuuuagccauaacugcuuuauauugggcauuucuucuagcaaaacaagcucuuauguacauuaucauauuacuuacugccucuugagacuuugguauacgcaguugaugccuugauuuaacacaggucaaccucaugguaaagaaacccaccccacacaaaaaaaauuaugauuuuuggccaggugugguggcucaugccuguaaucccagcccuuugggaggcugaggugggcagaugacuugaggucaggaguucaagaccagccuggccaacauagugaaacccugucuguacugaaaauucaaaaauuagccaggcgugguggugcaugccuguaaucccagcaacaugggagacugaugcaggagaaucgcuuaaacuugggaggcggaaguugcagugaaccaagaucgcaccacugcacuccagccugggugacagagcgagacuccaucucaaaaaaaaaaaaaaaaaaaagaaagaaaagaaaaaaaauuaaaauucuuugcccacuuuuugaugggguuguuuuuucuuguaaauuuguuuaaguucuuuguagauucuggauccauuagcccuuugucagauggauagauugcaaaaauuuucucccauucuguagguugccuguucacucugauaauaguuucuuuugcugugcagaagcucuuuaguuuaauuagaucccauuugucaauuuugguguuuguugccauugcuuuugguguuuuaaucaagaagucuuugcuaauaugccuagguuuucuucuaggguuucuaugguuuuaggucuuauguuuaaaucuuuaauccaucuuaaauuaauuuuuguauaagguauaaggaagggguccaguuucaguuuucugcauauggcuagccaguuuucccagcacgauuuguuaaauagggaauccuuuccccauugcuuguuuuugucagguuugucaaagaucagaugguuguagaugugucguguuauuucugacgccucuguucuguucccuuggucuauauaucuguuuugguacaaguaccaugcuguuuugguuacuguagccuuguaauguaguuugaagucaggcagcgugauaccuccagcuuuguucuuuuugcuuaggauugucuuggcuauauuggcgcuuuuuugguuccauaugaaauuuaguuuuuucuaauucugugaagaaagccagugguagcuuaauggggauagcauugaaucuauaaauuccuuugggcaguguggccauuuucauaguauugauucuuuccauccaugagcauggacuguuuguccauuuguuuguguccucucuuauuuccuugccucagcaaucccauuacuggguauauacccaaaggauuauaaaucauucuacuauaaagacacaggcacauguauguuuauugcagcacuguucacaacagcgaagacuugaaaccaacccaaauguccaucaaugacagacuggauuaagaaaauguggcacauauaaaccauggaauacuaugcagccauaaaaaaggaugaguucauguccuuuguagggacauggaugaagcuggaaaccaucauucucagcacucuuaacacgggaacagaaaaccaaaugcugcauguucucacucauaagugugaguugaacagugagaacacguggacacagggagggaagcaucacacacugggaccuguugcgggaggggagggcuaggggagggauagcauuaggagaaauaccuaauguagaugacaaguugaugguugcagcaaaccacuauggcacguguauagcuauguaauaaaccugcauguucugcaugugcaucccagaacuuaaaguauaauaaaaagauuaugauuuuggauguguaucauacaugacaguucaaauacuaaugaaaagauugauauuugauguacuuacguaauaauacacacuuaggacacuuaaaauaagauuuaauuuaauuuagaauuauaaauaucuuuccaggaauauauauaaaaauucagauguuuacacuagguauagccaugaaaacauuuuaaaaauaguaacucacagauuaauugcuuauauauuuucaaucuaguuuggggcuaucugugcuuggcuaguugcuugguugguauuuccugccuuauguggugcuaugcuguaaugacuguuuaccucuccauuggaaaaaauagcuaugggagauuagaagcucugugggaaaaauccuuuuuuaugcuuaggguucuguauaaguaaggagcucuuuggaacucuuaauuaauauauguuuuucauucaagaaguugcuguucaaauggaaagacuugaaugccaaagcuugauaaaagaagcaggaaucuguuaaauaagugcuacaggugucaugccacuuaaauugauugugcagacugcuucuuuaugaagcaauuucuggugucaaaaaaugcuauaugcuguauuauuaauauauagugauguguucaugauuuuauauagagaaucuuggaaaaaauuauuauuaaucuuuguaagucacuugaucguuaauauucuaggagaaauuucuuuuuaaaggaacacugauaaaucauuuauaaaauaauuuucucuugguugcauucacuuuuauguuuuucuuugauuguauggaggauauuuauagggcagaaaaaggggaaaauaucccugucguuaguaaauauaaugauagcuauugauuaagguaaauauuuugccauuuuauugguacauauaggguauauuuacuucuggcacaugggaagagaaaucagaugaaauuuccuuugcugacuucaaguucucagucacucaucauuaucuuguacaagaguccacugauaaagaaggaaaggaugaguuauuagaggguaaguuauuucuauauaauaauauuaacuucugauuuguaggaguggcuguaauuuugaauuauuaauuuaguguucuuccauagugucaguuucucuggaacuguuuuacauaagcaaaguuguuucaccacaucugagguagaggaugaauuacauugucauucauuuuuuaauuaauuaaaucagcucauauuuauugaguaccuaacauguaccagauacucuuccaagcccuacauuccaguagggaagauaagauagauaaguaaguaaccauaaugaaagugauaagugcauccugaaguacagacaaaauucuguuggaauucagaggagaaaagaucacuuuuaauugggagauuagagaaggagaauuaagcaaguaaguuuggcuuugaaggauuacaaauaaaggaaaaucuguugauuagaggguaguauuuuggauuuacucuagauuuuggagucaaaacaagugguuuaaaauuuuauuuuuucuacuugcuaguuaguugccccaucuaagcuugaguuaucucaguuguaaaaugaaguaauacuaccuggagggcuaagugaagauuuaaugagaaauuguacauaagcaaguaucucaguaccugacccaugccagguacucaauaaauggugucuauaauuguuaauaggucaaaucauccaaaaucuucuguccuuagauaaacuagugcauaacagugagugagcaagauacugaauaaacaugaacuuuggagcugccagucaaauauccuucuucauucacuaagcaaauaaauagguagaauguguuaaauuuuuucugaucauaacagauuaucauuuguaagcucagaccugaaaaaaucugugcuuuuucuuguguaggaauagaauuuuguuaccuuuucuguuacguauauucuucuuagaaacaaaacaauuagauaacauaugcauucagauucauaaaccagggcagauaacauuaaccauauauacauauauguaaggcaguuauacagcaaaagaaaauaauuaagccagaaugugaauaugagaacuuuaagaggaagagggaagugugcgcaauuguugggaggucucauaauagcccagcaauuuucagguucaacguucugccaauuaaugaaggaaacuauucaagauagcgaaaauuuaagugcuguuaauuuaagggaagaucaugcaucaaggaaaagcugcuguaguaaagaggcuuagaaucagugcucugagauaaauagauaaaggagacugugguacaaugaaggugaauuauuuuuuuguuuguuuguuuuugagacugaguuucacucuuguuguccaggcuguagggcaauggcgcgaucucagcucacugcaaccuccgccucccggguucaagcaaaucuccugccucagcuuccaaaguugcugguauuacaggcaccaaucaccauacccaguuaauuuuuuguauuuuuaguagagacaggguuuugcuguguugaccaggcuggucuugaacuccugaccucaggugauccaccugccucggccuuccaaagugcugggauuacaggcgugaaucacugugcccagccaaaggugaaugaauuuuaagcuaguuaaggcauuguugcaaguguacauauaaagugcaguuuucuuuuaauuugauugugauugagccuguaacuuauggugggaguuacaagccaaaccaucagcucaguuuuacagauacgcguuuaaaacuauauuaucagaggucaggagauuugagcacuaaucauuuauguuaucagcauugucuauugcuuuuggucugaaaagcaccaaaucauuagcauucucuuuagucuuuuagcaaaauaaaaaguauagaucugcuaagcaaugauagcuauacaacaaaaauuauuuuugugaauggauacuauuuuuaaugcauugaauuugucauguauuuauggguauaaugaucuuuuauguuaguaccuuaucguggauaguaauuuaaguguguaaacauaguuuagaagugggaagccagguagaaguuuuacaagaacauuuaagauggacagggggccuaaaaaggcuugcuaugggagguuauacagaguugacauaucucuaaauagaauguugaagaaaaguagaggcaaggacaggcuaagaagaauaaauaaagcuuucugguaagugugaggaauugugugaguugugacucagaagcaaaaaaauauuuuaaacaugggaguggcauaugucuuuuuuauaggcuacuuuuauuugaagaaaaaaaaaugagagagaaaucccucucccuguacucaagagcuaucuuuagauaugaaucuuaaagcaauaucaaaacugcaugaucuagcaagacauguguuuccucaaagcauguuauaaaacucugccugaucaugaacauacuaacuuuuucauuaucaaauguuuuuguagauguuguuccacaaucuaugcaagauuugcuggguaugaauaaugacuuuccuccaagagcacauugccugguaagaugguagguauaucuuuuacucaguaucuuuuaguauguguguugcgggggaccucaacacuguccccaaguucagugauuugcuaagaagacucagaggacucagcauuuaauugcagcugauuuauugcagagacaggauacagggcaaaaucugcaaagggaaaaaacacaugaggcaaaguccagaggaaguacaagcuuuuaagaauccuuuccuaauggagucaggcaagauguacucaguucccucagcaacaaauugugacaaaguaugugaaacauugucuaucagggacaguguuagaggcucagcgccccagguuuuuaauuagggggcuggucauauaagcacccuuuaacugguauauaccaaaauuucaggcucccagaaggaaagcagguguucggcauaaauuacauuguuugcauaaacaauuuaggcuuagugagcagcuuaaucaguucugggaauggugagaacccuccccaaaucccauuucccagcuguuggccaagaguuaaccuugcaagcaggcuuuucuuuucuuuuuuauuuuuuugguuuguuuuuucuuucaguuuuuuuguuuuuaauuauuguagauauauaguaguuuuacauauguaauaguuguacauauuuaucuuuuuuucaaaagaaaugauaaaugcuugaggugauggauuccccaauuaaacguuccaauuccauucuuuuauuuaucuugacauauacaacaaauuauuguuaacuauaggcacccuauuuugcuacugaaugcuagaucuuacuuuuucuauccaacuguauuuuugucccauuaaccauccccucuuuaugcccugcuccccauuacccuucuaagccucugguaauucuacuuagagauaugucaacucuguaucaccucccauagcuagccuuuuuaagccuccuggccaucuuaaaucuucuuguaaaacuucuacccagcuucccacuucuaacccauguuuacacacuuaaaugacuauccauaagacacuaacaucauucuauucucuuaucuccgugaguucaguuuguuuguuuuuuuagcucccacauauuagugaaaacgugcaauacuugucuuucugugccuggcuuauuucacuuaaaugucuuucaguuccuucuaugcucuuguaaaugacaggauuucauucuuuuuuauggcugaauaauauuauauuguguauauguaccacauuuucuuuauucauucaucuauugauggguacuuagguugauuccauaucuugguuauugugaauaaugcuguaguaaacaugggaguggagauaucccuucaguauacugauuuccuuucugcaagcaggcuuuuuuuugugaaacagagucucacucugucgcccaggcuggagugcaguggcgugaucucggcucacugcaaccucugccucccagguucaugucauucuccucccucaggcucccaaguagcugggacuacauguguccaccaccacacccagcugauuuuuuguauuuuuaguagagacgggguuucacuguguuagccaggauggucucgaucuccugaccucgugauccgcccgccucggccucccaaagcgcugggauuauaggcgugagccaccgcgcccggccgcaggcaggcuuuuuuaaggauagcggucacaggccugcugguucaucuuuucugcacaauguauuucauaauccaggguagugcuuaacuguagucucaugacaagcauggaacauuuaaauaucauagaaauuuuaauacauauuauugaauauugaaaugaacucaauauguuggauguugaucuguuaugugauaaaaucaaaacucacugugucuaaacuauaaaugugauacauuaauguaagagguacaaucuuaccccucuuaucugugguuuugcuuucugcgguuucaguuaccuguggucaaguguagucugaaaauauuaaauggaaaauuucaggcaaaaacaacaaguuuuaaauuguaugcuguucugaguaguauggugaagucuuaggccauucuguccuggaagugaaucaugccuuuguccaguguaucuacaauguauacacuaccugccccuuaggcacuuaguagucaucuugguuaucggauugacaaaucacaagaagaagggugaguauaguacaauaagauaucuugagagagagagagagagaccacauuuauauaacuuuuauuacaaaauauugucguaacuguucuauugguacuauauauaggaaaaaacaguacauacaggcuuugauaccaucugcaguuucaagcauccacuaggggucuuggaacuuaccuuccacagauaaggagggacuauuuacaucacauuuaaaaggucucuucugucuuuuucaguuauuccaagugucugugaacuuuauuuauuuuggauggaguggucuuagaacaaacuaccaccaaaauggcccuaguaaagaguauauauuuaagaaaggagaccuaguuaaaggaaguuuacauacugguuugaaauuauucuauuguuaucaguuggucuuuugauuuuuuuaaauuaaagaauucuaagguaggggaaaaugacauuaaucuguguuuaucuuuuucuucauuucauauagcaaauaggcuguguagcacuuuuaaaaaagaaaauuauuugcaaaugcagguaaacgggauaguguuucauaaauauuccucuuuuaguaugaccuuuuaaaaauuguucacuuaaacaacuaaaaaagaaauguaauaauuauaucuauuaaauuuaauuuaauccuuccacauuccguucuggccuuuuaaaauaugaauauauacauuuaaugugacuaaauuuaucagaaggcagcauaguaucagagcaugagcuuuguaugcauuaauucauucaacauuaauugaacacuuacuuacuguuuggcuauauacugaauuagguuuaauuccuaacucagguacuuaguaucucugcaacuuugggcaaguuacuuaauuucuuguaguuuguuucuacacugguaaacuaagaauaauaaauaauaugcacuuccagaguaguuaugaggaucaaauaagauaauggcgccuaguauguuuaucaaaaucuaaaugcuauuaacaugauuucagccuuuugguauguauuuccucacuguuacauaguuuguggucaaaauauuaaaugaaguaaugaaaccuuucuauauauuaauauaaauaacuuguuaguagggugguuuuuguaaccuuuccauuuacuuuuaaaaauauuuuuaaaaucaacguaguaaaauuggacuuuuuguggaggugagcaguucucugaacuucaacacuuuauauaguuuuuuacuaguaucaaaaucaggagauagaacaguucuauaacacccccucaccucugcugccaaaaaaaaagcccuauugucccuuuugucucuuaguaagcauaggcacguccuucccacuuuuuuuuuuuuuuuuaaagagacaggucuuacucugucacccaggcuggaauacauugaugcaaucauggguacuguagccuugaacuccugggcucaagugauccuucugccucagccccuugaguaucuagaacuacaggugcacaccaccaugcccggcuaaguuggguuuuuuauuuuuuguugagacagugucuugcuauguugccugggcuggucuuaaacuccuggccucaagugauccucccaccucagccucccaaaguacugggauuauaggugugagccacuguaccugaccacacucucgacauccuuauaaucccuggaaucccugaucuuucuuggucacuauaguuuugucuuuuugagagugucauauaaauagaauucuacuguauguaaauagaauucuacuguaugugaccauuggugacuggcuuuuaaaacagcauggugccuuugaaauccuuugaggugauucugcuuaucaauaguuuguuccuuuuuauugcugaguaguauuuuauuguaaggauauaccaagcuguuuauucagucauuuguugaggguuauuaggauuguuuuuagguuuuggcauuuuuaaauagagcuauacuauaaauauuuguauacagauuuuugugugaaaacacauuuucaguucacucggguagauaccuagaguaguauugcuaagucaugugguaaguguauguuuauaggaaacugcaaaacauuucuagaguaguuguaccauuuugcauucccaccaacaauguaugaaaauuccaguuucuacauccuuaccagcacuugguauugucaguauuuguuuuuagccauucuuaguaggugcauagugguauccuaauuuuaauuuugaacaucuuucguguguuuauuuguccauuuauaucuucucuguauuaacaguguccaagucuuuugcacauguuuuaauuggguuguuuguuuucuuuuuuggggguggggguuguuuguuuucuuacuguaaaguuuugagaguucguuguauacuuuggauguaaaucuuuuuuauaaugugugauuuccaaaaauuuucuagaaaagacagcacuaagagaaaugaaaagauuaucuguaacagauaagacuguaacuuaucuuuuaauuucucuuaauaugucuuuucuagaacaaaaguuauaaaauugaaugaaguucaguuuuaucaauuuuuaauuuuagggauugugcuuuuggugccaugucugaggacuuuuugcucuaggucacaaaucuuucuccuauuaaaaaauuauuuuauuuuggaauuauucaaaaucugagggugaaagcagcuguuuauggaugcuggggauggugguagcagauccauuacccagcuggcaaaagggguggcaguggccuguaauauucuuuccaaaaaccccuaaucccaauauauccauuuugauauuuagauguuaccugauuucuuucagcagugucuuacaguuuucagcacaaagauccuguaaauguuauauauuauguuucuacuuguugcuuucuuauaaaggagcuauuguaaugauauuauuuaaaaaauuuuucauuuccaguuguucguuucuaguauguaggaauauggcugauuuugagggguuaaccuuguauccuguaaccuugcuaaacacaaugacuaguucuaggaguugucauuucuuugggauuuucuauauauacaaucacugucucugaauauggauaguauuauuucuuuucuaaucucugugcuuuuuuaaaaauauguauuacaagauaccaugaagcagucuguucauuuuuuuuuucuguuuaaaacuggcuagggcuuccaguaaaauauugaauaggaguugcuuaucucagggggacagcauuuagucuuuuacuguuaagugugauguuagcuguagguuuuuucguagaugcucuuuaucagauugagaaaauucccuuuuguuccugcuuugcugagaguuuuuauuaugaauggauguugaauuuugucaaauccuuuuucuguuuaaauugauaugauuguuguuuucugcuuaaauugauaugauuuauuuucuuuagauuuuuaauauguugauugcauugacugauuuuuggauauauaaccagcuuugcauucucaagauaaacuccacuucuuuguggugcaauuuguauuucuguguguguguguguguguguguguguguguguguauguauguguauugcuguauuugauaugcuaauaguuuguugaggacuucagugucuauguucaugugggauguuggucuguaauuuucuuuucuccugcuuugguuuugguaucagaguaauguuggccuuauaaugugagucagaaaguauuuuguucucuuuuauuuucuuugagagaguguaaaauuuuuuuuuuuuuaaccguuugauagaauuugccuuugaaacuuucugagccuggcauucucauuuuauugagguggcaauuccuucuaggguccaggauguaagcagaagucucaguuccaguaccuugucucauguauacccauaucccugagaggucauucaaaacauuacaaccucuguagugauuuggauugauggaguaaaucuaaauauaaaggauacagaaggaagcuugugcguuuagguuauauagcagagagauugguaaucucaucagaaagauaggcagcuuccaagucccagggccucguaagcagaggcacaguuauggaugaugauaucugagugauauugugcuucuggaagccuaguuucuggguguagacuuauuuauauuuauuauuaugagacuggggcauucuuggacauagccuaaucuggaugcaugccagagaccacuuucccugggcuggguguaccuuaucaucucagaguuauauaauucacauuaugacugcuaggcuaaaauacaugguauugucagacguaaacagacuuuucuuccaucauucuuguucucuucagucuagcacagcauagucaguuuugcaaacaguuuuauaagucaaacuaacagacuuucagcaguaaaaggcuuacccuauaaaaucccagcucccagugcccagcuguuagggccuauagccaaagcugaucauccccugguauuuuucagucaccuucuaugcucgcuuuugccuuucaguauacucuuuguuucuguuacccaggaaucuccuuuuuauuauuucaaauucagcgguguauuuugacagcauugucauauuugaucagguauuucuguguguuuugggacaaggagggccugugucauguuaguuugccguaugguuggaagucacuuucaguuuugucuuacuugaccuuucuuaaaguuuaggaagccaacaacaaagcuuuugagaacuguuuaaaaguuaagcauauuaaauguauguguauuuucuuuuauucaacaaauauaauuuuuaaacauuuacugugauccagauacagaaauaucaagaauaaaacaugguuacugccuuaguaaucuaugggauuaauagauaagggaguagacaacaauaacauuuugugauaaaugcucucauaggaggcagaacacaaguuugauggaaacucauaggagguaccuguaauucagacagauuaagucaggaaaauguuuccagacaaggugauaccucacaugaauccugaaagacaagugagaauaaaccaggugaauaagcuuaauuaauaaguuagguaaaaagauacuugaggcagaauuaguagaggugaugauguuuaaaugcacuuuugaaacuuguagguaguuugguaagguuggguauagcaguagaggguugggaaugggaaaagaugagaaggacuuugguauguggguauuuuaagacuaaugugaaccagacaucuuaagaggauuucauaauauucuccuucuguuuuauucauauaauuuuuauuguaauuguuaauaaauacauuucucaaaaauuucaaggauacagauuacuuguaaugcuucagagauacugaagaauaacauacacagaaguuuucaccuaaacauuuauuuaaauuugaauuuuaaaaaguuaaaccagaauuaaagcaaugacaaugaaaauuugaaaacgauuuugcaauauaugcaucuguacuuauuuauaccauaaauauacaauuaguauagguugacccugucagagugauuuaaaauuacuauaugauuaacuuauauuuucaaaucaaauucuagaaaauagauuuuugggauuuauguccaaugcucaauuuugguaguucgaguuugucuauuaaucuuuaucuauuuuaagaucuucucguuucaguuuucauaucaagcaccucucagauuagcuccaagccuguuuaacuuuguuaagggacuuuuauaaaaguggacuuuaaaagauaugugggcaugaucaauuuuauguucuuggcaauguaauugaucuuaaugauguguuuugcuggauguauuucagccuucugauauaccuauccuuuaaauacuuuucuuuuuuuauuuucuuuaaauaucuucuaguggguguuuccugaaaccaucauuacagauuuauucucuugauuguuaugcuucaugauaauauaaauagcccuggaaaugacacagacuuuaaccguagcaaacauuuauguccaaauggaaauucaugagcagagauuuuaauagcaaggugugguaggcaagauaaugaacccugcuagcccccagagaugguccacaaccuaaaucuuagaaccuguggauauaaguuauguggcaagaggaauuaagggagcauuaacauuaacauugcuuagcaauagacuuuaagguagggagauuuauccuggauuaucuggguggacccaguauaaucacaggaguucuuaaaaguggaagagggagacagaggagaguuagugucauagcgguaugagaagaacuuggucccaguaauguagguuuuuaagauggaagaagagggccaugagccaaguaaugaggguaagccucuagaaacuggaauggguucugcgcuagagcaucccgaagggacacagccuugcagcuaccuugaauuuagccuugugagaccuguuucagacuucugaccugcagaacuauaagaugaucaaucuguguuuuuuuaagucaccaaauuuguaguaauuuauuacagcagcaauaugaacuaauacagaaaguaacagcaugaaagcuguagaugccuggagaggcucuacugagaguggaacaauacacugaaagcacagcuagguuuaagggaggacacauuuuguccccauggcucugccuuuguugagcguugucuuugggucuuuagcuuuagucaugcuuuauuggucaccacaaaggaacaguccacaaauaaucuugugaaaacuguguaguugaauaauuauuauggcuuuuaagaaauauucauuuuugucugggcacgguggcucaugccuguaaucccagcacuaugggaugccaaggcgggcggaucacgaggucaggauuucgagaccagccuggccaacauagugaaaccucgucucuacuaaaaauaacaaaaauuagccgggcgugguggcgcacaccuguagucccagcuacuugggagguugaggcaggagaauugccugaacccgguaggcagagguugcagcaagucaagaucgcacaccagacugggcgacagugcgagacuccgucugaaaaaaaaaaaaaaaaaucauuuuugugauuuuuuuuuuuuuuuuuuuugagacggagucucgcuguauugccaggcuggagugcaguggcgaaaucuuggcucacugcaaccucugccuccuggguucaagcaguucuccugccucagccucccgaguagaugggauuacaggcauaugccaccaagccuggcuaauuuuuaguauuuuaguagagaugggguuucaauguguugcccaggcuggucuugaacuccugagcucaggcacucugcccaccauggccucccaaagugcuaggauuacaggcacgagccaccgugcccagccuuauuuuugugacuuuaauguauuuuuuuccugguaauagagauacauguaaaagaaccugacaguuuugagaaaccagcauuuuagacuagcccuaaggaccuguaaaguguuuucauucuuccaaaagugaauguuaagaggacuucuuguaauggcagugugaagugguuagugauuccucuuugcuaaaggggaauuuuuuuaaaaggcauuaaacuggacagaacugucaaaaaacaaccauuucuggcuccucuuccuguagcuguuucugucaccuccccucuucucucuaaucuauguuggugauaacugagcuuucuagucuaggcuggccaugaaaauaccaccucuguugccagaugagcagguuuaauucuuuguuggcgggggagggaagguacaaaaacuuuugccuuugccaagcaaaaggaacagauucuguugggaacagauggguaaaaccuguaccuuuguuagaccaagguugcagucccaauucgaggcaagugauggauuagucaaaaauuuaacaaggagaucuuguauuacagccauagaaagacagauacccucucuacacauccguagaugacaggaaaacuacauauaugcaggagagacccagcagagcucaaacuggagugccaguugcaauuuugaaugcauuccccaacccacacacagaucauuuagcagaaagugaaaggaaaaccuuauaggcucagguguuugggcaugaucugugcucaaauuauugguuuaccugcaaacuauacagacaagagguagcugcuagagagccaggcuaaaacauugaaaauaagaauaaagcaauggaauagagauaucagaggcugcacacuguugaggagacaguuuccucaguguaaguccaggcaaguuaugaaauacaaacaaauugaaaaagcuaacaacccucagaaaaguuaaacagaauauggucuugcuacaauguauuaucaaaauauagaguuuucaaccacaaauuacuagauguacaaugaaacagaaaagugugacccauacaaggggaaaaaauaguagaaauggacucuuagugggucuagauauuagauuuagcaauaacaucaaaauauuuauuacaaguauguugagagaauugaaggaaaggguuuucaaagaaauacuaacagugaguuacauaggaaucucaauaaauagaaacuguaauaaagaaccaaauggcggccaggcgugguggcucaugccuguaaugccaccauuuugggaggcugaggugggcagaucacuugaggucaagaguucaagaccagccuggacaacauggugaaacccugucucuacuaaaaauacaaaauaaauaaauaaauaaauaaauaaauaaauaaauaaaauuagcuggguguggugguaugugcccauggucucagcuacucaggaggcugagauaggagaaucacuugaacccaggaggcggaggccgcaguaaguugagauacugccacggcacuccagccugggcaacagagcgaaacuccaucucaaaacaaacaaacaaacaaaaaaacaaauggaaacuccagaguugaaaaguauaauugaaaugaacuuucuucacaugggcucaaaagcagaucugagaugauagaagaaagaguugggggauuugaaagauuaacagaaauuguccaguccaaagaacagagaaaaaaguuuggagaaaaaacagaacuucugagaucugugggucagugucaaguguuccaaagcaugcauguaaugggacucccaggugaagagaaagaaagugguagaaaaacaaaugugagcucucccucucccucucccucucccccuucccucucccccucccccuucccccucccgcuccccccuucccccucccccucucuccauggucucccucugaugccaagccgaaccuggacuguacugccgccaucucggcucacugcaaccucccugccugauucuccugccucagccugccgagugccugggauugcaggcacgugccaccacgccugacugguuuucguauuuuuuugguggagacgggguuucacucuguuggccgggcuggucuccagcuccuaaccgcgagugaucugccagccucggccucuggaggugccgggauugcagacggagucucguucacucagugcucaauguugcccaggcuggagugcaguggcgugaucucggcucgcuacaaccuccaccucccagccgccugccuuggccucccaaagugcugagauagcagccucugcccggccgccaccccaucugggaagugaggagcgucucugccuggccgccaaucgucugggaugugaggagccccucugccuggcugcccagucugggaagugaggagcgccucuucccagccgccauccugucuaggaagugaggagcgucucugccuggccgcccaucgucugagauguggggagcgccucugccccgccgccccgucugggaugugaggagcaccucugcccagccgcgaccccaucugggaggugaggagcaucucugcccggccgccccgucugagaagugaggagccccuccgcucggcagccgccccgucugagaagugaggagccccuccgcccggcagcugccccgucugagaagugaggagccccuccgcccggcagccgccccaucugggaagugaggagcgucucggcccggcagccgccccauccgggaggugggggucagcccccgcccugccagccgccccguccaggagguggggggugccuccguccggccgccgccccguccgggagguggggggugccucugcccggcggccccuucugggaagugaggagccccucugccuggccgccaccccgucugggagguguacccaacagcucauugagaacgggccaugaugacaauggcgguuuugucgaauagaaaagggggaaauguggggaaacgauagagaaaucagauuguugcugugucuguguagaaagaaguagacauaggagacuccauuuuguucuguacuaagaaaaauucuucugccuugggaugcuguuaaucuauaaccuuacccccaacccgugcucucugaaacgugcuguguccacucaggguuaaauggauuaagggcggugcaagaugugcuuuguuuaacagaugcuugaaggcagcaugcuucuuaagagucaucaccacucccuaaucucaaguauccagggacacaaacacugcggaaggccgcaggguccucugccuaggaaaaccagagacccuuguucacuuguucaucugcugaccuucccuccacuauuguccuaugacccugccaaaucccccucuccgagaaacacccaagaaucaucaauaaauacuaaaaaaaaaaauaaaaaaauaaaaaaguaaaaaaaaaagcaagcugaaaaaaaaaaggaaaaacaaaugugaagaaauaauggcugagaauuuuccaaauuugauuaaaaacacucagaacuggaagucuuagugaaucuuaaguaggauaaacacaaaagagaaccaccccuagacauaguaugggcaaccugcugaauaccuuagauggaaagaaaaucuuauaggcagcaagagaaaaaugacuucucauguacuagagaacaauacccuuggcugacuucucaucagaaacaguggaggccagagggcagugcaaugacacaaaguucugaaagggagaaaaaaaaaaaaaaaccacuguugaccaagaauucuauauccagugaaacuauauuucaaaaauaaagaugaaauaaugacauucuuauguaaacaaagauuggcagaauucauccuugccuuacaaguaauacuaaaagacauagaggguaacuugaauccauagaaaagaaugaagagcauuggaaauacucuaguaaauacaauaaauauauucucauaauuuaaaaaaagcguaagauugcuuaagcaauaaugacagcacuauauuguuggguuuauaacauauguaauauguaauauauaugacaauauugcacaaaggaagggggaaggaauggaguuauacuauauaaaauugguagauuuuacuagaauaaccugaauagauuauaaauuaaagauguguauuauaauaucuaaaaaaguuacuaaaaauaaauucaaaaaaugaauuguuugagcaccuccaguuacccagguauuuuuguaagugauagauauuuaacuuuuuuauaccauuuuuuuaaagagguccuuaaucuauuucuuucuaagguaauauaugugagaguuguagaaugguagcauucaaaguaagugguauggcugggugcgguggcucacgccuguaaucccagcacuuuggguggaucacguggucaggagaucgagaccauccuggcuaacauggugaaaccccgucucuacuaaaaauacaaaaaaauuagccaggugugguggcacaugccuguaaucccagcuacucaggaggcugagacaggagaaucacuugaaccugggagauggagguugcagugagccgacauugugccauugcacuccagccugggcaagaagagugaaacuccaucucaaaaaaaaaaaaaaaaaaaaaaaaaaacuacacaaaauaagugguaugguuuuaugauuugccuaugugagaguaacaacaaauauaucaaauauugguuaacuuuuuguuguuguuacuuuugaucuuuauugguacaggaaagaaaaaugcaucuuaaaacaaaaaugaaugguugauuguccuaccuuucucauuuggaggaugggaugcuaaagcacauuuauauuuaaauauaguauuuaguauacauaugcaaucuguuauucagaugaaacaguucuuucauuaagaagugcaauugugacauuuuaauuuguguugauacauuugaucuccuaauaaauuuaaguuacugggcuagaaauuguaggaaauauaaugauuuauuaaugaaacucacccuaguagguauguaguggucucucacuguuuuaauuucacuucccugauuacaugugauauggaacaucuuuucauacgcuuguuugcuaucuuuauaucuucuugggugaggugucugguugaagucuuuggggcuuuuuuuuuuuuuuagcuucgauuauguucuuauuuuugaguuuuaagaguucucuguagauucuagauaacaguccucuaucugaaaugucuuuugcaaauauuuucucccagacuaugguuuucucuuucauucucuugacagugucuuuugcagagcaaaaauuuuuaauuuuaaugaagucuagcguaucaguuuguucuuuucuggauugugccuuugguguugcaucuaaaaggucaucaacaaacucaaaguuaucuagauuuuauucuguguucuaggaguuuuauaacuuugcauuuuauauucaggucuguaauccauuuuaaguuaguuuuuguggagaauguaaagccuaucuagauuaauuuuuuuguauguggauguccaguuguucuaacaccauuuguugaaaagacuaucuccauuguauugccucuguuccuuuucagagauuaguugacuauauuuaucugggucuauuuuuaggcugucuauucuguuccauugaucccuauuuguucuuuugccauuaccacacuguauugauuucuguagcuuuauaguagugcuugaaguuugauaguguuaguucuccaacuuucuucuucuucaauauuuuauuggcuacuuugagucuuuuuuugcuucugcuugugaacuuuaaacucaguuuguggauauccucacgauaacuugcugagauuuugauugagauugcauugaaucuguagaugaaguuggaaagaacuaauaucuugauaauauuaucuuccuauccaugaauauagaauauuucuuuauuauguguguguguggugguauugguggugguaaccauaauuauuuugccacuccucuauugaagaauauuuagauuguuucuagauuuuuacaauuaaauuaaaauauuauagugaaaaucacuguacauacaccuuuuugcauuuguaugaaugguuuuguagcauagauauaaagaaauauguaauucguuugaguuuuguccauuuuaaauauugauauauucuucccuuuugcucuccaaaaaaaauuuuuuuuuuuuuuaauuuuuuauuaagagacagggccuugcucugucaccaggcuggagugcaguggcgcaaucucggcucacugcaaguuccacuuccuggguucacgccauucuccugccucagccuccugaguagcugggacuacaggcgcccaccaccacgcccagcuaauuuuuuuguauuuucaguagagauaggguuucaccauguuagccaggauggucucgaucuccugaccucaugguccgccugccucggccucccaaagugcugggauuacaggugugagccaccgcucccggccuuuguguauuuucuuuugagugacauccauccaaguccuuugcccauuuuaaaaucugguugguuguuuuuuguuguuguuguugauuuucgcuuauuuuuuuuuuaaagcucccacguaauguuaguuuacuuuugaugaagacauagucucaggauucaaguagaccuauuggggaaaaaguagugacuuauauugacauuuuaaagaucauaaagaagagaguacauuuaucaagagugauauuugagguaaauccuuuuuuuuuuugagaugagguuucacucugcuucccaggcuggagugcaguggugugaugaugguucacuacagccuugaccuccuggccucaagcaguucucccaccucagccucccaagcugcugggacuacaggcgcucuccaccaugcccagcuaauuuuuacaauuuuuuguagagagugggucuugcuauguugccuaggcuggucuugaacuccuaagcucaagugauccuccugucuuggccugccaagauacuggcauuacaggugugagccaccacaccuggcaagguaaaucuuuaaagaauuugucaggauuuguguauuuaguaauggcaguagaauggauggggggagacauuuuaucaauagauagaggaaagaaaggcuuaggggauagaagguagauugcagauaaauggcaauucaguuuggcuuguuauucauggcuuguauacaguggcauuguguguguguacaguaaggagguuagcaacagcuaucaguguuaaaaugcaaauguucuuuuauccagcaaccacuagaaauuuauuauagagauauagauguagaaaaacaguugcaguauuguugcagcagcauaaaacuggaaauaaaguacugaucaauaggggauuguacuuuugaaaagaagcuuuacaaaguguauacaaauaauauaauuguauuugaggguagggugguuacgcagauaaauggaacauuucuggaagaauaaccaagaaacuguugacagugauuuuauacaaguacagaggauggaacggggauguucacuuguuuuguuuucuuucuuccagggacauuugaaaaaaagaaaacuauuuuucaaagaucuuuagagcucaauuuuuaaagcucuagauuauuuucauuauuuuaugcugccucugcauaacuaauuuugauuucagggcuaggaggguggagguagggugaggaaaugaaauaaguuuuugucaucuaaauaauaaacauuaugaauuaaacuuaauuuuuuaaaucauuacuccuguuuggggcauuucuugaggaggauguuuauaaaaauaaggauuaauaauucuuuauauaccagagauaauaaauuaggcaaaugaguaaaaucucucauaaguuauuuucuuuauuaaaaaauauuaaauauaaauacauuaaagagugaauaggagaggaauuuucaguauacaggauaaucaguuugacuuuauuuucauaaaaauuuggcagcaaauuugugacuuuaaaggauauggcaacugaaugagaaguuuuaauuaauguagaugucauagcaagaucaagcugcuuuaugauaauuuuuuaaccccuuuuuaauguguuauugaguaaaagaacacaagaauucuuuaauuaggauacuuaguaaacuguguucucacauuuagaaaggacauauacaucauugcugauaauuuuccugcaguuuagggaaucugucaaaguuucuucaucugcagacuuagugguaucaguucauuaaagcaaaguuucaauacuugccucuuuuaucuuguaaacuuaacuuuaaaggcaaaacuauuguuuaaugguccuugugauuucagcaaauuguuucuuuuuuuucuuucaaauaucagauuucuuuauacuuaaaaugugcacauuauaguuuacuuagauacaaaauguuuacuuuccuuguagguaaggaauuucacugacauuuccaugucaauuagcuucuuuuuaguaaaaauccuuccauuaaaaauaaacauuuaaauuacucaacuauuauauucauuagucucaauaccucuuaaaaauacuuaaaacuuuagaaaauagacuguaaaccuugccuaaaggaggcauccagcucugagcagaccacacggaauguguuagagcauggccauaugcauggccauacaacuccuggggccaccuccacgauggcccagccccaccacugacccucugcugaaaacccugccccucagcaggacgcaagcuugucccccaaauaguggugaccucaaacuguaauaugaugaugaaaccuacagccgauacugccuuccacaaggguuucuggaaaggcugaagcuggagacgguaaaccgcaacaccgucccaggucaccccagcuaaagacauucuauaccagccaaaaggcuaaaguuuaguuaaggguucaaaggcaaauacacugaaacccauguguaaaccugccugguuuucaagcugaaagagaaacacuuuggugucuucaauaacccaggccugcacuggaugaagcaaugaaggcaaggucacggcugcuaaagcacggagagguuaaaaagugugaaaccagaagaaacucuugagugagagaugugaagcagcaggccgaggcaucagacaccucucccaccacacaccucucccaccagacacuucucccaccagcugcagggcucuuggcagcguucucagcccagccauucugugacaguuguuuuaaggaaucagcuguugaccuuuuuuucucaagcggcaacaauaacaucaauauuacaguggucuuaugaauacacccaugugaucaacuuguuaguaaacacauggguauacaacauaaaguaggcaaagcggaaaaaguauuuacaacugucaaagucucucucucucucucucucacacacacacacacacacacacacacacacacagaugggcacgcaaauauaucugagccuauuuuagcugaaucaaauuuagauuucagcaaauuguuucuaauuuguaaagaauagaggggaacuaguagguggaugauggaagugcuucuuaaaguugaggucuuguagguucuguugccauuaaaagaaacacuuuuaguuuaaaccugacuuguuaaauuuucuguagugaaauuuuuuugugcuuuucaaguaauggauuuuuguguucugagguuuccccuguuuaaugcaguuaauucuuuuuuuaagguaugggcuacgugaguucguggugauugccccugcugcacacagugacgcuguucucagcgaaucuaagugcaaccuucuucugaguucuguuucuauugccuugggaaacacuggcuggugaguggacauuuuuuaaaaccuagacaaaaaaacuguuuuuaacaauaauuuaugaaggcaaacaguuauuaaauguuagcuuuuuaacuguaauuaggaacuuagugcauauauauuguuaaacuaaauuugacuugagguuaccucuguauccgcucccuauuuaaagaacugcuaccuaacuuauuccguguacaaacugaaagcuuaauuuaggaguauacuuuuggaacaauuaacugagucccagccagucacagcagcugagguucagucaaucacagggcaacugaucagagcaugcacaaaugaagcaaacuccgagcuguaaccaaucaagcuguuucuguaccuuacuuccauuuucugucuauaaaugcugccugcccaccuuacagagcugaucugucugaaccuccacugguucugaagacuaugugauucucaacucauuuuugcucaaauaaaauuuuuuuuuuuuuucgagacguagucuugcucuguugcccaggcuggagugcaguggcacagucugggcucacugcagccuccaccuccugaguucaagcgacucuccugucucagccucccgaguaucugggaguacagguguucaccacccuuggcuaauuuuuauuuuuauuuuuuaaauuuucaguagagaugggguuucacuauguuggccaggcuggucuugaacuccugaccucagaugauccgcccgccgcggccuuccagaaugcuaggauuauagguguaagcgacugugcccagucuuaaguaaacuccauuaaguuuaauuaguugaaaauuuuucuuuuaacaauauaucugcauguuuuuauacuggaauuugguauauaaggacaaaacuaauaaaaccuaaauggaagccauuucuaaagguaaucuuccugaaacaauucaauguauaucuggaauaacuuuuuuaaaaguuaauuuucaguaccuuuaggcccuauucuuaaauggaaguauuuaagaaaaugaaauuuguuuaaucacuauucugcuauuuugaauuguauuucauuugcauaucgaauagacuaugauacucuaaaucuacuggggaagaauuaauuuauuuuaguggauguacuccaugguauauccuaagugaauaauuuugcuagaauauuuacuaauguaggauuauuaacuuggggauauauuuguacaauccuuucuuguuauuuaagguaguuaugugcuauaaaguugccacaaacacugaguuaucaauuccucaucuguuucuccuaggagaaauacagacuuggguuccuucgagccucuggucacauuuuuugucaaucaguuaauacauaaccuucuuuuauguguguuucuguuuaaagauagcuuauuuaauauacauuguugagucauuaacauugaacuuguagccaaaagcaauguaacuugugcaugaaugaugcuucugggaaaauacguguguuaacacguauucucucuaaggcacaucacaaccuucuugugcuugggagccuuacuuuaucuuuaaaugaugugaaaaauauuucaccacaauauuggcuuaauuuauauuguuuaauaccuguaaguuagguuuuauuaucacuuuggaaagacuaauaugaaauaaucacuuuuacucaagacaguuuucauucugauguuuucugacuuuuagcuguucuaaaacaauuuucagacuaaucaaaguacuucuagaugauaguuucuucaguuugguauuguaaggagaaaaaggaacuaagaaugucuuuguuauacacacaaaccuguguuuuuguuguguuuccaguuuagugcuuucaaauucuugagauuaaaauaauuuggaaaaaauuugagguucagguuuaauguuuaaugagcuuguauuccauuccuauuuaaucaugucuugcagucaggugccacucuuugugcaaauucaccacaaauggcgaagaauguauguaggagaaugucaagguccugguguacgaacugauuucgaaaugguucaucuuagaaaagugccaaaucaguacacucacuuaucaggucugcuggauaucuucaaaucaaagauugugaguugggauugauauugucagucuuaucugagauccagauaaaaguagagauuugaucauuuuauucagcauauagaaacauuucucuauaauauugauaauguaauugcuuagaagaaagcuauaagugacuacauaaauuacuuuguaauuucuaagaaacaaaauauccaauuguauuuuuaguguacucaugcuaaagcaacaacugauuugucuguuuguuuguucagucuguuagcauuuauugacuguguuaucucuucuacuccuuguccucuauugguaauauugccagucuccuaagcuuaauggggcucagguagcugcuuguuugagcauuugaagcauuugacuaugagcuccuuaaggucuaaacacuuuggguucugaauugcauuuuuucccccaaaucuuuauuugauuuaauuuucaagguuaaucuggcuuauauccuaggccugagagcagcagggcuaaaugggacaugcuaaauauauucuuauauucuauaacaacacugucuauagcuauggaggacuugccugugcugcucugugggguuggggggaauggggcugaugagggcuuaaguugaggagcuguuugugaauaccucuagaaaacagagaaagcuagauaaccaauaguggaagggauccucuacuuagagaaauauuacucuuagguuauuaggaugcugauuuaaauuuggaguauguuaagugcuaaacaugacacuaucucacuaucucacaguugauuaauaaacugacaucaugugucgugugauggcuauuagucacauuuggccacuuaagugagauaguggcagcuuuagcacuuaaauauuaaguauauugauuaggauauugauuauauguauauuacaaugaaguauaucgauuauaaauaaauauauuaauuaugauauauaauuauauauguggcauuccugccaaaauguuuaacauacuguaaaucaaaacaugaggaagcaaucacauauuuucaaagugagccauguuuugcaacaguaacuggucaguaucaugauaggcaaaauaaaggcuggaagcaauucagauuuaaggagaaaauggaaccugacagcuaaaugcaacacaugauucuugauuggauccuuuuucaaaacaaaauagccaguaaggacauuauugggacaauugggaugauuuuaauauggacuguauauuagaaaauaguaucaauguuuaauuuauugagugugauaauuguauuauaguuguauagacuaauguccuuguucuuaggaauuacaugcuaaaguauuuaagggugauuuguuaugaugccugccuuuuucagaagauucagccaaaaaaaugucauaugcauaauauguguauguguggcaaaguguuaauaauuaugaacuccgugaaagucauauggguguucauuauacuaguuuuccaaucuuucugaagguuugagaauuuucaaaagaaaaagaauuauaagaaaaaauugcugaaauuucuuuuuaaauagauaacauuuguuagaaagauauuuaggauuagaauuuaaucauaaaaauauguuuuuaauguugaggaccuaaauaguguacugguaggauuauuacuaacuagauaaaucccuuugauauuaaaaaaaaaauaaugcauuuacgagauuaggaaauuagaguaaaagcuuccuuuuaccucucugccugucuccucaaaaugacaacuguuagcaguggcuugugauuaucuccauuagaaaaauuacaggugcuucuauuuuagagaauuccguguauauauguaauuuucuuuucaaaaaccuucugggcucugaagugcuauagguacugcuuaauuccacauauaguuugggaaauuuuugaaaaaggcaaguauuuauuaguaucuucuccauuaguuuuccuuugcucucaccagaagucuucaauuauauuuaaaauuuuuagaucaaguuucuggucacauggaaauaucaauacuuuauuucuucuucuucuucuucuucuucuucuucuucuucuucuucuucugcuucugcuucugcuucugcuucuucugcuucuucuucugcuucuucuucuucuucugcuucuucugcuucuucugcuucuucuucugcuucuucuucuucugcuucuucuucugcuucuucuucugcuucuucuucugcugcuucuucugcuucuucugcuucugcuucuucugcuucugcuucuucuucugcuucugcuucuucugcuucugcuucuucugcuucugcuucuucuucugcuucuucugcuucugcuucuucuucugcuucuucuucuucugcuucuucuucugcuucugcuucuucugcugcuucuucugcuucuucugcuucuucuucuucuucuucuucuuucuucuucuuucuucuucuucuuucuucuucuucuuucuucuucuucuucuuuuuuuguuugagacagagucucacucugucacccaggcugcaguguagggcgugauuacagcucacugcagccucgaccuccuggggucacugacuccucccaccucggccuccugaauauuugggacuauagguguguaucaccacacacagcuaaucuuuguauuuuuuguagagaccagccuguugcucaugcuggucuucaacuccuaggcucaagcaauccgccugcccaaccucccaaagugccaagauaacaggcaugagccaccgcgcugggccuuaguccuucuucuuaagaaaucauuaaugaauaugaucuucagaucuuuuaugucacaucucuuuuuugaagcuagggacuacauugaucuguggaacccaacuuacaucuuggcuauuuauuagcaguaguuaaaaaaaaaaguuuuuaaucaguuuaucucaucaucugacaaaccuaaaacuuacuuuucugauaagaaacaucucucaaaauugauuugagagaauugaacuuaagagcugguuuggguucuuaaguuuaauccucuucugccauaauccucuaaauauuugaaaacuuucauaacuucaucuuuucuuuuucaucuuagacauucuuaguucuugagauguucuuuacauuuuaugguauuauaucaugacuguugauuuggauauuugucucuuuuagaacuacuuuuuuauguuuugggaaauuuaguuuguaggcucauuuugaaugaguuucauuuuaaauuuuuaauguucacucccauccauccucucuagugauucuguaguuuuaugguuacucccuaccugcagaauauuucagaauuaggucuuaaaauaguguuuggagucucuugcucuguaguaauguuggggauuuugauaacuggucuuagaaucuuggguuguuugcucaccacaugugggugaggguuuuuuccccucacacaauaaccuccagucccauaccuuccgauaaagccauugugccaagcaggagugacaugucccagugucuggcuuaagcagagaaucuugcaaugcccucacacuggacugagcccuuuugguuucauccuagguugucagugccgccuuccacaccucaaggcaugugccuugaaccccacuuauccuccaggguccacaaagauauuuccaucauuuuucauccuaauccuuccuuccuuccucccucccucccucccucccucccuuccuuccuuccuucuguccuuauuuuuuugagacagggcuucacucugucacccaggcuggagugcaguggcacgaucuuggcucacugcaaccucugccucccgggaucaagcgauucuccugccucagccucccaaguagcugagacuacaggcgcgcaccacuacugcccggcuaauuuuuguauuuuuauuagaaaugggguuucaccauguuggccaggcuggucuugaacuccugauuucaaaugauccacccgccuuggccucccaaagugcugggauuacaggcgugagccacugcgcuuggccauaauuauuucuuuucuggguaucuguuuuuguauuuaucugugugacuggaucagagguuaugugucaaaguggccuuguuauggcuucuagaacauuugcuccuuauuauaggugaaugcucauuugauaucuggacaugacuaaaaaguugauauacugaccagccaaaaucucaccuugcuguugggcacaggagcccaaaacugaauuagguuuuuugggagcagcugucuacuauugugacuucaaauugaguuuguguucuuaaagcuacuagugacauuuauagaugcugcugcugagcuaaauguaaaugucauguauuccuuugcuacucaaaguguagucuccugaacagcagcaucuggaaacugguuagauaugcagaagaguauugaaucugcauuucacaaguucccuaggugauuccuaugcauauuuaaguccuauuuuauauuaguuuagauuaagcauuaugaagggaagcugaggucauaggauguuuaaaugauaguauuaaguuuugugauuuuuagugaauugacagauaaaucuaaguuuucuuuuguuagcugauucauuaaucuauuuugugugagugaucauucauuucucuuagucugaaauuuugguuaaauauucaaggguggcuuuaauuugaguuuauuuucauuuaaaagaaaagacauccucuccccaaaccaagucuuaugcuuuauaauacuuuuacuuauuugaaaaaugaaucaccuuuuuuucacauuuaauaugucugaagugaauaguaagaaaugguauuuuaugauuaaaauaguaaaagauacuuuaaagagcauuuugcuuaauagaauguaauaucucuuuuucuaauagcaguuuaaacagcuuuauuuuaaagcuauggcauuguuuuugaaacuuuuuuuuagcuacaucaaaugaaaacauuuguggaagcaguaugcagaaauuauggaaauccuucuguacacacaaauauguggacaaaaauacagugauucuuuggaaaguuuacuuuuccauuuuuuaaaauucagucucacaauugccacugcuguuccuuacuaugggaucuuuccuccuguucaucccugauccaccucuugagcuuuuggacugugagaauuucuucugugaaaaggauuuccuaaauuuugcaucuuuggcucuaaugacuucggugacuuauuuuuccuuuggaauggcuagaauaucauguuuuuaauaacuagaauaugcacacuauuguuuaacacuagaaucugaaaauccagguuucauaaagguaguauuaauccauuccauaaguuugaaauuuugauguugaauuaauaugaaaaggguaccagcauuuacacgguauugucuuugcauguauuuccuagggauguccuuuaacuccauugccuccaguuaguauugcuauucgauuuaccuauguacuucaagauuggcagcaguauuuuuggccucagcaaccuccaggugagaucauuuagaacuauauuuaacuuacugaauauaaauggaaaagaagauacauucagaaauuaaaauuacuuaacaagaguuucaaguguuuuacauuagaaauauuugugauucauuuuaaauguaauauuauugcuuucauugcccuuauuuuuuuucucuugaagaaaaacuguagguuuucuagagauaguauuacucuauauuugacaaucugucuuugaaagccuuauuuauaaggcaccccuugcuguggcacaucaugugccauaaauuacuauguagcgaaugauuaacaugucuguuuuuagacuauuaugagagaagagcuguucucagcucacccucauaaacugagaacacucaugcaaaaagcuuuaaagagaguaauguuucaagaaagggggcuaaacaaggaaagcagagaagaaaaauauauguaggggaaaaauaauaauuaacuuguauguuauagaaauauaaucaaaaucaauuugccugcuuacccuugauaaacagauucauucaacaauuauuaauuauuaaccugagacuaggcggugcuaagacagcaauaugagcaacacauuaccuaaguucuagaaaagcucaguuucauggacauauauccuaaauaauauuuugauuccuggguguuucuuucacauguuugauuauauuaaagcacaucuaauaaggaauauaauacaaacuuuuaaaauauaagaauuuuacuagccugaaaacguuuuuuaaucuacuucuccuaaagagaaauaaaauaaacuaauauucuuuacuguuuauuuuuguuccaaauaguuggcuauuuauaggauugaaaaaauugguaggcaugagaugauauaaaaauuaauauaauacaggccgggcacggugacucacaccuguaauccuagcccuuugggaggccaaggcaggcagaucaccugaggucgggaguucacgaccaaccuggccaacauggugaaaccuugucucuacuaaaaauacaaaaauuagccaggugcaguggcaggagccuauaaucccagcuacucuggaggcugaggcaggagaaucccuugaaccugggaggcggagguugcagugagcugacauugcgccacuguacuccagccugggugacagagugagacccugucucaaaaaaaaaagaaaaaaaauuaauguaauauauccuuagcuuuuggcaguuauauguacuacuacuauuuuauuuuauauaccacaaaauaauuuucaacucuaauguacacuaaaaggaccguaucuagacuacaacagagaaauaaaagcuaagcuuuagauuuauaucagaagaaacacucaaauguuuguguugguaguuuuaguucccagguaacaguacccacuggacaauuuacagucuaugucugguuagaaguuuccauucuuaucuuccuuuuuuuuccuuccaaggcuacucucuuauaaagcaguuuuaaagauuuccuaagguaguguggucugcucgugaucugugaagaagcccaagaguuagaaccuuagcauuauaagauugccaauaaggucuuuguuaaucuucuauugucagguuuuuaaaauggggauuaaaaauauuaaccuucucccucaguagauugaaagccauauaaauucuuaacauuuuccuuuauaagggggaagggacugaacauauaauauggaugagauacugugcuuuucauauuuuauaucccauuuuguauaauuuucacuuaccugugagacaauuauuauuaucuuuuguuuuguuuuguuuuguuuuuugagacagagucuugcuuugucacccaggcuggagugcaguggcaugaucuuggcucacugcaaccucugccuccuggguucaagcgauucucuugccucagccucagccuccugagucucugggacuacagguaugcaccaccacgccuggcuaauuuuuguauuuuuuaguagauaugggguuucaccauguuggccaggcuggucucgaacuccugaccucaggugauccacccuccccagcuucccaaagugcuggaauuacagguuugagccaccgugcccagcccaagacaaguauugucuuucuuagagauguaaguuucuuaacccauguaacuggcuuaaagucauauggucaccaagugauaaaguuugcauacaaacacuagucaaacuccaaguccgaugugcuuuucauuccacgaguugcuucucccuuuuuaauucagcuaaaacuuuuguacaguuauauuuuaguaauaauuuuuaauuuacuaauuauaaaaaugugcuuguaauuuugaagcuuuuacaaacucacuuguaacaaugcuagucauugugaucuuucuuauuauaagcauucuuuaguuggaaaaauggaauugacuugagaaaauuuacugaaucaaguaauugauucauauuugaugacuaauuuuaaucauuuacuuaggauguagauaaauaucagaugugauuuuagcaaauaugggaaguuuuguuaacucaguaggcuuuaauuucaggaaauccuaguauagugugaauaauuaaauaucacaauuuguauuauuucaaagagaaaaaaauccuuuugaugccuuuuagaaaugcuuauuacuuccucaggagagauagaacuaagggaaugauuuacccucuaaguucucuuccagucuaguaugccauucguaauggaaaggagguucuuuucugaucuuuauauauuuccauuuacuaucaaccaaaauauaauguuauuaaugacgacaaauauacuaauuuccuauucagaaauuacugauagcaaaacugauuaauguaguuggugauuuuuaaauacuuggauacucuuuuuggguuauacuaauuacauucuuuaaaaaugcaaaaaaauguacagaaauaauauucucuugaguaauauuuaaggaauauuucagaagggcaaaauuuagaauaccuggccugaaugaaauacuggauaaauaggaaauaagugugcccuuuuacuguaacauucucuggggaagucaaauauuguuagacuacauaugcuguaaguuggucuaacuugcuaacuugcuacauguguucucuugcagacacuuuuaaagcuaugauauuccaaagggcuuaacuagauuagacucuucuuuauuuuuucccaaaugauggaaaaauauuucuuuuguuuagacauagaugcccuuguaggaggagaaguuggaggcuuggaguuuggcaaguuaccauuuggugccugcgaagauccuauuaggugagaauuucaaccugucauuugaauugugggaauauuuuacuuugaauuuauauugauauugauuucacugugcuuuaugaugcuauagcuugcugggaugaauguaguacuggaaauaaagaaagacguacaccugggcugggcacaggcucaugccuguaauccuagcgcucugggaggcugcggugggcagccccugaggucaggaguucgagaacagccugaccaacguggcgaaaccccaucucuacuaaagaaugucaaaauuaacugggugugguugcgcacaccuguaaucccagcuacucaagagguuaaggcacaagaaucacuugaacccggcaggcagagguugcagugagcuaagaucacgccauugcacuccaaccugggcaacagagcaagacuccgucucaaaaaaagaaagaaagaccuacacuugcuuuauuuauuuuauaauuuuacaugaaaacuuucugagauuugauauucaucuauaacucagcaaacuguguccuuugccaaaucuggccauuagccuauuuuuguauggccagugaagucaggaugguguuuacauuuuuaaagguuaugaaagaaaaaaaauaaaauagagacugugcaugguucacaaaaccuaaaauauuuacucucuggcucuuuauagaaaauguuugccaacuccugauuuauaacauuuuucaaacuugagauauaauuuaccugccauaaaauucacuauuuaaaaguguacaauucaaugguauuuuaauauuuacagagcugugcaaccaucauaaucaucuaauuccagaacauuuucauaaccuuaaaaagaaauucuucaccucuuagccaucauuuccccuuagucuucucagcccuccggcucuaggcaaacacugauauacuuucugucucuuuggauuuaccuauucuggacauuucuuauaaauggaaucauauaacauguggcuuucuuugugucugacuuauuuuaauuagcauguuuucaagguuuguccauguuguagcaugaaucaguacaguaguacccccuuauccacagcugguauguugcaagauccccaguggaugacugaaaacauggauaguaccacacacuaaauauuuuuccugugcauacagauaaguaguaaaauuuaauuuauaaauuuggcacaguaagauuuccaggugauguaauacaaaauaaauaaauaaauguaaaugaggcauaguaagagauugacaauaauaacuaauaauaacauagaacagcuauaacaauauaccuuaaugaaaguuaugugaaugugaucugucucucucaauauaucucauuguacuaugcacacucuucuugugaucacucugaucaccaagacaguuacuaagugacuaacagggcagguagcauagacaguguagguacacuagacaaagggaugauucaccuaauggggugggauggcacaagauuucaucaugcuacucagaacaacaugcaacuuuaaauuuauggauuuuuuuucuggaauuuuucacuuaauauuuucagacugcaguugauuuaggguaacugaagcugcagaaagugaagcuguggauaaggaggaacuaauguacuucugugcuuuuuauggcuguaaauauaccauuguauggauaugccacauuuuguuuauccauucauuaguugguggguuauuuaugcuuuuuggcuauuauguauaaugagaugaauguuugcaaaacauuaacuucauaaggaugugcuaccauuugcuaaauaaguuguuuccaguauguuguauuauaaauaaugccacuguaacauacuuuuauuuccuugguauaguuuucuagaaguauuaaauauaauugcugagucaguauuaaagcuuuuggguauauuuuauguuuuuuagugaacuccauuuagcuacuacauggccucaucugaccgaagggaucauuguggauaaugauguuuauucguaaguauguuaagaguaguaguacacugagauuaaaaaacuucaguagaauaacucucaaauugcuaguaauuuuuauaugcauuuuuuauuauuuuguuuugauuuuaguguucccuuuuguguuuuauugucuaaggacuuugauuucuuaugauguuauuuuuuaaaaacuuauccaaauggcuccauguaucuggauaagaguaaguuuaagggaggcuaaauggauugcuuguccuucuauguuuucauuagacugcauuuuaauaaguucaugaaucuugcagauugucauaauuaggauuuuauauuuauugguuugcauuuuagugauuuggauccuauucaagcuccacauuggucuguuagaguucgaaaagcugagaauccucaguguuugcuagguaagguauauuaugcuccuuuccugaaauacugcugaucugccuaacuuccaaaucggagacacugcauacauucuuuauacuuugucaccucuucaguuaacaccauguaggaaaaaaaucauugccaauagcagugaauccuuuuuugaauagugccagcaaauucuccauuauuuucucauuaucucagcuuuauguuucugaugcuuuuauuuacuuuuuuuuauuuauuuuuuauuuuuugagacggagucucugucaggcuggagugcaguggcaugucucggcucacugcaaccucugccucccggguucaagugauucuccucccucagccucccgaguagcugggacuacagacgugugccaccaugccuggcuaauuuuuuguauuuuuaguagagacgggguuucaccguguuauccaggauagucuugaucuccugaccucgugauccgcccgccucggccucccaaagugcugagauuacaggcaugagccaccgcgcggccuuaagaugcuuuuucuuuuuuuuuuuuuuuuccggaugcuuuuauguuacucccuuuccuuccuccuguggcauagucugcaucuucuauuucuguuauugaagcccuuuuugccuuuuguugccccucuagacguguguuaucugaagagcacuguuuuguuuguuuguuuguuuguuuguuuguuuugagagggagucucacccugucgcccaggcuggagugcaguggcgcgaucucggcucacuguaagcuccgccucccggguucacgccauucuccugcuucagccuccggaguagcugggacuauaggcgcccgccaccacgcccuuuaauuuuuuguguuuuuaguagagacgggguuucaccguguuagccaggauggucucgaucuccugaccucaugauccgcccgccucggccucccaaggugcugggauuacagacgugagccgccgcacccgaccugaagagcacuguuuuugacggugcgcuuuagagcccuucuauagaguugugucacaucugcagccuauuuucugauaugggaaaagaaaugugaauaaucuuauacaccucacaagguuauuugagggaucaagugaaauaacacaaauggaaguacuuugaaaaauauuaauugcuauucagauaauauuauugugucuuaugucugggauucguccccuucccuuuuuuuagguguaucucuuccaugaagucuuuugaacccaucuccucagugugccuugucaucuuuuuccuccuuauauuuaguacacaugaaaauauuuucuccuuuucuuuauguucauccaugcuaccuuaacucucuaucacuugauauauuaccauuuaacugauggaguuaccaaagauuuauuaugacaguaaugaugcauuucucuaaagcauuguuuucuugggcucuuuaucauucauaugcuauuugucaaaugcugauuaguagcugccauuugugcuaacuauauaauagugaauacaaagauguauaagguauaaguccaccauuggugaauuugucuaggguguuagggcaacaguauagggucaaugucaagaguauuacaguuggacagaccucaguucaaauccuggauucaccagguuggucaaguuucuuaaucuuuuuaagccccagaguccucauaaauaaaauagagauaacacuaguacuuacuucauaggguuauugggaggaucaaaugagauuauguaccuguauguauguguauauaucacuuuuaacagugccuuuguuauaguaaaugaacaguaaaugguuucuguuguuuaaucguugaauuacuacauauuauguuuacguacuaaguugcuucuuaguaacauuauuauuccucaucuuguuacuguaugguaauugcugaggaccuuagaauugaaaguauucucauuuuaguuuaacguuccaugaucuuacccuaccucuuuuaauauuuuguaugacuagauuauagacuuuuccuaccuuucugaagaagccucaaaaaaguuauggguuaauucagaauuaguuggugaauuauaaaauuuagauguacuugauguaucuuaguacugauaguauuuguuaagcauucauuuauuuguguaaacauuguagcuguucagaagauucaaaucgcuuuaccucuguuuauaauaugacagacagcugggugcaauggcucaugccuauaaucccagcauuuugagaggucgaggcagguggauugcuugagcccgggaguuugaguccagccuuggcaacauggcaaaaccucgucucuacaaaaaauacaaaaauuagcugggcauggugaugcacacauguagucccagccuacccaggaggcugaggugggaggaucaccugagccuaggaggucaaggcugcagugagccaugaucgugccacugcacuccagcuugggcgacagaguaagacccugucucaaaaauaauaguaauaaugggccgggcgcggugacucacacuuguaaucccagcacuuugggaggcagaggcgggcggaccaugaggucaggagaucgagaccauccuggcuaacacagugaaaccccgucucuacuaaaaauacaaaaaauuagccaggcgugguugugggugccuguagucccagcuacuugggaggcugaggcaggagaauggcgugaaccugggagguggagcuugcagugagccgagauugcgccacugcacuccagccugggcgacagagcgagacucugucucaaaaaaaaaaaaauaaaauaaauaaaaaauaauaguaauaaugacggaaagaauaccauuaauauguagcagaaacugaaauaucuuuauccuacaugauuuccuaaucuucuagaaacaugucuuuagcguuucuucuuaauuuuauuaauggauuuagauucuaguaguguagcaguuggggaaagauuacuacauacuuagaguaaguucuuguuacuuacauaacuuaaugacaaauggauacugugucucauugaggcauauaguaaguacuauuagguacaguuauuuuuuucuuuccuucuagauggaauucuaaggaaaagcuuuuuaaauauccugggacauggagagaaagaaaagaacaaggcuaccuuugauauaggauuaauuuuuguuuuuuucaauggaaaaacugaaugguuuuacuuucuaccauaucuuaguuaauagcuuuuguggaaagauguacuuuaauuuauaggacugauuuuuuuuuuuuucaguuaagugucaaaaauaacuuuuuuuccuacauaggugauuuugucacugaauuuuuuaaaauuugccgucgaaaggagucaacugaugagauucuuggacgaucugcauuugaggaagaaggcaaagguaaccuacauuuuuuuuuaacauuacuuucaaaugucuuacuguuuuuccuuggcacauuuuucagcaacuuuucaucuguuuucucauuuugaauuaaguuggauaaucaaguuuugauggacuagacagcuacaguuccuuuccaggcuguacccagugcuuguuaagacauuaaaggcauuuaauaaguucuuuccaccaaaaauguaaaauauuuugaaaagcagaguuuuagagguuaaauuuugaagucuccuagggagaaauaauuugugugacaccauugucacucaugcuugcacauaaagcugaacauguauauuaauauuuuauaauuccaagaccauguaacacuaguaaaaagaaugaguaaaauauucuauauaaucaucaauuuguucaucacuuucaccugcugagguuggugauauaauuuauauuuauuucuguucuuuuuauagaaacugcugauauaacucaugcuuugucaaaauugacagagccggcaucaguuccaauucauaaauuaucaguuucaaauaugguacacacugcaaagaagaaaauccgaaaacacagagguguagaggagucaccgcuaaauaaugauguucuuaauacuauucuccugguaacuaaauguucugucuuuauaggucuauaugcagaaucauuuauucauuauauagccaguuccuuuuaugugguaggcagugaccuuggaauauacaaugaguaaaacaguuaccacauuuagaaaauuccuacuaguuuaguggugagaaggaaaguaaauaguaguugugauaccauguugcaugugagaaaucuggcaagggggcugugagagcacagcaggggugcauuugucucugucugggcagugggaaucagggaaggcuucaugaagagggacauuugagcugaaucuugaugaaaagaaggcuuuagaagcagaggaauagcagagguucgagagcauguugaacgguugauauuuuguagggugcuucccagaccaugaccaggguugaggcuggagaaguagcagguaaccugccaugcugaagcacuggcuuuuaucuugcaguuuaaguagaagaucaacaugauuagaauuuuuuuauuuuuuauuuuauuuauuuauuuuuuuugagacgaagucucgcucugucacccagacuggagugcaguggugcaucucggcucacugcaaccuccaccuccuggguucaagcaauucuccugccucagccucccuaguagcugggacuacagucacgugccaccaugccuggcuaauuuuuuuguauuuuuuuuuaguagagauaggguuucaccguguuagccaggauggucucgaucuccugaccucguaauccgcccgccucggccucccaaacugcugggauuacaggcgugagccaccgcaccuggccccggaaguauauuuuugaaggauugcuuugacaacaguugagagaaagcuuuuagugagaaugagagggagaugaauagagagcuaagguggcuccuagguauaacagaguggaauggccccagccugggggccauccacaccaugguuuaaugucugcaugacuuacugcaugacuuugaauaagucacuucaguuuccucaucuagaaaauauggcuaacaaaaccuugcgagauuguugugaggauuaaaggaucuucugugacacugccuggcauauaugggucuuugauaaaugauagcuauucuuaacuguaauugugguuaaaaucauacucccggaaauuugugcauuaagacaaucuugggaaaaaccuucaagaaaaguguugaaaagaaaacuggaaacuuaauguuaaucuuauccccugccauuuaucugaacaaaacucuuagccaacuuuuuagcuuguacaucguaagauguagguagugauacuuagcucaaacaguuguaugagaauaggauaaugcugguaauugugccuuauggcacuuggcacauaguaguucaucuaauuuuuaaaagucuauuggacauguucuauaauguguggcaaaguauacauaguaagagggauuacuaaucagcaguaccacaaaacaauugagaggaacagugauaaaaggacuguaaauaaaugucuauagagagccuccuucuuaagacuguauucuuaaaagaauguuauucaaaucauguagcucaguugucauguacacuggauuuuuuuuugaccacucguacauguacauauaaacagaaaccacauggaaaagguacauugguuauuauagguuuagacugcuuccuacuuuccagggguaucauaaaauaaagcugugggucuugaauaucaucucuuaguagucuauauaugaaagccuguggaugauguaacucuucagauccucaugaguacaugaguguuuuuaaauugucuuuugugguuuuguuuuuuagauaguaguaacacuaaaaaaauguaauggccuugggugagcaugaagucacagugaugagauuuugcuuuugcaccuuucagcuuacagaaucaagugauuacuuuuaagaaaaaaauucuaauuucuaaaauuggcuagucacugaaaccuuguauauuuucaaagaaaaauagaaaaaauuugagaguguagaacaaacuggccaauacaacuggaacauuucuauuguuagagcagcaaaaccauuaaaaaguuaaauaaugucuauaugaguuauaaaaaucaacaaaauaggaaauguggucuaaaaugugauuauuuuuuuccuuuccuucaaguucuuauucccugaugcuguuucugagaaaccauuagauggaacuacuucaacagauaauaauaauccuccaucagagagugaagacuauguaaguugauguggaguucaauguuaaaauguuuuaaaugcacugaauuucuagagguucuauauauuucuaguuuaauagcuuacuauauuuuuauuuuaaaaaucaccuugggaauuuuggauggcagaucgugguuuccacuuagauaacuagcacagauacauauuuuggguagcaagaauuuuucuggaaacaaugaaaaaauagcacaaauauacucuacacagcuguaggauuucccucauuguagaguuuuggugaaaucauuaaauuuguguuucucagcagauucuuuuugauauuuuaaaacuaguuagugaauggacaacucuuuaaugaaguaaaauguguaaaauuagguaaaauuuucauggucucuuugucuagucuuugaaaaauuaagaaguugaagaauuuaaaugacaaguguagauauauaucaaccuuuacaguaguuauuguugagaaguagauuugaugaggugagagaaaaaagcaaaggcuuuuuacauuuucaguuuagauaguuaugauuuuuguuuuuucagacgugcucauuuuuguaauuaaaagauuuuuaaaacaacacaugaaauuuggaauacuuccuaaauauuccacagaagaaauugaaagcuguaacuuuagcuucauuaaacuauagcuuuaucuuuuuuaaucuuaguagaaaucuugaaaaugugggacuuccuaagaauaguuuaugcaguaguguauuagacauuugauaaugccuaguuuaggugggauagguuaauuuuacaauuaaaaucucucccuacgaccuuuucaguuauauguguaaaauauuuugguaacaaguuugcuuuguuucuauuuuguuaaauuuagaaucucuacaaucaguucaagucugcaccaucugacaguuuaacauacaaacuggcuuugugucucuguaugaucaauuuuuaccauggaggguugaaaggaguggcacaccucuggcaggaauuuguucuugaaaugcguuuccgaugggaaaacaacuuucugauuccaggguaauaauuucaauuuucaauuguuuggauacgauuuuguuuguuagcagacauuugacuuuugaccuauuuuuucccccuucuaggaagucugcccuaagaaaguggcaagaagcuuagacaugauuuauguucagagguguucacugcagcaaauuuauuaauauaauagaaaaaaaggcaaaaccuaaauaucaaacauaaaagaauaguuaaauaaauuauacuguaucucuacaauagaaaauuagauugauuacaguuuuucccccaauaaucuuuaauaacagauguucauauuguuucuaauaaaguagaauauuuuaaugcauauacaaaguacuuuuaauuauguugcuauauuuguacaggaaaaauauuauaaauacugugaaaugcuaucaguuuuucccagugugaaauuauacuuuuauuuuguucuuuauacuuuuaugcauuuucaaagucuuuuguaauaaaccuguuuuuuguaauugacauuuuacuuaaucaaacagaacauuuucauuagcacauagguugauauugcauaguuuagugcucaucuacccaugcuaugauaggagaaucaugauuuugagcaauauaaaaugauuacugauccaaaaacauuuauaucauuugccaaucucugcuuagcuggauucucucuugguuuuagacaguccgcucuggaacauuuuacagacccagaagcauguugaauaugagggagugccucuggcugauugcugggaaccuaguagucuagaggaaccuagaacuagagacaguccaagguccuauugaaauacagguggagaucuugguuuuuauagugagaauccacuguaagaauuuaguacugaauacacaaacugauuuauuuuguauggugugaaauacuguaugcuaguacuuccuggaguggguucaggggcuuuuucucauuuugaguuuuuguuagccugaaaacuaucacuaauuugcuguuauguuuugaaauaucuauuauauuugcuauuggugauuuguggacaaggaguauaaaauaaauuuucaucuuuuaauucuaugugcucccccucuggaauucacuuaccuuaccuguggaaaucuaguuuugauuucuuaucaauauagcuaaaaauuaugguaguauagaaaauaaucauaucugaagcaauuuuacuaaaacuaagcuuucuuuucuccuuacuuuauuugauagauuagcaaguggacccccagaucugagguguuguuuacugcaucagaaacuacagguaaagauuucucaaugacauggauaaauguggucuugauuuaaucagauuauucuaauacuaaauguaauaauggguuacaugcuguucucauggugcugcuguagguugccuauagucaguagucacugcaauucacaagguccugagaaguggagagugaaaauuaaauauucaagcaguagguagauuuuuauuuuucuguaacuaauucaacuauaaauguuauuucucuuuucuuaagauguuaaauuguuguauugaaagaaagaaggcacgugaugaggggaaaaagacaagugcuucagaugucacuaauauauauccaggggaugcuggaaaagcaggagaccaguuggugccagauaaucuaaaagaaacagauaaggaaaagggagagguaggaaaaucuugggauuccuggagugacagcgaagaagaauuuuuugaaugccuaagugauacugaagaacuuaaaggaaauggacaagagaguggcaagaaaggaggaccuaaggagauggcaaauuuaaggccggaaggacggcucuaucagcaugggaaacuuacacugcugcauaauggagaaccucucuacauuccaguaacccagguaggaugcacuaguucuuuccauuuuaauuuauuuugugguuuauauaacuucauccuaguagaagauagugcuuugaguaaggaaaauuauccaaaaagucuauguuuaggccagaugcgguggcuuacgccuguaaucccagcacuuugggaggcugaggugggcagaucaccugaggucaggaguucaagauaagucuggccaacauggugaaacccugucucuacuaaaaguacaaaaauuagcugggcacaguggcgcacaccuguaguuccagcuacuggggaggcugaggcaggagaaucauuugaacccagcagugggagguugcagugagccgagauugcaccacugcacuccagccugggcaacagagcaagacucuugucucaaaagaaaaaaaaaguguuuauguuuaaagauaaagauauagacuguuuaaagaaacuaaagguaaggauuucccaaugacauagauaaauguggucuugauuuaaucaaggaccuuuaaaagauuggacaaagucuauguuuaaagauuaaagaaaucuaaauaaacuuuuggggcuuuuagguuugccauuucuguaauugagaaauguuuugaaguuuaaguagaucacgucaucauauauaaggugauuuauaaacugagcagugaaugcucagauguuuaaaaaagaaaauccaacugcacuuauguauguuuuuguuuaacuuguggacaaagacuuauggauaggugcaaaaaauaaauccucuuuugcaacccagaacucauuguucaguaugaguuuugauacauauaagaagggauauuaugauaccugagacaguuaacugaugggaauauugauagccauaaagguuggucccagaccaggcacaauggcucaagccugcaagccccacaccaaggugggaguauugcuugaagccaggaguucaagaccagccuguauaagaaaguaacaaacaccucaucuccacaaaaauuuaaaaauuagcugaguauuggggcaugugucuguaguugcagcuacucaggaagaggaggcugaggcaagaguauugagcccaggaguuggaggcugcacugagcuuugaugacaccacuguacuccagccuggguaacaaagacagacccugucucuuaauuaaaaaagauugauucuaggacuguggaagagauaguuaaacagcaugggauaugaaggaaauccucagcaguauuaauuuugcauuccaauuucauguugacuugauaccuacgauggcuuuuuguuuuaaaggcuuuuaucuugagaacaugaugucuguaguuaaagguauuggcguauuccacacaucuguacuauucuugaguaugaucgcuuagggugucaaauugagaaccaggcagauccaccaccuacaguaaaaaggacccuaaaguaaauugguugaagaaguuagaucccaaagauucuuggugaauuuugaagucuucaucaguauauccauauuaaaaggagaugacagaagccaaaauaaaagaauuaugggcuaacaggacagcuggauuaaaauaagcaucaguuucauuaaaaagggcuaacuugaagauaaaucuuuugacuccagcucuuuagaggaucugaagugaccuugauggacaguggaagaaaucacaacauggaauuacuugaacaaaaauuuauugacuuaaagaaaaagaaaaaauccaaaaauauauagagagaacaaaaguaaauauccuucaauuauaugauuagcuuuuaucuguucaaaaauaguuugaagucauauacaccauuaggauguagaacagcaauaacucaacaacaacagcagcaauaguuguuuuuaaggguuuuguuuuguuuuuuuuuuguuguuuuuuuuuugacacagagucucucuuugucacccaggugggagugcaguggcaugacuguagcuuacugcagccuugaccuccugggaucaagugauccucccaccgcagcuucucaaguagcuggaacuacaggugcaugccaccaugccuggcuaauuuuucgugguuuuuauagaggugggguuuugcccuguuguccaggcuugucuuaaauuccugaacucaagccaucugccugccucagccucccaaagugcuaggauuacagacaugauccacugcacccggccugaaaacauucuauugugaaaauuguaaucuaguaaaaaugaaagaggcucaacgccuguaaucccaacacuuugggaggccgaggugggguuggauugcuugagcccaggaauucaagaccagccugggcaacaugguaaacccuauuucuaccaaaaaaaaaaaaaaaaaaauuagccgacugggguagcguacaccuguagucccagcuacucgggaggcugagguagaagaaucaauugagcccgggagguuaaggcugcagugagcuaugauugugucacuguucuccagccugggcaacagagcaagacccugucucaaaaaaauaaaaagugaaagccaccauccacuaauuuugacuugcauuccuugaaguaacuaacaaguauuauugguuuggguuauauuucuuauaacuguuucucugcauugauguauaauacauauauguguguacauauuaauacaugguuuuauggauuuuuuuuuuuuuuuggagacaggaucucauucuguugcauaggcuggaaugcaguggcaugaucauggcucacugcagccuugacuugcugggcucaagugauccucugaccuuagccuccuagguagcugggacuacaagugcucaccaccaugccaggcugauuuuuucacuuuuaaaauuuuuguaaagauggagucuugcuauguugcccaagcugguccuaaacuccugaccucaagcaauccucuguuucggccucccaaagugcugggauuauaggcaugagccacugugcccagccucaauuucuuauaaacaauugguauuaccaaccauauaaauuuuuguuaacaugauggucaaaaguaguaucucaguguuuuagauuguauuuuucugaauuuucaugaaccugagcaucuuuuaauauguucguuagccguccuuuccugugaaucgccuaugauuuuucuuuuagguugcuccccuguucuuauugauucauaugaauucuucauauuuuagaugugaaucuacaguuauauauauuguauauguuuucugcuagucauuuuaaaaacauauguucauguauuuacuuaauuauugaguuauaacuuaauacaauaaaguguacagaucuuggcugggcaugguagcucaugccuguaaucccagcacuuugggaggccaaggugggcagauugcuuaagcucaaaaguucaagaccagccugaggaacaugacaaaaccccgucucuacaaaaaauacagaaauuagccgagcguggugguguauggcuguagacccagcuacuugggaggcucaggugggaggauggcuuggguccgggaggcagagguugcagugaacuaugauugcaccauugcacuccagccugggcaacagagcaagacccugucucaaaaauuaaaaaaaaaaaaaauaaaaagugcacaaaucuuuaguauacugcuuggugaauuuuuucauauugauacaugcauauaacuacuucccagaucaagauacagaaaauucccaucauccuagaacagugcugauaaauaaaacuuucugugaagauggaaauucucuacauucucugucuuucccauucaauacaauagccauuauccaaauguaacuacugagugcuugaaauguggcuaauguuucuaaggaauuaaauuuuuaauuuuaauuuauuuaaauuaaauagccagauguauuggauagugaagcccaggauuccccuccagcaacucuuucucuuaacuuuugucaccauagguuagcuuugucaguuuuugaaccuuuuaaauggcaugcuuugcuuacucuuuuguauauaaauguaaucauacauuguguacucuuucguuguauaaucauacauuauauaccauugagcuuuuuuauuuaccgauuuugagagucauccuuguuguugcaggcuucaguguuugugcauguguuauuaguauucuauucuaugaauuugucacaauuuguuuauccauucacccguugauggguauuuggguuguuuucacuuugggcuaauaugaauaaagcugcugugaacauucuuguuucuuuugguagacaaaggcacucauuuucuuuuggauauauuccuaagaguagaguuauugggcuauauggugcaaauauguuuuggcuuuaguagaucuaucuaaauagucugucuaagugguugaacuaguuaaccuucucaccaacaauuuauaguaguauaguuauucuacagaauccuccccauuugauguguucucaagaccacucccagguuuagugauuuucuaggaagacucauaagacuuagcccauaaucaugcucguggcuauaauuuauuacaagaagaucagcaaagagaaaaggcacaugggaugaaguuugaaagagaugagguuuaagcuuccaaaaagcuuccccuacuguaguuacacagagugcacuuaauuccuguugcaacaaauugugaccacaugugugaaauguugucuucccugggaagcuuguuagaggcacagcagugggaguuaucaguaggggcuggucaaguaggcauccuuugcuuaggcauaggguuaaccauaccaaaaucuagacucccauaaagaaaguagguguuuagcauaaaccauauuauuugcacaaaguguuuaggcauagugagucauuuuuaucaguucugggaauggugggaaccuucucaaaauccagguucucagcugccagccaagggccaacuuucaagcaggccuuucuaagaauggcagucucagaccugcaauauuaacucuuuucugcacacuugauauuuuuggucauuuuaauuuuugccuuucugaaggguaggagguaggaucuugugguuuuacauuuuccugaagcauauauauauuuauugcccauuugucuaucuucuuggugaaaagccuguucaaggccuuugccuauuuuuuucuuaaagcaguugucuuuuuuuuucuuauuacuuuauaggaauucuucauauauucuggauaugaguccuuagauacuuguauugcaaauauuuuguugcuuaucuauucacuuacuucuuuuuuuuuuuuuuuugagacagucucacucugucauccaggcuggagugcagugguguggucucggcucacugcagccugagucuuccggguucaagcgauucuccugccucagccucccgaguagcugggacuacaggagugugccaccauaccuggcuaauuuuuuguauuuuuaguagagaugggguuucacuauguuggccaggcuggucucgaacuccugaccucgugaucugccugucugggccucccaaagugcugggauuauaggugugagccaccgcgccuggccuguucacuuucuuaaugaugccuuggguugaagagguguucuuaauuuuaauacagucucaucuauccuuguuuuucuuaugugguuagugcuuuuuguguucugcuuaagaacucuuuaccaaguacugaagauauuuucuuuucuuuuggaagcuuuauuguuuuaccuauaucauuuguuugugacccaccucaaauuaauuguuugguaagaggaacagguuaagauucucuuuucucuauagggagauugaauuguuccaccaccacuguugaaaagaucugccuuuucccauugaguggcagugauaucuuugauguaaaucaagcaacuguauguguuuuggucuauuucuggacuauuuauucuguuccguuggucucugucgugugccaguaauguacugucaucauuauuguagcuuuauaauaagucuaucugguaguguaaaucuucuaacuuuguuacucuucaacauuaucuuagcuauucuagguccuuugcauuguuauaucaauuugagaaucagcuuguuaauuuuuauaaacaaacacauauucaaaaucuugcugggauuuuaauucagauugcauugaauuuguagaucaauuuauggagaauugacaucuuaauauugaguccauuaaauaucuucaauuuuauuuaaaguuucuguucauuuaucucauuaguguuuuaguuuucaauguagaggucuuacauaucuuucauuagauauauuuccaagguauuuguaauuucuuaaaugguuuuauaaaugguauuuuaaaaguucauuuuccaauuuuuuucccuugauagauauaaacaguugauuuuuauauauugaccuuggauauaacaaucuugcuacauugacuuauuaguaguuuagagauuauuuggaguuuucuacauacacaaucaugucgucuuuuaguaaagaugauuugaauucugauuuugcaaucuuuaugcuuuugaauuacuuuucuuaucuuauugcaguggcuaggaccuccaguacaguguugaauacuggacauuauucucuuguucccaaccucagaaagaaagcauaugauagucauugaaggcaccugauguagauaucacuuaucauauuaaggaaguuccauuccuaguuugcuuagaguuuuguuuuuuguuuuuuuuuuaaucaugaacagguauugcauuuuaucaaauguuuuccuguauauuaagguaauccuauuuuauucucccuuauuccauuaaugugguuaauugcauugauugauuuuugaguauuaaaacauccuuacauuccugguauauaucccacuugggcuuucccuuuuuauacagcuggaguuuauuuuuuuuuuuuuuaggauuuuuauauucauaugucagagguauugaccuuuauuauguuguccuugucagggaaguguccccucuuuuucucuucucuggacaaauuuguauaaauaagauuuuacuucuucuucaaauguugaacauauucaccagugaaaccacucagaaucugaaguuuuguuuguagaaauauuuucaaauauagacuuacuuuuaaauuagauuucuuuaauagauaaaaaacuauucuuauuuuuuauuucuuguaucaacuuuggcaaauaguguuuuucaaguaauuuuuuauuuuucuaaauuuuauauuuacuggcauaaauuauuucauaguauucuuuuauaaucuuuuuagugauuauagaaucuauaaugauauugcaguuuuaauuuuuaaaauuggcauuugguauauuaucucuuuuguuccugaucuauaagaggguuuuauuaauuuuaugaaucuuuccccugaaaaaacaacuuuggguuuuguugauuuuucucuguugauuuuguuuucuauuucauugauuucuucuauuauuucuuugcuucuacuuuccuuagaacuaaucugcuauuuuucuaacuuguuuuauuagcagcauagguaauugauauucaaccuuucuucuguaacaugcuacuuuuuuuuuuuuuuuuuuugagacggagucuugcucugucccccaggcuggagugcaguggugcgaucucggcucacugcaagcuccgcuucccagguucaugccauuguccugccucagccuccugaguagcugggacuacaggugcccaccaccacgccuggcuaauuuuuuguauuuuuaguagagacgggguuucaccauguuagccaggauggucucgaucuccugacccgcccgccucggccucccaaagugcugggauuacaggcgugagccacuguguccggcccuaacauguuacauuuuaagcagucuccuuaauuugggacucagaugucauaauuccugaauauguucucuuaacucuugccucuucacuguuuguucauacauuuuaucuuuuugcauagugacacaggaauuuucuuggccacuuugcccgcuggggcccucuguggcuggcaaugcuucugcccaggccucacucagcccugggccugccgcaggaggugcucuguccgccaggcuugugcaccagcuuagcucucagcugggcugagcaugcccuaacucaagcgugcccuaacccacuuguguuacagcuuguacccacauucagugggucccgaguucuugucccacauccaagaagaaugaauuuacguugacaaucaaaggguaaggaagguggagaagaauuuuauugagugacagaaacagcucucagccaaaaggggcugcgaggguggucucccaccugaagucgggugguuucucucuaaguauggcuggguccagagcuuuuaugggcucagaauggggagugcuugcugauugguuugcgaguacgcaaaaugggcuaaaacaaaggcaccacucaaaggggggcaugacaauguauaaaaccaaguagggaaggauagguguauguaaauaggugaagggugaggauuacucagaggaaagcaugccaaguaggaagagaguuucucaauccagucuguggauuuacccagaacuuguaccauggcuuucaggcuuucaacuaucuuuguuugaaggucagauuucacugaggaccugccucuuaccugccuaggcauuugacuuuuugcugccacugucaguagcauuaugggagaaucuuuugacaacuuuuguuuauuccauuugccauuuguguuuuguguuuccuuguuuugggggauuuaucacacuuucauuuccaaguccuaaaaaugauucuuuucuuguaaagaaaaugguucuuguguuguaaaugcgguauucucucuugccucugaacuuuccaguuuccucuuacagagucuuaauuugccauugcacacaagaugguuguacugacaaauuacuguugaugaaauaaaguuauuauccugaacuuucuuuuagaaaaugugcuauuguagaguaacagugguuuauuugccauuugcuaagucaauacuaacagaguuuugcuuaauauuuuugguauuuauucuuuaaaauuugcuuauugguacauaauauuuguacauuuuuaugggguacauaugcuauuuuguuacaugcauagaaagcguaaugaucaagucaggguguuuggaguaucaaucgccuugauaggugauugauaaaucugucacuuauuuaucauuuuuaugaguuaggaacauuucaaauuuuuucuccuaaguuauuuugcaacacacaauacauuguuguuaaccauaguuacccuacuuuacuauugaacauuagaacuuauuccuucuaucuguuuguauccauuagcuaaccucucuucauaccaccccucaccaacacacacacacauacacacacacacacacacacacacuucuuaaccucuaguaauuauucuaauuuuauguaguuuuuauuucguuugcuuuaagccuaccaaaccuauaaggagucacagcaugauaguuaggaauacugucaguggaguuagauugccugaguucaaauuccauuucuaccauuuagcauauguauggauuggggucauuauuuaaucuuucuuugccuuaguuuuuucaacuauaaguucauaguacuucuuaacaucauuuaaaugaaauaguaccugaugagugauuaacauaaugucuaauucaaaauaaacacuuaaauuuuagcuauuauucuucuggaacauuuucuuauauaaguggcuauuauugcccgucaagaugcaaggauuacuuaguuuuugcaacuagucuuuauauucugaaauggguugaugaauuauaauauuuguacaaggaguugugugcuuucuguucuagcccucaacuuggauuuugugugguaugugauaauaugcuuuaauagucaugaauuuuaauaaaguaccagguauagugaaauaaauaauaauuugaaacauggauucuguuaacuuuauuauccaugccuauauucuuuauuuaccaggcauaauuuacuagcuuugguuuuuguuuuguuuuugauagcccauaugcuauuugcuuuauuauaccuuuuuaaaaguaagucagaguuuagguuucucaugauuaaauuuuaguauuagaacagaaucuuuuaaugcuagaaaccaaguguauaagugcauauuuguucuuuuuuuuuuuuuuuuuuuuuuugagacaaggucuugcucugucacccagggcuggagugcaguggugcgaucaugaucuugucucacugcaacuucugccugcugaguucaagugauucuugugccucagccuccugaguagcugggauuacaggugcccgccacuaagccugacuaauuuuuguauuuuuaauagaaaugggauuucaccauuuuggucaggcuggucuugaacuccugaccucaagugaucugcucgccuaggccucccaaacugcugggauuacaggcuugagccaccgccccugacuccaaaugaauauuuguucuaaucuugcuauggcgaaugcaguugguauugaggucuuguauagaccuggguuuuaggauguagcagaacuggauuaauauccugcaucaccauuuauuaacagcauugcuaauacaagcuauguuuccuuucugagccuuguuuuucucaucuuaaaaaacaguaauagauuaauuugcgcauucuagaauuuuaugcaaauggaauaacauuuuuugugugcauucuuucagcauaauuaucuugagauucacacguauuguauguaucaauaguucaugcacauuuuuagguuuagucguauucccuugcauggauauacaaguuuguuuauccauucacucuugauaaacauuccaaaaauaaugggcauaaggaaauuucugaggugaugaauacauucaguauguugauuaugugauuauuucaaggggguauaaacacacacacacacacacacacacacacgaaaauuuaucaaaugugccuuuaaauuauuguauguugauucuacuucuaaaaaguuguuuagggcugggugaggucgcucacgccuguaauccuagcacucugagaggccgaggcagguggaucaccugaggucaggaguccaagacgagccuggccaccaugacgaaacccugucuguacuaaaaauacaaaaauuagcugggcaugguggugcaugucuguagccccagcaacuggggaggcugaggcaugagaauugcuugaacccaggaggugaagguuacagugagcugagaucgcaccgcugcacuucagccuggaugacagagugagacucugucucaaaaaaaaaaaaaaaaucuuuuaacaaaggaaaaaugaaaguuucuaucuuguucuaacacuucugcaguuuuaaaacccuauuuccuuaucuguuuaauaaauaaauaaauacugaauucuuaaaaagcaauaauaguuuguauuacucuaguuuguucaggauuaagucacauaucauauucgaaaacacuuggcauguaaguguucagcaaaaguuaauuuuuuuguauccuuucuccuuccagauuuuaauuaauaguaguccccucccccccccuuuuuuuuuugacucggggucucacucuguugcccaggcugaagugcacucaaucauagcucacugcagccucaaucucccaggcucaagcgguccucccaccucagcuuccugaguagcuagaauuauuggcgcccacgaccaugcccagcuacuuauuuaauuuuuuguagagacagggucuugcuuuguugcccauauuggagucccuauuuuuaauaagcuaauuguacauuuguuuucuugguuugacuggguuaauaaacagucugaaaaaguuauuuuggaagcucaggcuucuucuuuccugaaauaaaaauaauacuuuuuaaauuuagugcuuuauuuuucuucaaaaggcugugcucccucucauuucagaugcuugaauuuucacauuugaauuuauagucuaaaucuggacugacuuacucuucuuucagugugcaucuuauguauuuagaaauuaauuuuuauauuuugccuuuagguaaaucuaggcaaaauuuuaguccauuuuacuuucuuauuuuaagguuaauuuuauuugaauuaugaucauuauaaguguacuuauaugaaaugguuggaauucaaaaugaucccaguugaaaccaauguaauuucaagcuuuagaaguuagcucaaaaugugccauuaaucaguugccucuucacugaaaaauaaugacuuuauauaguugcuucauaagaauucgaacauacuucuguguuccauuuauguagacuuaggucacaacauaaaauacauggcuagaaaaaguuugaagacuuuaccccaauauacuagagccagggcuagaagaaaauguccuuacccaguggauuggaaccaagcuaguaauucuuuuuuuuuuuuuuuuuuuuuggugacgggauucucacuguuaccgaggccugagugcaguggcgugaucuuggcuuacugcaaccucugccuucuggguucaagcgauucuccugccucagccuccugaguagcugagauuacagguguacaccaugcuuggcuaauuuuuguaucuuuuuuuuuuuuuuuuuuuuuuaaguagagaugggguuucgccauguuggccaggcugggcucgaacuccugaccucaaaugauccguccaccucggccucccaaagugcugggauuacaggcuugagccaucacgcccagccucaagcuaguaauucuuaaagucagcauuaaacugauguccuagauucucuuuucuguuugcugcuugguaguuuugccacuuggugauccugggcaaggcgcuuuaucucugcaccucauuuucaucacuugcaaaauucccuuaccccucucagugaucccauggguccaugaauauaagaaugcuuugggcauauucagaaacaguauaugugaaaauguauggcccacaugcaacuugcugcuuauucuccucuuuaucauguucuucuccauuuauaaguggcucaaauuuccaagugggagagauagucaguguccucucaguaucuauuuccuuccuucccauccugugauuucagggcuguaggccaaugaaauguagccccuucuuaauagaaagaaugaaggccucugcucuugaguauacuccuucaugagagauugaauauaauuugugaacuugacugaaauauuuugagaaguauacugacccuuagucaaagagaaaguaugaagccuauaauauaaccuaaguauuuuaucuuuaauugcuaguaucuaucgagcaugugccaggaucuguucuucacaacagugagucacaaugaggguugagugauugcccaaggucacaaagcugggauucaagcacauagcauauaguuucuggagcccaagcucuuaaccauuauacaauacuacauuacagguuguuauucaacccuaaaucucagugugagauucuugcuugguacuugcaggauaauuaaaagugaugcauguucauuguagagaaaaaauaaaaacucauaguuuuauaaccagagaugaucauuguuagagcaauuuuuuuuuggagacagagucucgcucuguugcccaggcuggagugcaguggcucgaucucggcuugcagcaagcuccaccuccuggguucacgccauucucuugccucagccuccugaguagcugggacuacaggugcccaccaccaugccuggcuaauuuuguuuuuguauuuuuaguagagacaggguuucaccguguuagccaggauggucucgaucuccugaccucaugauccacccgccuuggcuucccaaagugcugggauuacaggcaugagccaccgugccuggcccuguuagagcaauuauuucuauaucaaaccauuucuauuacuuauaauuaaaauuuuguugcagcuagugaugacauauauaauaauaucauuaggacuucauuucuuuaucacuaauaggcaggaaaauguugcucaguggacccaaauuccucugucuuuuacuaucaauccuugucaagggaaacaugguaaucuuaucugugagggggaggaggccugaaagugguauuuauuuuucuuaauucuuuuuuauguaaguucuaaaaaacuuaugcauuucucugaauuuuuaaaaauacucaucuugugacugcuauagcugaaaugacuguugucuuuauucuauuuuuaugguacuucuuuuucuaaaaagggcuguuuaugagccuuguccuuuugugcuucacaggaaccagcaccuaugacagaagaucugcuagaagagcagucugaaguuuuagcuaaauuagguacaucggcagagggggcucaccuucgagcacgcaugcagagugccugucugcucucagauauggagucuuuuaaggugggucacacuugcagagcucuggggucuauuuugagcuauucugggaugaaacugugaaaaucacucuguaaagugguauaaaggccugaaugucuuuuuguuaaguguuuggauuucauuaguaguucaacacucugccaccauccccccagaggacauagucaaacuuguuucuuaaguuuuaaaaaagcaaagaucuaguauuauuaauaguugaaaguugagaauagaaucauuucuauaugugaauuggagugguuucuuuguuuguguucagccaauuuaauggaagacuuuuaggaaacuuaggauuuaacaugggucacuucacucaaugaacuuuugagugccuauuguguaccuugcacugugacuagaugaguuaagaaauacaguguuuacccucaguuacaguugauugagguugugggaggagauauguaaggaacugucaugaguucucuuauggaggcagggucaaaaagacugacucugcugaguaggucaugaaagguuucucagaagagucacuauuucagaugaguaggcauuugcuaucugaagaauauuuuaggguuagauacaggucuguauuucgaacauacaggauucagggaauggugacauuuggcuuauuagcuuaaaaacuaggaaugaagaaaggacuuuuauuuuugaaagcaaaggcaaguccacguauauguuaaaaccccaaguggguagccccaugggcuacagggcuuccuuuccuacugcugauacucugaacuauccccaggcgcagacuucccucuuuauuuaaccugugguggccuccaccuugccaauccauauccccuacucaguccugcuucuguacuguuuaggccagugugaguuugauuuuucucugaaacaccuguguauuauuuuuaaacauaaacacuccacaaacaccuaugccacuuucauccuuuuuugcuagcagauuuaagugacaauaaaagggagccuuuuguuuccugcuuauuuuacccaucuuuucuaaaugaaaaacaucuuuagugaaccucuuaagagcuauauguuuuccuuggagacuaaaaugauacagaaaaucugcaaguucuauacugccaugugacaagaaacagaggaguugcuuuaaaacaaauaguugguacaguggauaaagagaagccaguuggcucuuggggcacaugucaaaccaaaagguagagaagggaauuggcuuaaggugugugugcacagcaggaaauaccagccuccgcagcaguaauuuuccaucugaccucuagcugccuucagagucaucuuucccuguccugcugcagugucuuugcagaggcaugcacgggaggacauuccaaauaggaacuacggaaguuuuuccccauggaaacauacuacuccuucuugguaaaguucuauauaguuccucuaacacugcacuucagcaaaacugugauucauuagacuauuuugggcuaaccuggguaccugcaaaucuuacaugacauuguuuuaaccagaaaauagacaguaauuuaaauagucaacuuacauauacacccauauguagaaaucagauaauacauuuaaggaaauauguaguuauucuaaaauagauaugguugccuuuacuuuuuguauagggaugaguuaggggcucuugagaguccccagagcauuggaagcauacuaauaugugccugggcaccuacaccuacaccucagaguuccagaaggagaggguggauucuggagcaugcccuugugguacauaccuuuaacaguaaagagaagauaagcucaagugaaccuuggccuucucuugguagcuauguucagccuaguauaguaaggacaaccagaaagaagaauuuugguaugaaaugccuuucuucaauauaaucuauaguguaugagugaauauuauuuucuuuugaaguuuaugcucuuuacucugggccucugguuuccuaggauguuuucauguggguaugauguuaacugauuaagaucuagaucuuuguacaugaauccugagucacccaguaucaugaaauaaucuugacccacugcuuuugccauggaccguaucauaacccuuuuacauuuguguuguugacagucagugaaggaucuucuaggggauaugcccuuagggguauauccuaagaugguagggauggucaugcugguagcccuugagcucagugaggagaaacugguaguuuuacucuucacauuuaagacagaacauucucaucaugguaguuuucaugcccauccuuaggacucuacuaguacaucacuggaacacuuguagaaagaccucugugccuuaccacaaacacugggaagccucgucuuuuuuuccaagcuugaaguuagaaucacugaaagguuuuuggcauacaucaucauuaauucuauagaacuauccacugaguaaaacuuuaaucaguuugguuccagaagccugaaaaacaguaguuugaauuccaacucguuaacagcacaaaaccaauuaauuugaugguaauuuguuauauaaaguacaagaauuugauggcagaauagaacaguuuugagguuagcugacauuuauugcagaaccaguauugauuuauugaggaaaagaagaacagaacuuuuccaucacuguguuauucugaucaugugguguauuauuuaauuuuuacuuuucuuaguauugaguaguuauuauacuguaauaugaaacuaagcuguguaacacauaauguguuuaaggaaaugauuuucucuuuacaucgaguuuuuauauccaaauucauugaaugaaaguguuuucauuacuaaguuauauaacacauaauguguuuaagaaaugauuuucucuuuacaucgaguuuuuauauccaaauucauuaaaugaaaauguuuucuuuuucuauaaagcugagaaaauaaaaauaaaaugcuuuugauacuuuaacaucugaccuauuuuaaaggugacauccaaauucauuuuacauauuagauuguaaagauuagauaggcuuuuuuugaaaauacaauuuugcaaacaggcuuaucaguaacuguugauuuucauuugauucugcugaauuuuuuugucuuauuuuaggcagcuaauccagguugcucccuggaagauuuugugaggugguauucaccccgggauuauauugaagaggaggugauugaugaaaagggcaauguggugcugaaaggagaacugagugcccggaugaagauuccaagcaauauguggguagaagccugggaaacagcuaagccaauuccugcuagaaggcaaaggagacucuuugaugauacacgggaagcagaaaagguaauugagguuugagucucuaauacuagaaugcaaauuacuguucuuaugauuuaggaacucacugucauagacgugagaguuuuggacacacuugaggugcaaagcauugaaauucaaugagcguuuuauauaucuacuauucacauuuaagauucuagaacuaguugcaaauagggcaaauaauaggcaugcauaguuuaaacagacugcuuaccauugaacugucucacaguauauguuaaaaguguuaaaaauggguauguccuuugagcuagcaguucuaucaccaaaacauuuuuuaaggaaauaaugagaaauauacaaagaucuauguauauaaaugauguucaacaaaguucuuaagugaaaaaguagaaacaaccaaaguuuccaacaacagggacuugguucaauaaauuaugguauauccauuaguggccagcuuuacagcagcuauuaaaaaacauuuggaguuauggagaauauaguggcaccugccugauauuuaauugcccugcacaccuuccuaccuccuccacccccccaagaaaaucccgugaaaucaauaaguaaauaaauccaugcauucagcauuacuaagagauagaaauugcaaugaccuucaaauuaacaguaaauagagaaauaagccaaauuccaguggagcucccacugcucucagucuuugcagauauauugaguagggggcaggaaaagaaaaagagccaagagauacagaagacuuagaugaaacacaaagucaccccagaaagagagagccuaacacuacaugccaaaacacugaacacagguaggguuugcuaguucacagcacuugccacagggaagggacuugaauguaaacagggcuagaaauggagccuuggagaaaaucagauauacaaagaaggaguggaugggaaugaugagaaaaaggaaauaagaggggaaaauuaaggaucuugcggaaaugaaagaaaaacaagacaaccagccucccucaucucccucuauccauuaaagaaacuucagaagagggcacuuugaagcuauuugugauauuacuaggaauagaagagaacagaccacauccauauaaaacuacuuuacaaaacagaaaaugcaaaucagcucauuucagguaaugaaaauauuucccagaaaaucagucacaaagcagaagaaaauuguaacauaacauuccaaacugaaucagauauccucaaacaguuaaggaggauaugaaaaaaccauguuuaaucagaaauacuaaaaucaagaacagagauggaccaaaaaaccccacaaagaaaugaaaccacaacugauuuagcucaggauagaaguaaaagaaaaaagaaaaccauauaaaaaaugaagacuaaauuacaagaggcccaaguuuaaauuuuauaaagggcauugaagaaaagugggaaaagagcccagaaaaugaaaaugagauauaggaguaaaaggaauugaagagaaaguaguauaaaugaaagauaagaaaagucagaauaugcaauucauuaguuuccuuuaaggagaaaaaucagaauacuaagacagaacuaauacagucccuauggcuuaacaaagaggauacguuuugagaagcuccucauuaggcaauuuuguuaucaugggaacaucauagaguguacucacauagacccagaugguauagccuaccacucaggcuagaaaauuaguggaauacaaacuuucuauuaaacaauaugggugaaaggggaaaauacaaauugaaaguacagaauuuuugaaaaacaaugaggaugaaaacauaugaaccuauaggcuauacuuaagaaauugaugaaaggaacuuucauagcccuguaucaguaaaaacaaaaggaugaaaauaaaugaauuaaauuccuaacuaaaaacccuagaaaaaaagucaaaucaaaagaaaacaaaaggaagcaaaugaaaaggagagaguguagagaacacaaaacagaugaaauuaaugaguucaaucuaguucuuuuaaaaucaacaaaauagagaagccauuagcuaauuuaaucaagaaaagggagagcacauauauauaauaaaauaauaaaugacaaaaagggcacauauuaguaacuacugauacagaggaaauguguuaaaaauacuacuuugcacaucucuguguauguaaauuugaaaaucaaguugaauuagacaauuuccuagggaaauuccuaccaaaaauauaauguauaucaaaacuacccccaguaaaaacagaaaguauaaacagacaaauuuucauagagacaauuaucaaggaacugccacauuaaaaagaaccaggcccagaugguuucacagggaaauucaacuaaauaucaagaaaccauauaguuccaaugcuacauaaauuauuucaacacauaauaauuggaggaaauuuuccaacuucucucugugaagcaacuauaacauugguaccuaaaccugguaaagauagcauauuuuuaaaaauagcagaccaguaauacuuaagaaauuuaaugcaaaaucggaaguaaacagacucuaauaucauuuuaagaaaacaauacauguugaucaaauaugaggaugauuauuuagaagucuguuuauauaauuugcuuccuuaauagauuuaaguagaaaauuguaucucuauuuaugcugaaaaaacuuuugauaaauuuaacuuaaaacucuugggaaaagaguggaauagauggcuacuuccuuaaaaucagaaaauauauagaaacuuuaguccuaaacacagcaucuuaauuugggaagccuuaggggucacuaaggucaggaacaaagcaaggaugccugacaucuccacugccaaucaaaauuguucugcagguauuagcuaguguaauuagcaagagaaagcagaggcaugggaguugaaagaagaacucuguuugcagugguaugacucuauacuuggaaaaauucaaaaagucaauguuaaaacuaauaaaaacaaaagaauccaggaaggcagcaugauauauaguuaacauacaguaaucaguagcauucauauacacuaauaaccauuuagaagaucuaaauauaauuuucauuauaaggggaaaguaaaauacuuaacagaaaauauuugaaaucuuaaugaagaaaacaaaacgcuccucaaaaacacacuugaacaacagaaagauagcccucaaacuccuaggcucaagugauucuccuggcccaguuucccuaguagcuaggacuacaggugaacaccaugaugcccaacuaauuauuuuucuuaauuuuuuauagagauuagaucucacuguguugcucaggcugaucucaaacuccuggccugaagcaauucuccugccucaucuuccgaaaguguugggauuacaagugugagccacugugcuagccuaugcuuuacuuauuccaaaaaaauaacaagaauggaaagaggaaaaauaaaccugaaagcaaguugagauacauuaauccagcuguauuuuaaaugaguaacauaaccacaccgacggggauuggugaagggaggauggaaaaucuaauccaagugauuuaucgacacaucaaauguguuugacuguauacugucaguuguggugggggaugggacugcaagaaaaaucuugaggccaggcgcugguggcucaugccuguaaucuuagcacuuugagaggccgaggcaagaucaccugaggucaggaguucgagaccagccugacuaauguggugaaaccccaucucuacuaaaaauacaaaaauuagcugggggugguagcacacgucuguaaucccagcuacucaagaggcugaggcaggagaauugcuugaaccugggaggcagagguugcagugagccgagaucgugucacugcacuccagccugggugacagagugagaauccaucucaaaaaaaaaaaaaaaaaacaaaaacaaucuugaacccuauuauuaucuaagcuugguuuuuguaaugauacggguacagcaauugugaaacucuuuuagauguauuauugguugggugaagugaguaacuaaauauguuggugguguuggaagccagaauuucuuacuguggaagugagaugcaaauaugaaauaaaggaaggcaaggaagaacgcaguggcaaugaauuggaauuggagguauugguguggacuuacgaguuuuuaaaauauggauagguauguggguauggacauaguaacuauuuguguauauguauauacacaagcaaacauucccuggcuuucuucugaaagagucuagaagcacugacacccucauagcagugagcacacauagcuugauuuuuuuuuacacauuccuuuuuuuagacauuuaguaaccaugcuuuccucagaaaaaugacugauuucaagauugaggcaaggaagguacaagaugaaccuggaacauccuggauugcucgacacuaaggaagugcuuuaaaaaaagaugggggcauuucauagagagcuaacuugaaaggacucacauuggccaaaucugggacaauuuugaguuguaaauauuuaaggacaggaaugauuauaaaccguuggaaaaaauaggaauucuuggaaccauauugauaauuaauggauaaacaacuaggggaaaggggaagucauuuccuacagagcaaagaugagugguaaauguagaggauauguuggaguuggaagucuucauuuugcaaccauguucauaguaaggauugguucaccaagaaucaugaauauuaagucuagguggaaaauugaagagcaucaucuugcaugauuuuuaaguguuucucuauagagugcuucugcauugcaaggaaaguggagaaauaggacaguaucuccaaauuaacaucaccaaugaggaguaaauggagaucguacacauugggcuaugauacucugauggacccaacaccacuuaacaugccauuugguucaggaauguaaaaucuuagucuaauugugagggaacauuagaugaacccaaaaugaggaacauucuauuuuaaaaagauuuugaaaaaagaaaaauuugcagaaguuugggggcauauuaaagacacaggagccaacugaaagaguucccaacuggccaagacuggaacaauuugaacaccaaaauaaaauaauauuggauuguaacucagaguacaaaauaaauauccuugaguucauacugguauaaauaauugauuggauauauaaauuaaugggauagaagggacaaauccccugugcagaauucuaaauguauauagauacuccacccucaaggaggugaagcuaauucccacucuguaagugugugcugcacauaguguguuccucccagagaguacagugcacagagaggggaaaggagugauguuacagugcagcagcccgacugacacugucucagccagguggugaagguuaacauccacaggcuaagccauacuggcgguauguacuccugacaugaugugaugacaguggcacuuuaccucucuggucuuccucccagaaauacauaacccagcuuaaucaugaggaaaacaucagauaaaccauaauugagggaguuuuuaugaaauacuugaccagaacucaaaacugucaaggucaguaaaaacaaugaaaaccugagaaaugucacagccaagggagccuagaaacaugacagcuaaacauaaugugguaucuugaaggggauccuggaacaggaaaaugacauuagauaaaaacuaaggaaaccgcguacauacauacaugcugacagcauuauucaugacagccaaaaaauggaacaaacccaaaugucugucagugaugaacagauaagacaaauauggucuguccaugcaauggaguauuauucagccauaaaaaggaaugaagcacugauauguguuacaacaugggugaaucuugaaaauauuaugcucagugaaagcagccagaaaacaaugggcugcauguugcgucguuccauuuauaugaaaggaccagaauaggcaaguccauagagacaguaaguuagauuaguaguuggcagcaguggagauuaggaaugggggaaaucaggaguggcugcuuugggguacuggguuucuuuugggggagaugaaagaaaauauucuggaauuagauaauggugaugguaacauaaccuugcaaauaugcuaaaaaccacugaaguuauccauuuuaaaguggugaauuuuaugguaugugaguuauaacucaauuuuuagaaacuaaggaaaucugaauacaguauggaauuuuaguuagccaaaaaguagggaggaagaggaaacuauacucaaaaugccaauguuauaaaagacagagugaaaagcuguugcagauuaguugagauuaaagagcuaugauaacuaaaggcaauggaugauccuuaccaagacuuguagugguugagggaaagggucauaaaagacacauuuugcggccgggcgcgguggcucaugccuguaaucucagcacuuugggagguugagguagguggauaauuugaggucaggaguucgagaccagccuggccaacauagugaaacuccgucuuuacuaaaaauacaaaaauuggccgggcaguaguggccaugugccuguagucuuagcuacucaggaggcugaggcaggagaaucgcuugagccugggaggcggagguuguggggagccaagaucgcaccacugcacuccagucugggccaacagagaaagacccugucucaaaaaaaaaaaaaaaaaaaaaaaaaagacacauaugggaucaguugacaaaacugcaauaaagauaguagguuagauuacaauuauuuuuaucaguguuaaauuuauuguauauaaucagaaucauuugcauuuugauuauauaauaaaauauuuuuaauuuuaggaaauacagauauuuugggauaagggacaugagugugcgacuuauucugaaauuauucgaaacaaguuuaugucuauaguauguacacacaugaaagcagagaaagaugcaagggauccagaacagaggagggagacaggucauacgugaauccagguaaaggggaaucacauauuucacguuauuccugcaaauuuguuuuucugugaaucaggggaaaacaaaauucagaaagguggguauuagcaaggauguacaacagagggaacucauuacucuagauaagaauguaaaucuguugaaacacuuuguaggauaauuauguuguacauuuccuaguucaauuguuagguauauauccuaaaguaauugcuguacaugucccauuugcaccaggaaauaugugcaauaauguaauaggagcaucauuuguaauagccaaaaacugaggagcuauccacuacuauuaguguaggaacauuuuaauacagcagugaaaaugaguaaacuauagcauauuggaaugguauacgaauaucaaaauacugaaugaaaaaaagcaagucacugagggcuauaaacagaaacacuccauuaauauaaagguuaaaacuagacaaaaguaaacaauauauuauuuaaggcuacauaugugaaaaaaaccauaaagaaaagcaaaagaaugauuuguaguuaauucuggggauggaggguacacaggaggacuuggaaaagccugguaacauucuguuuccuaagcugguguuuucuuuaaacuauuucuaauacucuaguauguauauuucuuaauuuaaaaaaaguuucaaaucagacaaaacucucuaagccaaaaaaaaguccaccacaagucauuaaauaaagcaaauaauaaaacaguauguaaguuauuaauuuuuguuaagaaauuacauaugcaucuacauuuuuguguuuaaauggacauacaaguaguuugagaggauaaacacgaaaaugugguuuuggggaaguaggauuucaggaaaauuucugcaucaccuguauuuuuuuuaaaauuuugaaauccaugagcauuuaucagucagacucacauuaugagauuauacuucuuaaaauuuuuauugauguaaaagaauuguacauauuuauaggguuauacuucuuuuaucuuuacuguugaauaaggagccuaaagguaggguccauguuuuguacauacuucucuguauucuuauaauaagaauuggaaaaaaaauaaaccaaaacaacuaaaaccaaaaaaugugugggaagucacuaacaauguuuagaaauauuaagugagaaaagcagguuaaaaggcaguauuuuacauauuuaauauuagugcccuuaguacguguauucugcgucuuaaaaugaaaaugcuccacugucaaugguuguuuucucuugguauuguaaucagucgguaguuuuuauuuucuuuguauuuuccuuauuuguguguauuacauaagaaagcagaaaaaaauagaauauuuauaauuauuaaagauugaaguucuuaggugcuuucaguaacauuauccucaccuuuggggucguggcugccuaucuggagugcugucuuguuaaggauuaagaugaguggcugaggauuugcacuucuguaaguggcugcuucauccuuugacaccugcgcugaucauuugugugcgcugcaccuccuucaggugcugcacuaucuggcaauccagaaaccugcagaccuugcucggcaccuguuaccuugugugauucaugcagcuguacucaagguaaaggaagaagguaaaugucauauuuaacuagucauuagucauuuccaaagugaaaguauauuuugcuuaauuuauuuaaugcuggcuucaaucuuuucuaaaauagaaagucucgaaaacauuucuucaguuaagaagaucauaaagcagauaauaucccauuccaguaaaguuuugcacuuccccaauccagaagacaagaaauuggaaguaaguuugauguagugucagaaucuugccaaguguucuccucaguuggcaaaaauaauuuuuaagaugcguuuucaaagggcuuugcuuuuuugccaucucgcaauguaugccucuuccuuuucuaccgccaggaaaucauucaccagauuacuaauguggaagcucucauugccagagcucggucacuaaaagccaaguuuggaacugagaaaugugaacaggaggaggaaaaggaagaucuugaaagguaauugcuauuuggcuaauucaguuuugucugcaguaggaaaagccaccacucucuuaagaaaaauuguaauaggauauuaagacucuuuugugguaaucauauauuauuugaaacaagcauugucuagagacagaaauaauuaucauagcauuugaccucucccguauuucugagucucuaccagguguuuccauucuucccacuuuuagaaacagucucccagagccuccuuuucuagggauuccuugguuugcucuuggagauguggugucuggaauuucuuguggaggagcuguuaacuguguugcucacccugccccaaaacuuuguuuucagcuguuacuauuccuugaccacagggugcaggugcugaaaccauuucugcuuacuguuccuaguuguuuauuuuaaacaagauuugugauagcaaaggugcacauccuaugugccuugcgauuauguuuugaaagauugaccagauggcuuuucucagaugaagcaaaugauuggggcauucucuuuaugagacucggcaccauuaccaauggagcuuagaucagugugaggcccuguucauuuuuugcccauguuauuuggaaggacaauauuguuuuaaugugugauaaaguguucacaaauuagcuuguucaguggcuuaaauuugucaucauuuaaaaauuuucauuagccuuuccauaauaaauggcauuauugaugcuaaauaauuaauauuguauggcaaggcauuugcugucuuuuaacaaguuuguguuugaauuuuaugucuuuuguuaggugaaguuuucucccacacugcuuugcucuugaaaaugucuuccuuuuaaaugagaagaauaagcucuaaucaagggacucguuucuaaaauaguagaguaugaauuagugagcagguggugcagguuugguggcuuugugccuucaacucuguuaguuccaccauacguuaucugugacauacuuggaaguucaguguuuccagcaucuaauggcacaguuuacaauugcgacuuugcccaacacaaguauuuuaagcauaugugcacgugugcgugcacacacagacacauaccccuuaaaaaaaacaaaaacaaauauggaucauugcuuuuauuggauaaauauaacuugguuuauauuauacaauuuuuuuuucaucuuuuauuaacuguagcauuuucuaagcuucuagucugaaaaaaauagacugaauauuuuuucuuacacuuugacagagauaggcuuuaaacauuuuuuaugagcacaggugaaaaagcaggaagauugucaguuaagucgauaauaauuccaaaugucaaucuuaucuugcuguaaaauuucacuccaaccuuguuggguuuagccaguaucagcuugaggauuuguccacaaaacuccugugggaggauggacgcccaguggccuggacagcucacuuuccacccuuucauugccugucucugucuccuagguuugugaguugccugcuggagcagccugaaguguuagucaccggugcaggaagaggacaugcuggcaggaucauucacaagcuguuugugaaugcccagaggguaugugagagucauuauugacuccaucauaaucucuccaaaccucuacuugggaagaggcuguuuuaguucccacacguggcugaucacacucaugucaccugaguguaagucugggcauuggguuugaacacugaagaaacaaugacuucugagucuucgaaauccauuugauuucuuacauguugaauuaaaaugauaaguauauucuaggaccuaaauuuuaaaaauuagaagaguccaaaauccauuguuauagaagcuggcagggagucaguuagcaauggccagugcugugcugugggaaaaaauguuuacucacagguacuuucaaaugagaauggaguucaguuuuaccaucuuuaaaccccauguagggcaaaguggagucacaacucagcuugaauuauaaauauaauuguucuuguaauggugaggagaucuaccuuugagguuuccuagaaaagaagaggaaaacuucagauuuuuagggcuguggaaacagauuucagcacagaaagaaagcccaguuugaaaaauuaucauaaccauuaccucuaguagugaaaguaaagauuuuaaaauuauauuguaucuugguuacuggcuaagggcucuggcauccuacagauaauucucaguucagggcucauuaauauuagggauucugauaaaggcguuaugugcacuaauuacacgcuuccccuuauauggcacugugauuacacuagaaugacccaguuuugagaguguaauuuucagaaacaaauaagaaaaagaauuucuaugugucuacacguggaauaacaacuggauaaucccuguagaguuggucuggaguacaacuaguuaauauauucaaauucauagccaaauacacugauaggaauucuuagcaagagcuaaaaucugaguuuguuuauggggcagcucccuaaaccucagaauuucaaauuaauaaccaaauauuuauuuccuuauaaauuagacuucuagcaaacaauagaugcuugcuuugauuuauuuuguuuuucucucuggcaugaaaacaagaaccgaguuugguuccacaucugauaauaucuauccaguucacuacccagaagcuuacaagcgcauuuccuuguuagcuaccaauaugaauguuccucauauugcaaaaauucuuuccucuuugaucauuuuuaauaagugacauguuggcugggugcgguggcucacgccuguaacuuugggaggcugagguggguggaucaccugaggucaggaguucaagaccagccuggccaauguggugaaacccuuucucuacuaaaaauacaaaaauuagcugggcgugguggugagcaccuguaaucucagcuacuugggaggcugaggcaggagaaucacuugaacccgagaggcagagguuacagugagcugagaucaugccacugcacuccggccugggugauaaaacuccaucucaaaaaaaaaaaaaaaguuauguguuaagaggauuuaaaaugugaaguauuuauauuuuuaguccugagauuguuacuuauuuuagauaacuaagcaaaauuauuuuccccaaaauagaaauaaccuccuuacccccucuacugacugcaaguaaaacuuugacaauauaggaacuuuuauauuuauuuauucauuuuuuaaagagagggucucacucugugguccaggcuggaguacaguggcaagaucauaacucacugcagccuugaacuccuagguuuaagcaauccucuugcuucaaccucccaagaagcuggagccacaggcaugcaccaccacgcccaguuaauuuuuauauuuuuuguagggacggggucucacuuuguugcccaggcuuaucuagaacuccugguuucaagcaauucuccuuccuuaaccucccaaagugcugagauuauaggugugugugagcuaucacaccuggccuagaaaauuauaagaaaauauuaaucacauaaucucacuacccauugaugauuuaacaucuaguauauacauauguauauauaauuuuaaaaguaggguuauauuauauaauuacuucauuauucuuguuuuccacuuaauauacuuaagauaucuuucaaaaucacuaaauacaggaacauaguauaucaucuuucaguagccucauuguauagcuaacccccuuaauggcuacugaaauuguacauccaucuacauuaugucauuuaagaaaagauuuuaaaguuuucagaccuuguagugaauguuuuuagggaauugguagacuguguaauacauauaacaagcaucugguugguacauuuuuaaacucaguuuuaaaugucuggcugaaguaaacuguuagaauuuauucauguaacuuuucauuagcugauacuuuauaucaauuuuacuaauuagucaagauuuuaacacauuuuuuuaaaaaguugugauguaauuucacuugguguuuuuauagcuuauaguaauucuauauauuuauaacuuuucuuuaaaauuauaaauaguaauaagccuuaucaugauuauagguaucucugguauguacauacuuaaauggaauucagcaaauaaaugacugacuggauuucgcuucagacuugcuagauugaauaacuguuaggcaccuauuccuaaauucuauuuuucaagccaugaacacuuuuuuuuuuuuuugcaucauaauucccaguaaaagagcuagguuuuuguuguucauuucucccauuaaaugacaucauaugucaccuguugagccauggaugcaugaguaguaguagaugucugcuguaguugacagcugggugugcuguguuuggugugacuuugucuugaauauucuuuugauaggaucauguuccauaauguagugcauacugucuuugaaauaauccugaacucccuugucuagcccuauuuaaaccaucuugcuuguuucccuuucaucacuguuucuuuucuuaccccuucucaagcugacugaaucuucugaugagguaacaaaauagccuuugccccucauaguuccuuguuccuucccaucccucuaauuucauaaggucauuaacacuaaccaccucucucacagucuggauuuggcuuaccuaccuugcugauguuuagcgcaacaugauuucauguuuccauugccaaaacaauuuuuuuucccaaauugaugguauuaaaaaaaguacaguaaucagaauuaaaauuguaggcuguaaaugaacaugcauuuuaugucauuucaaugaaaaaauagaugccuuuaauauugcgaacuucucuuuuguggucauugcuauaugggccucuaucacuucggcaucacauuagcugcccagcaagcaagaccaaugcccccacuuuuaauuuggcaagugaaccuuaaaaagaaucgauuaaaaaauucuuacccagagucaagaugaaaaucaucuuuucacucuggagaaaaacagcuccuuacuggacugaggcugucagacguagacuugggucauugcuggaagaaacauagaaagcagcacagcuccgagguccuuuuucaucagauguguaaauauggccuucucucuucagagcagauugccuggcagucaucaucccuccugucugucuccagcccggcugcucaugcagugucucaagcuucuugcauuugcuguguuaugugguuuuugaguaaucuuaacauauagcugacugcauuacugaguaacgugggacauuuucauaucuuuauuauguuaauucaucuguccuucaaaagcaucugaguuuagcauuugaccugcuuuugacuuuagcauuugauucuuuuccaggcugcagcuaugacuccaccagaggaggaauugaagagaaugggcuccccagaggaaagaaggcagaacuccgugucagacuucccacccccugcuggccgggaauucauuuugcgcaccacugugccgcgcccugcucccuacuccaaagcucugccucagcggauguacaguguucucaccaaagaggacuuuagacuugcaggugccuuuucaucagauacuuccuucuucugauucuucuagcauuacucguugguggcuucagagacagugcugccuccuccugagggagggaagguaccagggagaaccugggagguccuggagagggcccuguccaguugggugaucaggaaucaaaccagcaucggaaagacuucccagcaccaagcuugagcugugucguuucguggagggggcagcgaggaugggcuugagcuguugagagauuucugcccuagagauggccuuuguauaugggggggugguggggggacacaaacacaucagacacuccguccucacacuggcaggacgguguucaucgcauucucuucugugaccagccucuaggcuagcggcugcauucguggucugugcaaacacuucgugguucuauauaucagcagcaagugugcaaaauaaaggaccuguuaacucagauuucuggauauuuuggugguagcuucuagucccagaaucuguguuuuuaaaauacuacaugacauucugucuauucaaucaccugguggucaucuuucuuguacuaauuaacuguugaugagcauuuuggauauucuaggagaaagccuauaauuucacauaguuucucuuuuucauguaacuguaaccuaaauguauuacuucugauaaaacuauauaucaaaugucacugcaaauuaguuuuauaucugucaugugagauuugucuuacuuauuuuucuuuugguugccauggaaguuauggcccugaaaaucgucucccuccccuucucuugcuguacagcaugcguucucuuuuugugguugcuggcuggguacuguauuuaaugaaguagagaauagcacuugcaaaaauacagucuugguaccuagagacugucaugcagauaguauaauuugguauaugugcuaaugcauugaguagaggauuauuuuaacacacuauuuugcuuuuguauuuuaguuaaaauaaucgauggggauguguagcccccccgugugaggaugacaucaccacauuucuaguuucauggagcucaagaugucuugugucuguguggcuagauggccucugcuugguaaucuuauuuuuaggccuaaaauucccacuuaaauccaaaguaaaaaugguuauacugaagcauaaaccuugccuguguaauuuuaaaaaauuaauagagcugugcaaacccuguuauuuuuguaaaaaaaaaaaaaaauacauaucuauauauaauaugugugugugugugacauaugcacacgucucuguguaugugaaguaggggaggcccugggggaugaccucccagccuuuaugaugcuuuucucuaugcugcuggacuucauucuuacugguccacgcagaugcaggcggccugaggccagugcuguaccaaguagaagacgguuccuaaggacagaguuugucuguuuucuaacaaagaaaaauucuacaaaggagagguugggcguuacaaaggcauugugaaucuaauaaaaggaaagugucgcuuucuguggcguuuucuuucauuuucucccgcugaggcauuucagucuaauuucaugugguuuugugcugucucagcucuaauguuugcagccugcugagccuaacaaggcaguggucucaagaacauucuuugugccuuuuuaaaguacuccauuuuauuuuuaugauaguuauguauuuauuucacagauauauuuaaguacccacuuugugucagguacaguacaagcaaugaagauaaaacagaaaccaaaacacacucccuuacagggaaaacugacaccacguugccacaaaauguugaguauagucaacucugcuguguggaucggagggccugcauuuauccuacaaauaauugaauguaauccuacauucauguauucauuggcaguacggaguaauaaaugcagcaaugucauaa

SEQ ID NO: 191143 - RNA, 193757 nt, Homo sapiens
cgguguccgggcuggugaugggguuaauucccuuucguaagacucuuacuugcacccacccagccccgccgucgccccgccgcgccgcgcuccaaccgccuccuccuccucaguaacgcggguaagagaugcccuucccucccccguccagcuccccgggaauaacgcgccuugcuccccucccccgcccgccaaccgguagcgcuaacggagaaggaggcaggcaggggagagaugugguguguggaaagguggccuuccccgccgggucgucggcgcuucagccagggccuucugacgucccgcugcugccagcccgccguuaggucggguuccgagugagccaggcucgccuggcccgcggcugcggcuccggcugcagcugcagccacugccuugugcccaccgcccccacccgggggccaugugaaaagcaaaccccucgaggccuagcggaggaggcaggggaaagguuuccgagucccugccauggcugcugcugcugccuccgcggcugcucuugcagccccagggacucgggagccagccacagcaggccugccaagagcgugguacugcucucucguguggcuggcgccggugccccgggcucccccggccgccccacggccgcauccccuggccuugcaccaagagaauuuucagcuucgaccgguugguaaaauguagguacauuuucccugugguaccagaaaaagcacaaugggaauauuaaaaagaaaguugaaugacugucagugccacggucccccgggaucagauuuacacacguuuugauuccugagccuuaggcugccaacaaaucuuugugggcuuugaaguuuuuugguguuuuguuuucuuuuguugcugugacuaggugcaaagggugacucuguugagcuuguuuuuauaaagaaacuuaaauuauugggacuaucaugcuccguguguaauuguccugggauaguuaaguaaaaggugaagaagaggugcuuuccaaauuaggauuagugaacagcaaaugguuuuucuaauaaaauuuucuaaauauauauauauauaucuucaugguuauaguuuaccuaauuguaacuguaagaaaccuuuuuuagcuuaaauaucauugaugacaaaaacuuuuaaaugaaaagaugauuaaagucaaacugaaagucuacccauuuauaauaugugaaacaagaucuucuaaguaauaggauaccagucugacaggaauaauuggacacgucucaauuucuaaaaauuuggcauauuuggcuauuuuuagggcauucuguuaugauuucuucaucacauuuugauggaguacgcucgucuuuucaaauaccacucugcuuuuaugccuggaagaauaugucuuuaaaucauggauucuauagucuguaguagacauaacugugaucagagauaaaauucuaggcccauuucugagguuuacuuguuagcagaauaaacuuggguucugaggaaacaucugaguuuugaucauuucuucaggguuugagaagacuaugguggcuuaaugaucuucuguauuccauaacuaguacaccuaguuacagaauugacauagauacauucagguccuggaggaaauuugugguaucuauuaaaaaaaugaaaauugccagucauguaguagucaccuguagucccugcuacucaggagugugaggugagaggaucacuugagcccaggaguucaaggccagccuaggcaauauagcagaacauggucucaaaaaaauaaagaaauaaauacacagccuuggaaggcaaguccccugagauccccacagaguuccuguaacauauauugccagcugccagcauaguauuuuccagaacuuaagaguuaauugauaaauuauacaaucgauacuuucagaucuugggugauuuauauagagaaagagcuguugaaaauuuaggagucuucuacauuuucuuccuggcuguuggaucccuccaugaaccucaguucgguuuccucaucuguaaaaugaggaugauaaugcuuaacuuagggaguuaugaaaauuagagauaaauauauaauaguggccgggcgcguuggcgcaccuguaaucccagcacuuugggaggcugggcgggcggaucaccugaggucgggaguuggagaccagccugaccaacauggagaaaccccgucucuacugaaaauacaaaaaauuagucgcucaugguggcgggcaccuguaaucucagcuacucgggaggcugagacaggagaaucgcuugaaccugggaggcagcggugagccgagaucaggccauugaacuccagucugggcaacaagagcgaaacuccaucuuaaaaagaaagaaaacagaaaauuagagguaaaguauguaaauccccuagcauugugccugacacaguuugugcaauaaauauuaacuguuauuuucaugcauauuuagagaauggguuuguuguucauaugcugaggguguuguugcagccuuagaacacauucuguuacugaagaguaccauggguguauuaauuuauauagugacuuaagcacaguuugcgacuaguuauuuuugauuagcuuauggaaguuuuuuugacuuugaauuaaaaugcaagugucuguggaauacauuucaaauggauuauugggaauaaaaauuaguguacuccauguagugguuaacuauuguaauaucuuuuaaauuuuauuuagcuguuaaauguuucaagcucuaguuuauauacuugcuauccauauucauugugcuaccagaugacauuugaacuguuuaauacagaguuaagauuaagcaaaucauuugaaauuguuacaaccauaugugacuacaguuuuguugcuguucuuuuuaauucuccuuauuuaucaacacuugaguguuucuuuucugugaaacaacuugugagaggugcuauuccuuucucuucagaggcauuucugaaaauuuacugagucuucacauauaauaguguucuuggaauuuguauaguuaaacaaauuuaagguuagcaugaagacaguuauauuaugaagucuuucugacaggaauguccagucaggguucaagacaagcugcaccuuaugcaaaauaacgaggugagguauauauauggugggccuccgaagucauugaaccugguacaaaugggugcuucuccaaagaggucuuacaugacaguagcaauagaaaauuauauaaacuugaaauaagcuuugucaaauauuaugcagaagaugugcauugccaugccuugcaaguaauaggguuuuuuuucuucuuuuuugaacugguacuuuaauauaccuaauuacauccauuugaguuaguauuaaguuuuaauuucucagaaauaaaguagugaaaauugguagcaguuuuguuuuucccauucuugagaauauuacagugauaaacaaggcuugauagguuuguaaaauacuauugcuauuugaauuaaaaaauuucacuauugacuuuccauauucuauuguaaauaaguuggggaauuagugugucaagggggugugguaacaaaugguaauguaauuuucaaauugcuauugcagcaccaaaccacagaaucaauacucugucuuuauaaccacauuugcauauagggauaauaauuuauuucuuauaacuuaagauaacuaaaaugaagggccaggcgggguggcucacaccuguaaucccagcacuuucggagaccgaggcaggcagaucacaaggucagcaguucgagaccagccuggccaguauggugaaacccuaucucuacuaaaaauacaaaaauuaguagggcguguuggcgggugccuguagucccagcuacucgggaggcugaggcaggacaaucacuugaacucaggagguggagguugcggugagcugagauugcaccacugcacuccagccuggcgacagagcaagacuuugucucaaaaauaaauaaauaaauaaauaaauaaauaaauaaauaaauaaauaugagauggcuguugugaagagaaggaagucaguuuuuucucaguauaauuguaaacuuuaaaaaaaauuaaaucaucuuccacuuaauccccgagacuucccauaauguuuaguaauacggacaugugcaaagaauuaaaucguauaauuaaacaaaauuuugucaaguuaacuuugcuucucaaauaaggaaguuauauaauuaaacacauuugcuuguaccuaaugagacguuagcaucaacaugacuguauaucauuuccagaauuuaauucaauuaguuauuggcugagggaugaaauagagaugaaacuaaauccuggccucaaacuaguuuuguaccuuauuuuccagcaauuugguuuuuuuauaucuagauuuuaucuuuacuauuuucccucaucuuacccauucuuagucuccauacacaccuauuaacuuuaauuuccuuuucugagaauuuugaaagcccuauaguuuaugaucuuuuuucccucuuugccuugugaauuuuauauuugugaguuuuuuccaaauuucuaccugucagcucacuucuuuaggcaagguguaagguuuuugagcccccuuauuucauuuuuuauuuuuuuaagagacagggauucacccugucacccagacuggagugcagcgacaggaucauagcucaccacagccuugaacucugaggcucaagggagcuucccaucuuaugcucccaaguaacuacgacuacaaacuugucacuaggacuacaggcauauggcuaauuuuuuaauuuaguagagacagguucuuacuguguuacccaggcuggucucccaccuccugggcgcaagcaauccuccugccuuagccugccaaagugcuggaauuacaggcauaagccacugcacccagccuauuucauaaauaguggauugcacagcauguuuaaaucauguuugcuuuacuaaaguuuuuaucuacaacucccuauaacaacuucaucugcaaaagaaauuagguagagaaaauaaacuacauuuguuuuuauucuugaccauucucgagagggaauaacuugauauugucugaucuaagcguuuaaaauagugaauuugacuugucacaacauuaguuugaugaaagacaaauauaaauuacuuuuguggguuaguuguacaauuaacuuugcuaaccuguccuauaaggcagagguccccaacccuuaggagcugggccacacagcaggaggugugcaguggaccggugaacaucaccaccugagcucugccuccugucagaucagcgguggcauuagauucucauaggauugcaaaccuuacugugaacugcgcaugcaagggaucuggguugcgugcuucuuaugagaaucuaaugccugaugaucugagguagaacaguuucaucccauaaccauccuccucaccgccugcaccaucuggggaaaaauuauuuuccaccaaacaggucccuggugccaaaaagguuggggacugcugcucuuaggacagaaagaaagaaguuccauaacuagaguaaaauaucaccuuacaguaugagguagcuuaacuguggauuuacuuuguuaccuugccccucaguggggagagaagcucuggaauuuaaaaaaaaaaaaaaaaaaagucuuacuguugugaagucaaaauucuuuguacguguaugcaacauguauacaaaacaauagcuaaagugagcauuagucugucuuuuuuuuuuuuuuuuuuuuuuuuuugagaugaagucuugcucugucacccaggcuggagugcaguggcgcaaucucggccuacugcaaccuccaccucccagguucaagugauucuccuuccucagcccccccaaguagcugggacuauagucacgagccaucaugccagcuaauuuuuguauuuuuaguagagacaggauuuugccauauuggccaggguggucuugaacucccaaccucaagugaucugcccaccucagccucccaaagugcugggauuacaggcgugagccaccaugcccagccuaggccuucauuuuagugagcccuuauuuuauuuuauuuuauuuuauuuuauuuuauuuuauuuuauuuuauuuuauuuuauuuuauuuuacuuagagucucacucugucgcccaggguggagugcaguggugcagucucggcucacugcaaccuccgccuucugagcucaagcaauucuccugccuuagccucccuaguagcuaggauuacaggcaugagccaccgcacccaguggguucucauuuuaaaaacguucuugggaaagaugcuuccuucauacagaacuacugaguaucuguuuguuuuuuacugggaacaacccaaauguccuucgcugcgugaauuauugaacugugauacauccauaccauggaauacuaugcugccuuaaaaaaggaacaaacugcagucacaccuuguuuaacauuagggauaaauucugagaaaugugucauuagagaguuuuguugugccaacaucauggagugugcuuacacaaaacuacaugguauauagccuuauagauaucuaaguuauaugauauguauggccuguugcuccugggcuacaaaccuauacaguaugcuacuauacuaaauacuauagacaauucuaacaccaugguuaaguaucuguauauguaaauaaagacaagguaugguaaaaauaagguguaaaauauuuuuaaaugguauaccuaaggcacuuaccaugaauguggcuugcagcacuggaaauuaugguaggugagccagugagugaaugcaaaggccucagacauaauuguacaccauuguaaacuuuauaaaugcuguauacuuggguuccacuaaauuuauaaaauauuuuucuaucuaaaaaauuaacuuguuugcaguaacuuuuuacuuuaugaauuuuaaaaaauuuuuaaaguuuugacccuuuuuuaguaacagcuuaaaauagacauauuauagcuguacaaaaauauuuuuucuuuauauccuugcccuauaagcauuuuucuauuuuaaaagguuuuggaguuuguuuuugagacggaguuuugcucucgucaccaucacccagacuggagugcaguggcacgaucuuggcucacugcaaccuccgccuccuggauucaagcgauucuucugccucagccucccaaguagcugggucuacaggugcccaccaccaugcccggcuaauuuuuguauuuuugguagagacgggguuucaccauguuggccaggcuggucuugaacuccugaccucaggugauccacccaccucagccucccaaugugcuuggauuacagacgugagccaccacgccuggcuuaaaaguuuuuguuguuguuguuguuguuguuguuuuuccuuuaaaauuuuuuguuaaaaaccaagauguaaacacaugcauuagcauaggccugcacagggucaguaucaucaguaucauugucuuccaucuuuguaucuugucccaccggaaggucuucagagacaauuacacacaugacucugucaucuugauguuaaugucuuuuucuggaauaccucuucaaggaccucccugagcuguuugacaguuaacuucugauuuuuuuuuuaaauaaguagaaggaauacacucuaaaauaaugauaagaaguguaguaaaugcauaaaucaguaucauagucauuuauuaccauuaucaaguauuacgugcuguacauauguaugugcuauacuuucauauagucauaugcauauagcagugcaguagguuuacaccagcaucaccauaaacacgugaguaauguguuguguuaugaaggcugugauaauccuuaggugcuaggaauuuuucaccaacauagucuuaugggaccacuaucauuuaugcaguccauuguugacugaaaugucauuaugcagugcgugauuguauugauacagcaacuagaauggaucccaaaagaauugcaggcacaccuaggagauacugcgaguucaguuccagacaaccaugaaaaagcgagucauauacauuuuuggguacccuggugcauuuaaaaguuagguuuacuacugauguuaucauuugaaaaaaaaaagaguuuuauacaauucuguagucuauuuaaagugugaagagcauuaugucuaaaaaaugcacauaucuuaauuuuuaaauauugcuaaaaaauuuuaaucaucugagccuucagcagguuguaaucuuuuugcugguggagagucuugcuucaguguugguggcugcugacccaucaagauggugguugcugaagguuggaguggcuguggcaauaucugaaaauaagacaacaaugaaaacaauguccacguugauggacacuuccuuucauggaagauuucucgauagcaugugcugcuauuugaaagcauuuuacccccaguagaacuucuuucaaaauuguagugaauccucuccaauuuuccuacuaauuuacaacuaaguuuguguaauauucuaaauccuuuguugcuauuucaacaaugcuaacagaaauagacuuaccaggaguagaguccaucucaagaaaccacauucuuugcucauccguaaucaugaacaaauaaugauaucaugagcagcaauucaagcacaucuucaggccccauuucugaaucuaguucucuuacuguuuccaccacaucuguaguuacuuuauccaggguagucuugaaccccuccaagucauccauaaagguugaaaucgauuucuuccacacucuuguugauauuuuguaacuucacagaugcguagguggucaaaaaauaaaaaucuuuaaaaguugauauuuugaccuccucccaugaaucacaaauauucuuuuaagacauggagguguugcucuguugcccagguuggaguguagugcugcugucauagcuuauuguaaccuugaacuuuggggcucaagcaguucucccaccucagugcuggugcaugccaccacauccgucuauuuuuauuuauuuauuuauuuauuuuuguagggacagggucuugcucguagcccaggcuggucucaaacuccuggccucaagcaguccuucugccucagccucccagaguguugggauuauaggcaugagccaccaugcccacaaauguuguuaauggcaucuagcgugaugaauccuuuccagaagguuuucagcuuacuuuacccaguugcaucagaggaauuacuaucuuuggcggccauguagccuuacaaaguguauuucauaaauaugagacuuaaaaauagaaauuaauccuugauacaugggcugaaaaauacauguguuagcagucaaaggaacauucauucuuuuuacaucuccaucagagcucuugggugacaagguaaauuaucaacgaacaguaaguuuuuuaaaaggagucuuuuuuuucugagcaguaggugucaacagaggguuuuaaguauucguaaauagcauaucuguuguaaacagaugugcugucauccaggcuuuguuucauuuauagagcacaggcagaguacuuuuagcauaguucuuaauggcccuaggauuuucagaagguuaaaugagcgcugucuucaacuuaaaguuaaguaucugcauuagcuucuuuuuuuuuuggagacagagucuugcucugucacccaggcuggagugcaguagcgcaaucucggcucacugcaagcuccgccucccgccuccuggguucacaucauucuccugccucagccuccugaguagcugggacuacaggcgcccgccaccaugcccggcuaauuuuuuuuuauuuuuaguagagacgagguuucaccuuguuagccaggauggucuugaucuccugaccucgugaucagccugccucugccucccaaagugcugggauuacaggcgugagccaccgugcccagccaguugaccuaauuucaauguuguuuugucucagugaauagggaggaccaaagagagggagaagagaugggguaucagccaguugguggugcaaucagaacaccuacagcauuuaucaacuaaguucacugucuuauaugggugugauuugugguccccuaaaacaauuacagugguaaagaucacugauugcagaucaccaucaccagacauaauaaugaaagaguuugaaauauugcaagaauuaccaaacuauuacacagagacaugaagugagcacauguugggaaaaugguacugaucgauaugcuugacucaagaguugccacaaaccuucaauuuguuaaaaaaaaaaaaaaaaaaaagaaagaaagaaagagaaaagcaaugucucugaagugcauauagguugaguauuuuuuacccaaaaugugugagaccagaaguguauuggauuuuuucagauuuuggaauauugaaauaucuuugggaugagacccaaauuuaaacaggaaauuuauuuguuucauguguaccuuauacucauagccuaaagggaauuuuauacacuauuuuaaauaauuguuugcauaaaacaaaguuuugacugcaacucaucauguaaguucagguguggaauuuucuacuuguauuguuaaguuggugcucaaaacuguuggauuuugaagcauuuuggauuucacauuuucagauuagguauacacaaccuguguguguuccuguauaguacuaagggggaaaaguaccuauuuuuaaaugaauauccucugcaaaauaacauucauauauuuaacauaguucaauuguguuauuuuuacuaagccauguucacauguauagagcacaauagaaauaccucuaacacugaacaaauccaaguuacaguuuuuguuuucacuuuguauaccuuguuuuuuucuaaaugucaguucuuuucucauucuccuuuuguuaggucuugcuguccuuucauuuuuuaacuccucgucauuuaaacuaaaaagaaucuguuaucuguauuuuucauuguccaguugcuauaauaugguuuugucaagaggcauuauucaaccagauauuuauauuauaagcauauuaucuguaagaugaaauaaaagauuucauccccuauaaugacauaccaagcaucaaacuggcagaugauaacuaauuugagggaagaggguaauguaaaugcuuaaguuacacuaugguuacuauaugaccaugagacggcgucucacucuguagcccaggcuagagugcagugcugcagucuuggcucaccacaaccuccaccucccagguucaagcaauucuuuugccucagccucccgaguagcugggauuacaagugugugccaccaugcugcuaguauuuauauuucuaguagagaugggguuucaccauguuggcuaggcuggucucaagcuccugaccucaagugaucugccugccucaggccucccaaagugcugggauuacaggugugagccacugucccuggucuaaauguuuuaaagcaaugggaauggaaugugaggagaucaaaaguaaaagaccaccaacuuggggaggauacagucucuguaauauguaaaauggaugauuaauuuuuguguauggugugagauagggguucagauuuauuuuuauacgugaauaucuaguuuucugcaccauuaguugaaaagacuguucuuucccccauugaauugucuuggcacuguaguugaaaaucgauugaucaaaaaaugugguuauuucuggacuuucaauucuauuucguugauuuauaugugugucuuuaugccagugccacacuguuugauuauguaccuuuguagcaaguuuugaaaugagagcuccaauucuguucuucuuuuucgaguuuuuuuuuuuuucuuuuugccuuuggcuauuccagaucccauuuauuauucuauauaguuuagggucagguugccaguuucugcaaagaagccagcuuggauuuuaauugggauugugucaaauauguaagucaauguggauaguauugccauuuaaaaaauauuaaaugagaaauuuuaaaaaauauuuaaugauuaauaagaaugauaaacauugcaaguuuacaugauaccauauuuuguacaaaauaacuuaaaaaagaagaaucccauuguuuuaacauuuuugcaaauuuccuuaaugucuggcuuaaccgaagaagauggcuggguucacauaccugcuuuugcauucacucugauauaugugguuuggguugaaauauaagaagacaauuuuggccaaacauagauacaaagauaaaaaggggaggaccucaugaacuuuuugaaaggaucuuggugacccugcagugguccucagaccacacuuagagaaccacauguugaauggaaacaaguauguguuuggaaacucagagaccuaauugaaauucacagcucugccucuuaacaacugaacaaguuaaguuacuuagccucucagucuguuucuucauuuauaaaaugaagauaaugacaucuccuuuuagggauuuuguaaggaggaaacaagauaaugccuguaaauguuuugguauguggaaaccgcuaaagaaauuaugcuguuuucauucauuuauauuugucgaccucucgcuauaggauuagcuaauuuuuuuccagugaaagguacaaauaguugggaaaugagagagguuggaauuuuaaauauacuuauguaguaaaaacacaucauauagacauucagcugucaauuguugacucccaaaaaaggacaccagaaaaaauguguugaucaaaguuguauuuauuagauuuacuggaauaggggcaaacacaacuugacaaagucuuaguagucucaacaugaaaacuuuaguuuuuuauagugguauuuacagugagcugagcuguauucauauaguuuccuauuauccggccuuuuaacuacaaauguuauugaacaaguaaaggaaagggaagggcuaacaaaaaaagguaaaaauuuccagaaauggaggaauaaaauuaguagcaccuuuaaaaccauuugccacucacccuaaucccacuaucaacuguugaagaaugaaagaaacugcaaaaauucuccauuaaauuagagcacagggccaggcaugguggcucacucacgccuguaaucccagcaguuugggaggcugaggcgggcagaauacuugaggccaggagcuugagaccagcuugggcaaccuggcgaaacccucaucucuacuaaaaauacaaagaaauuagcuaggcaugguggugcacuccuguuaaucccagcuacuggggaggcugaggcgugagauucguuucaaccccagaggcagagauugcagugagcugagaucgugccacugcacuccagccugggugauagaguaaaacucugucuaaaaaaaaagagcauagugcuuuagcauguauuuucccuguuaaaauuaauaaaauguaaauaaccccaccuccuuaaugauuccauaaauacugacccaaaucauauacaaaguucuaaaaaauaaauuccugugguuaaaacucuguauuauuccaaugguaauuuuaauuuugaauguaucugcaaaacuaaagugauaggauuguugcccacccaggacguuauggauucacucagcauucauucaugaaauauucguugauaauuuacuaugugccguguacugccuauauaaagcagagaguacuugcccuuauggauuuuauuuucuagugagugagacaaagaaugaaauauuuaaguauaauauagugucagauagaaacuauugcaaugauuuuaaaaaaggagguugagguuagaacaugauggaauggagcguagggccuguuuuacacaagguagucagagcaacaucucuugacauucaagcaaacacuugaaugaaaugaaggaaaaagccaugagauauaucagggaagaauauuuuggauggaaggaacagaaaguacgaaggccaugaaagaaguacacacuuggaugaaguugcagguacacuuguuuacugaaguucagcaguguuuuccuguagacaauugggaauuaaaauaaaaaguacauaaagaauacuggaggugugguucugggcugucagcuagguguauucauuaguuacgugaaucauucccacaguagucucuucaucccaaauguaguggauuuggggggacacuugugacgucuaaacaccaaucuuuaaucuccauauaucaaggauuuccugucuucuuaguguuuaaacaaaagaugccauaguuuuucuuaaacaaaaguaccuguguuuagacagacugauaaaucuuagcuauuagaaugugagaagucauccgauccaaccucaguggugugggacgcauccaggggcaaucaccugggcagcuuuuccuaaaauugugugcuuuuccuugucugucuucuuccaggggauaucagaauaggggaagaggagaugccuggcucaugccuuucgagcaagugccuguggguaucugaaaucaggcagauaauguuuuuauucuuugcuugaacuauucuagugacaagagcgcauuccuaagagaauguuugucuccacauuguauuucuuuguuucagggucugaagauuaccagauaaauuuuuguucuguucucuuuuuuguucuuuuuuuggauauagggaggaaggcgauaggcaggggagaggaaaucgaccuggucccagacacaagugagauguuauccuaaaagugcaucagugucaaugucaccugugcccucuucccuucccuuccucuccacccugaagagaauagaauagaugggaugggaauagggaugggagacuuuguuugcacucaagacccuccagccuggcucaguugugcuaaaaagaggaaaugguggacaauaauucuauaaauguccucaguaaguaauuaucuccccuuuauauuccccuuggcuguuuggcacccuucuuaggcuuaucagguuguauuacauauuguugcugacuaagaugcuagaaccaguacccaaagcacaugagauguuaucacagagccaggcaaccagaccaugauguuaucugugugauuuuaguuuuugucuuacucaggaugguuugaccacagaaaagaaaugguuacgcuggagugcagugucacuaucuuggcucacugcaaccuccaccucccggauucaggacauucuccugccucagccuccugaguagccaggauuacaggcgugugcuaccaugccuggcuaauuuuuguauuuuuaguagagauggaguuucaccauguuggucaggcuggucucgaacuccugacaucaagugaucugccugccuuagccucccaaaauguugggauuacagccaugagccaccgcgcccagccaagaaauguuuugaaggacauuauaaaaaccuuuuuuuaagaucauuuuaauaaguugauuugagaaagaagauggucagauugguuuugucucgaguaauuuugauaacuccuccaucuuuugaacucagacaccuaucauauuguucaguaugcuugacaaauuauaaacauuuugguggaaggcaugggauagaaaacugagccuguguagaacuuaacuacauuucuaaaauuaaauuaauuuuuuagaacuuuuuuuaaguagcauuuuuaaaaaucaaaacaguacaugcacauagaaaucaguauggugggucugcauuugacuaucauucucauccucuguuuuaucaucaggauucaugaguuacuugaagagaauguuucuagcaccaaaaaucaaaugaauuuuuuuaaugcuuccaucaguuuaucagaauuaugucacauuguuacuucuuaugacugucuucgauuuuuuuuucuggaguuucuaauugucuuuuuuuuuuuuuucugguugacaagcaauagugcaccaucagcauauccucaagauuauccagucuguguuuccaugagauuuuucuccuggaaucuuaugucccgcucacaggucucauuccuucacugcccuacuagguugaaucaacuguuugcugaaucuuauggcuccuucucuuguuuuuuacauuaauuugucuagguaauagucugagauauuuucccgaggaagguugcuuaggaaauaaaccuucugagaacuuauaugucuguagucuuuuuucuuuucuuuuuuuuuuuuuuuuuuuuucuugagacagagucuugcucugucgcccaggcuagagugcaguggcacgaucucggcucacugcaaucuccacuucccagguucaagugauucuccugccucagccucccgaguagcugggacuacaggcgcgugccaccacacccagcuaauuuuuguauuuuuaguagagacaggguuucaccauguuggacaggauggucucgaucuccugaccucgugauccacccgccuuagccuccuaaagugcuaggauuacaggugugagccacugccccagccugaagucuuuuuucugacaucagacuugauugaugcauagaaugcuaaguacagaaucauauuccuuuuguacuuagacauauuucuagugucuucuaacaucuagauugcuguuaagagaccuguugccaaucugauauuucauuuuauuuugaaauuuuccaaacguacacaaaauuugauaaauuacucaauuuuacaguuaaccuuuugcucuuuuugcuuucugccauauuaauccauguuuuaugcauuuuaaauuaaguugcagguauuauaauaguauacaucaccccuaaacacuuggacaugcauaugauuaacuagaguugaauguuugauugcuuuuuaaaggcacauaugcauuuagaaaaaugcacaaaucauaaauaugucauucaauuaguuuuugacaaauuguauacaugucuacaacccauacauccauugagauauagaacauugcugucacccaagaaaguucccucauucucuuucccagucaucgcccccccaccccauaccccaagaggcaacaaccaaaauuuccgauucuuuuccaucauauauuuggcugucuaggauuuacauaaaugaaaugauacaguauauacucuguguagggcuucuuccauucaacauguuuuucagauuuauccauuuuugcacauaugaauauccuuuuuauuacagaaucguauuuuauuauauaaauacacaguuaauuuuuccuuucuguugauggcuuccaguauuguuucuauuuaguaauuuaagaauguuuuaaaucuucgaauaagaaauaccugcuaacaugcagugcacaaaaaucuacuucuuaguccuacauuucuuuauuccuaguuuuugaaauuuuguuaauacaaaauucagucaauuuaauacugucaaacguuuuaugauuucuuguucucaguaauaagagcaggaagaagauuauuuaaagucauccccuuuuuaaaaaaguuuugaacauuuguauugaaacuagaauuaaccuuucuaacucuuaauugacuuuagguaaauagguguuuauauuaauuagguguaauuaaguauguaucuuuccuagaaugcauuuauaugcauaugcagcauaugaagucauuuaauuuuaaagaacacauauuguaugguuugguuuuguuuugguuuguuuuuuaaaaaaauggggucuuggccaggcacgguggcucacaccuauaaucccagcacuuugggaggcagaggcagguggaucaccugaagucaggaguucuagaccagccuggucaacaugaugaaacccugucucuacuaaaaauacaaaaauuagcugggcgugauggugggugccuguaaucccagcuacucgggagacggagguugaggcaggagaaucccuugaacucgggaggcggauauugcaguaagccgacauugcgccauugcacuccagccugggugacaagagcgaaacucugccucaaaaaaaaaaaaaaaaaaaacaaaaacaaaauggggucuugcuauauugcugaggcugaacugaaacuccugggcucaagggauacccagcuuauauaguuccuuuuauaugauauauucacagugggcaaauccagagacagaaaacagguuagaguuuaccaggaguugggggaaggaaaaaaauaguuauuccuuaaauggaauggguguuuuacgggguaaugaaaaaguuuugaaacuagagauagcugguagagacaaacauugugaauagacuaaauacuacugaauuguaccuuuaaaaauggucaauuguguuugauuuucaccucauuuaaauaagaauacauuacauauguauuucccuugacacaaagauguguaacuuuuguauuauaaauuuuccuuuguucuuugguaaagauuauugucaguucuacuuuucauagcuuuuggaauggcaguuuauauucauaagacccaaguuuaaaaucuuuucaugaucuggaaugucuuuuccagcugaaguuuuguuaaguccauaugauaaauuacaaaugaaauauuuugguugucauucuauguuacacgaacuauuuuuuuacacacuccacagcuuuuugugaguguugauuuucuuuuuuaaugaaugcugauuuugaaaauuaaagcaaagaaaggguaaaggguguuuuuagucuagcauuuaaguuuuauuugugauauauggaaauuucuuuaugccuuuucuuaggcaagcagcuuucauacagcuacucuaccauguuuuuguugcauuuaccuugcuacugaaauggagaacccaaugguaaaauagguggcaguuuaagagaauugacuuaaauguuaaguuuguaucacuuguacuucauuagcauuuaacaccuauacuguaauuuuagaaagggcuuaucuuuucucaugucauuuuuuucuuggcuuauguggcauuugugaaaaugcuuacagaaauacugguccuacgauaagggguaauugguguucuuguuugugaaagucacaccaaggucacagaaauggcuacugauuaaauuguuuccaucaucaaagauauaccucugcucaugacuuaguggagaucuauuugagucaaaauuucaauauaaaauauugugccuucuuucuuuuuucuccucuuucuacuuguccuccucuuauaaaaguucaacuuuaugcuuguaucaaguauaaaucauuuuaggaaucaagucaauuaaugugccuuuauccccaaaauuuaauggguuuauuagggaaauuuucaaaauggauagcuugucaggcauacuacaauuauacuucguauuuuguucagacuuuguaauguucuuagaauuguuaguugcuuacagcaaauuacauaugcacuuagaagaccuucugucuugacucaagucaugaagguuaagaaaaaaauaaauccauccaccaguggacaagggaccuauaccauguaauccaaauuuguaaguuauauauagacagguggcugaggaaaucuauaauuuccucauugauaauaguuuuaagaucauaggcacagaguagugauucccugccauucuaucguuaacacuuuuaucuagccaaugcauggcaguagguuaguaggagaugcaggcaaacugacaaguuuguuuuuccucauagaaaauuagaaacaaaauuagaagugggagaggcugcccgcuguagcugcacuagcagcaggaacugauaacuaaaaucaaagaaggaaagagaauuauaaaagguauuaaguaguuuaaaacuauucgggaccauuuagcacagaauaaauuguccauguaccuaguagaaugaaaaacugccaagguuauucuauugcacucugguauuuuguuuuuaaaacaauaaugaaaaaaaaacagugcaacagucaucuagaaaauauacuuauucuuugacuaugccaaguaauuaagauauuacgaaauaauugaguguacauuaaaaguuaaaucacguugaauugcauaggaacacugauaguuauuucaaacucacauuagugaaguaguauauaauuuauaguuuugucguuuuacauugugggguauuaggagaaucuuuucaaauggaauuccuagagugauugcuguuugagaucgggggguguaucuuucugguuucuuucuaguucuauagcuuuuuaaauuuuuugagugaaaugucaaaaauuauuguaaacugauuugagaguuguuuucauuaucugauucauuaagcuucagauuuuaacucaguauuaccuugaaggcaaauguuuauuuuaauaugaaaaugauaguucauuuguugaugcuaguauuuaugacuguaucauaaauuaacaugagcugcuuagagucuaauugcaaaauugaaaaguuagcauaaauuauccaucauauaaaugaaaaauaauuucaguuuauuuaguaaagaaguuuuugugucuaaugugcaagggauuuugcuuucagcauuguaagauuuaauaguaaaauauaugcuguaauaauuaugaaagcauaccuacaucucuuuuaacuuauggcaugaccuaauccagaauuuuuuuuucuuuuuuggggggugcggggagggacagggucuugcucucucacccaggcuggagugcaauggcaugaucuuggcucauugcaaccucugccucccgaguucaagcaauucuccccccucagccucccaaauagcugggauuauaggcacacaccaccacaccuggcucauuuuugucuuuuuaguagagacgggguuucgccauguuggacaggcuggucucgaacuccugaccucaagugauccacccgccucagccucccaaagugcugagauuacaggcaugagccaccacacgcggccuaauccagaauuuaaauucuucacaguauagacuaagucaacaaccagugauagcuucacaauuucuaaugagugacuugagagugacaaucugauaguugacccuagguacuuuuuucacagcaaaaauacuauauuuauuuagauuguauauuaauuaagggaggcuuuagaggaaguugauagagauauugguucuuaaaaagcccaggucaucauuggcacuccaguuuaaguuagcuuucuucacuguaaugacuugaaaaaguagaguuguuagaaauuuguaauuucuuacucauugugcaaaccaggacauauuuuuaaaugaaguaaauuuugugaaguggaacaguuugauagguaguuuguuguuaacauugcuuuuuuuuuuccucagagacaggcccucacucuguugcccaggcugaagagugcaguggcaugaucauagcucacugcagccucacccucuugggcucaagcgauccaccuaccucagccuccuuaauagccgggaccacagacaugugccaccgcauccaguuaauuuuuguagagacagggucucacuguguugcccagggugguccugagcuccuuaacucaacugaucuaccugccuuggccucccaaagcacugggauuacaggcaugaggcaccgugccuggcucuaacauugcuuggcauccauucuaugaauagauuucuuggcuaucuagauuauguuugcuuagauauuugaaagagucuuucugaacuaaaguucaggcaaaugggaggaaauucaguauuucauacugaaaugaaguacaacccucuguuccuuuuuuauaaaguggcauuugugcuuuuuaggaucacaauauguuguggcaaaaggcaaacagcagugauuuguacaaaauuucagcagauccagauuagcaauaauaauguuuccaagucaucaccauggaaagaggaguaggaaggaauugagauguguagcaguugcagaaaucagggauucaggagcaucaaaauauuugaaugucggucaagcugaugcccgaucaagcacuguuauaagaagguuucaaaaugugauguuuuuacaaguuuguauauaaccugacuuauaugaaucauguugaaaguggccgauguuaauauucugcuauucugcugagguuuuuguauguguuuuuuguuuguuuguuuguuuguuuuugagacggagucucacucugucgcccaggcuggagugcaguggagccaucucagcucacugcaaccucugccucccgggucaagcuauucuccugccucagccucccaaguagcugggauuacaggcgugagccaccacacccggcuaauuuuguauuuuuaguagagacaggguuucgccauguuggcaaggcuggucucgaacuucugaccucagcugauccgcccaccuugccuucucaaagugcugggauuacaggcaugagccacgacgcucagccucugcugguuuuuuaaacaaguuuauugagauauaauucguguacuguaaaauuaacccuauuaaaguguacaguucauucaguuuuuauauauucacaaaguuaugcaacuaucaccauaucuaauuauagaacauuuucaucucuccaaaaagaaaccccauacccauuagcagucccuuccacauucucccucuuccccaguccucagcaaccacuacuuuucugucucuauagauuugccuauucuggacauuucauauauguguaaucauauaguauguggucuuuugcaacuggaugcuuuauuuagcauaauguuuuugggguucauccauguuguagcaugaaucaguacuucauuccuuuucauuucugaauaauaugcguuugaauggauauaugacguuuuauucaucaguugguggauauuuggguuguuucuguuuuuugguuauugugagcaucacucuguaaacauucuuggacaaguuuuuauguagauguauguuuucauaucucuugguuauaugucuaggagcagaauugcugggucauauugguaacuauguuuaaccuuuugagaaacugccaaacaguuuucuaagguggcuauaccauuuugcauucucaucaagcuguggauuaggggugggccccuauuucaauauauuaauaacuggugucuauaaaaaggggaaauuuggagaccguuauucauacaggaaaaaugccacaugaacaugaaaauggccauuuacaagccaaggauagaggccuggaacagauccuacuugaccauuuuaaggaaccaacccugccaacaccuugauuuuacccucagaacugugcaaaguuaaauuuuuguuguuuaagcuacccaguuugucauacuuugucacagaagcccucgcaaacuacuacauaagugguccauguccauucuguccuagcaaauaggcaaacuucuuuuguuuugaugacacacacuccugcugugacauacaguaguaaacuuaaaaguaaaauaagucgggcguggugguucacgucuguaaucccagcacuuugggaggccaaggugggcggaucacgaggucaagagauggagacuuuccuggccaacauggugaaacucugucucuacuaaaaauacaaaaauuagccaggcaugguggugcgugccuguaguccuagcuacucgggaggcugaggcagaauugcuugaacccaggagguggagauuguagugagccgagaucgagccacugcacuccagccuggugacagagcaagacucuugucucaaaaaaaaaaaaaaaaaguaaaauagaugucaucuguccugacggaaauacaaaucaaagccauagugagauaccuuugugucuauaauuacaaaaaucagauaauaacaacaguugaaaaggauguagacaaauuggaauccucauauacugccaguaggaguguaaaggguguggucauuuuggugagucuggaaguuccucaauuuguuaaacacuuaaauaaguaaacaugaguuacccugugacccaggaauuccacuccuagguauauaaccaagggaaaugaaaauaugaccaaacaaaacuguacaccaacguuuauagcagcacuauuuaucguagugaaaaaguagaaacaacccaaauguccgucaacugaugaauggauaagcaaaauguaauauccaugcaguagaacauuguaugacaauacgaagcaaugaagggccaggcgaguggcucauaucuguaauccuagcacuuugagaugccaaggcgggaggaucccuuguguccaggaauuugagaucagcuggggcaacauaauuucuacagaaauuaaaaaaauuagcugggcaugguggcauacauuuguggucccagcuacgugggaagcugaggcaggaagaucacuuuagcccaggagguugaggcugcagugagccaugaucuugccacuguacuccaaccugugcaguggaacaagacccugucccaaguggggggauggggggagggaagggaaggaaugaaguguugacacauguuccaaugugaaugaaccuugaaaacaugcuaaguaaaagaagacaguuacaaaggaccauguacuguaugauuccaggcauacaaaauguccagaauaggcaaaucuauagagacacaaaguaaauuagugguugccuugggcugggagaauggaggggauuagcaggugaugacuaagagcagugggguuguuuuuugugguaauaaaaauguucuaaaauugauuguagugagggucacacuacuccgaauauacaaaagccauuuaauggcuuuuauaccauucgguaguaauaugccauuguaugguaugugaauaauaucucaguagagugguuuuuugaaaacacuagaacauauaugaucaaaaaaugaaaaaaucaacuagaccugguaaucuguguuuaagaguagcaguugauugaucauuuauuaugcaugugcuaugucagacuuuuuuuuuuuuuuugagauggagucucgcucugucccccaggcuggagugcaguggcgcaaucuuggcucacuacaagcccugacucccggguucacgccauucuccugccucagccucacgaguagcugggacuacaagcacccaccaccacacccggcuaauuuuuuguauuuuuaguagagacaggguuucaccguguuagccaggauggucucaaucuccugaccucuugaucugcccgccucggccucccaaagugcugggauuacaggcaugagccaccgggccuagcccaaaacugucauuuugaagcaacacuuacuagaauucauauagaaaaaaaaaacuauuaaaauuccucugcuuagauucucuaggucuuacaacuuuaucagcuaccuguuuaccuagaucauauugcucuagcauccuuuuuuuuuaaacccaaagaauucuucacugaucuugcuuauuuuagaaauauuuuuagcuuuacuuguaagaaagguacugcucuuuaaagauugaagagcauaagaugaagacugaaaugugggaucuuacugccuuuuuucuuucuuaaucagugacuuuuaaaccucuaugaagauccagaucuagaauucuaggacaagugcccuugugguucuacuuacucuacggugguaauuagcaauuuaguaaccuuaaggaaguauuuuguuguuaguuuauugcucuuuuuuuccucuacuaauuuuacuuuuuuuuuccuuuuuacuguccauauuuaacguaaguauauccuuuguaucuuuuucuucccauacuauaacaagggucuugaaacucuuuaucucugauuauucuacuccugcacuuuaaauuguaagugauacaaauccaaagcauacaaacucaacaaaacaggagucagagaauuuacuaaacucaucgaaugccagguccagaaguuaagaggcagccagguucaggucucagaugguguaauccgagucuuauuucuucuccacagguauucuguagacagcuucuuucauguugccaggaaaaauugguuacuauaaauccugacuuacuugguccuuauggcucuugaucccgauagcagugagccaguggcaaggaugaucauauggcauauucugaaugacccagcuuaagucacauguucaacauugaacuguggccagggacuggaguauaguucaugucuaggucauguucucacuccuggggcuggaaguggaacuuaacugccaggcaaggcugcugacauugagugauauuauuaccaggagagguggaggaacaagguauucaagagacaaaaauaauagaggcuaguaaguguaguuaguauacauugaacaaaaaacaugggcccauguacaaaggaaugacaucagaucuuagaauacauuaaaacuauguaauucuuugaguugcauggagcccacagugcuagagaaguacguauuuuaagagauacaguggauaaugauaaaugauaauggggcuaaaaguaauaaaacauuagaaauaucgaguuauagauuaauugguucaaguguaaugccaauucuuuaagcacacaucauaagcagcugauacgaaaacaucaguuuucacacauugguaccauccaauagaguuguauacagugauggaauuguuucguaucugcacugcucaacaugguggccacuagccauauaugccugcugagcaguugaaaugugucuaguguaacuaaagaacugaauuuuuaauuauauuuaguacugaacagcuguauguggcugguagcuaccuuauuagacagcacaacuaucuaaauuuggaacaacuugaucaauauccugccuccuauauuuaauuuaagauauuggggaguuuuacaaaccuugcuugcuguuguuuucccauuuguaaaaugagaguaaauaucuuauaauaaauaaccuuaguggguuauuuuaaggauuaauugacuuaauccauguaaaugugccuggcacucaccuagcauuuagcauuuaaguguuagucuuuauugucauuguuauaucacuaccuuagaaugggagcuaaagaaaugaguagccaguaauccaacaguuaaaaauuuuauugaacaucuuuggagcuguagcaguugaacaguuuauuaauguguauauuauuauggacugaguacagaauauguaguuuggggagauuuagggaugaacauuucaguacugucuuggcaauuuaaaauuuuuaucaaacaaagguuucuguacauauuucauggugauuuggucaguauuuuguuucuaaggugguuaaauguguuuuuaaacuuuuaaaaugauaaucaucuuccuuuuaggauuccuuaaggguuuucuucucugaaagucaaaauguaauuuaaaaaguuuaaaggguuacuacuuuuuagccugucuuaacuuuaaaauuguuuuacaaaaacuuaaaacuaaaauaccuuaucagugguauuuaugauuccacaaagugugugugugugugugugugugugugugugugugugugugugcaugcgugugugugugugguuuuguuguuguugucggagacagggccucgcuuggucucccaggcuagagugcaguggcaugaucacgacucacugcagucucgaccuucugggcucaagugauccuccugugucagccucccacacagcugggacuacaggcacaugccaccacauccagcuaauuuaaaaaacauuuuuuuuguagaaauagggucuuaccauguugcccaggcuagucucaaauuccggggcucaagcaauccucccaccucaccuucccaaagugcugggauuacaggcaugagucaccauacuuggcccacaaaauauauuaccuucuugcauuccuugcuagauuguuauuuuguccccugagauauuuugggaugguagaaaaucaccagguccauccugcauuucuucuaauuuauacuauuuuugugccuuuuaaaauaucaacccuuggcuagaaguauauuuauaugccuuaaucucuguauuaucaauuauuagauacuugggcugagccccuuggaccaucucauuucccuccuuccugcaguaggauccaacuauuuacuacugucuguaauucaguauuuuagacacuuguuuaguaguugguugucucuuaucacuaguugauugaaggaacugucuaucuccaugaauguuugaaguaugcccuggcagagcucuuuauguuuuuggaauguggagcugacuauagcuuucucucaguaauaaauucaucuaaguaaugaaacauucacuuacuaaauaaaaggaaaaagagauacacucuuaauuuaugcuaugcgcaguagauagaguugaacaaaaguuuuaaauauuucacuaucaucauguauaauucaguucgcaucuguuccauaacuuacuaaaucaauucagugagagggcugagauuuugaaaugaccaaaugacaaauuuucccugcagugauggcauggaaaucacuuggucuuuguuuacaaaguuggcgcauguauauauuauucugcaggaccuauugauuuuuccacucuaaaccacuuaauguuuaaaauuucaaguucuuaggauuuauuaguaacauugugagcauacuaaaaauugaaggcuguguaaaccaaagaauuuaaacaugcugcaggugauacuuagauucccuuugucucaguucuaacucaaacaugaagcauuuuuacuuuaccacaaucuaugauauuuugacacauuucuuucugaaucuuuuuucaggcuggagugcaguggcgcugucucggcucacugcaaacggccucccagguucaagugauucucccaccucagccucgcgaguagcugggacuacaggcaugcaccaccacauccggcuaauuuuuguauuuuuaguagagacgggguuucaccacguugaccaggauggucucaaucuccugaccucgugauccgcccaccucagcuucccaaagugcugggauuacaggcucuuucugaaucuuucauuuaaaccauuucacuaaaaaugaaaauuauaguugaaauauuuagaaucauagaaucuuuggauaagaauaaaaaauauacaaguugugguagagacuugaggugcuuaucuguacucaguuaugcuuucugggcaucuggaacaguacacuucccagucccguugcacuuaggugguaccaggugacucauucuggagugugaggagagacugucguggaggcuguauguuaagauggcagagccacuuacagaaagaagccaggaaccccaaacuuaaagcauccugagucucugaguaugacauggaaggcagauaauaaauauaaauauaaaaguuguucuuagugcaagggacauacagaaacaggccacaggcccuaguuuacuaacuucugugcuugucaccugagugguaacaaauguaugguacaaccaagacaaaagucuuucuguuaauccaguaaguuuuaaggguuaauuaucacagcauuacuugacuuacuagaucacaggugaucucaucuaacugucugacuccgucagauuucuaaagaaugcuucugauaccaggaaucucugcacuguacauucugugagaugaccuguuccauugauggacaacuuuguaacaaauuuuucucuuuuuagugagccaaaguccugauuacauuuuaucuguugguuccaauuuugccuucggauaaguuuuauauuuuguggcagcuuuucauuauccaaagauaguuuucaggucucccuggucuguuaacguggagaaaacagaauaaaauagcaaaugacauuuuaaaaaauguuaagcuuggugggacgugguggcucacacuugaaaucccagcgcuuugguaggccaaggcaggcggaucacuugagcacaggaguucaugaccagucugggcaacauggcaaaaacccgucuccacuaaaaauauaaaaaauuagcugguugugguugcaugugccuguggucccagcuucucaggaggcucaguuggaagcaucaccugagcccaagaugucgaggcuguagcgagccaccauagaaccacugcacuccagcuuaggugacaaaagugagguccugucucaaaaacaaaaaaaaaaccaagcuuaaaauaaaaguuguauuaacuagaauauaauaaacuacauuuaacuuuagaaaaauuaacuacacaagcgguaagaagauuugacccaguucugagaaaaaaacugucagcuuaguauaaaacaauaaaaugaccguuaaagaauuaacugaauuauaggcuuggcguuuuguuuauggcaaauauuucucuccuguacugugaaugaguccagccaucuauuacauuaaaggccaccaaguuuuaaaggaaaaauugacaaaguuagucuagaggaauggucaccagaaugucucaacaaaagucuagauaccguuaacacagugaauggcuaaaggaauuagagauacuuaaagagaaacagcccauugcacaauaucucauaaucucagauaguuacaaugaaaucugucuuuuauaaauuuucuuucucuaucuucacagcggugacuaauagcuguucguaggaaugaggcguaugggcauccaggcuuuacauuugaucuuucuagccaacaucuuucaguuauguguuugaccaucauccccaaagcuucuauaggauauuuggucaagaacuuuucugaaaucauacagcauauagucuguaguauauuaacaacauacuaauucuaucaaaaaagaauuuaaaguugaguauuagaugauaugacuuauucugucaaugccaauucuuaauuauuuggucgcuuauuauuuuuuucuaguugcauuucuucuaguaaucuagauuauaauuuugguaggauuuggcaucagauauacuaagccauaagucuuaaacuuacaccauuuguugcaaauugagaguucacuuaccaauaucuagacuugaaaaaucuuaucuccuuaauugaauaaaacuuuccuucucaaauuuauuuacaccuucagguucaugaagaccugcacaguugaacuuauuuuaaguggccaggugcuuucaucuuuacauuccuacuuuagucccauacuuuaucagguaucuuuuuaaagccaacuaugcuaagucaacuaaccuuaucugguugggauaaauucaucuuuagcaaaggaaaacguccuguuucaaccucaguaaauguuaacuguuccuuuuauuucauuucuuaugaaaauaaauggaccauuuuauccuuuuacuuugugccuuuacuguuugcugucagguugauaacuagggcgaccacauuaccuguugcccagcaaaaauaauaguauccccuuucauuaugaaaaguauuccaguuuggauaaguuauuuggucauccucacuguuguuuaccauuuuuggcaaugauuggcagaaaugucuuaugugaguguuucguuucauuuggcugauaaccuaauuuuuucauuuaccccuugcaacuaacaaguagucuaugagaucauacucaggcacucugaaauccuuagcauggggaauaaaugcgugcaugugugucacucuugugcuggggccauauaauauaauuuuugcuuaugcacugccaaagcaaacuuaagaauugccuuuuaauuuaaagcaagaaaaaucuucuuuuuucuaaaaacuuuggugcauuuccugauuugcugagaaugagaacuguguacauaucuuguuccauuuugcucuugcugccacgacuccuagguccagauuugauccacugucaauucugcaucagcguuuuugguuagcauaugucuuccuuucgguaagggugauuuauuugauuuuauuguauacuuuuuggcucuuuaguagccauuuaaaauuuuuggcaagguauuugguauaaaaucauaacaacuaucuuuguaggacuccauaaugauagccauuacuauuuaaauaaguugggaccagggugcgguaaauacccaaagcccaguggaauacguuuauaauccuguuaugggaggaaaagaccaaccacuaaaaauaagcuagcuauacaacaccagccuuaauuuuuuugugguuacaguuuagcucuuauguauuauucuauauguguuaguccauuuuugcauugcuauaaaggaauaccugagcauggguaacuuauaaagaaaagugguuuguuuaggcucaguguucugcaggcuguacaggaagcguggugccagcaucugcuccuggcgagggcuucaaggagcuuacaaucauagggaggguaaagggaaagcaggcacaucacauggugagagcaggagcaagagagaguggggaggcgccgcaugaaucacauccucuaugaucucagagcaaaaacucauucaucaucacaaggacagcaccaagccauucaugagggaucugcccccaugacccaaacaccacccaccaggucucaccuccaacauuggggauuacauuccaacaugaaauuugaaugagacaaacauccaaacuauauuacuguauauuuuguaccucuaccuagacaguaaguuauaugcagcuucuuucuuaccauguguaauauuguacuuagaaaugagauaaaugaaaugugcauucugcaaauggugaauuuaaauguugcagaaaaauuuccuuuuuuuguuuuguuuuguuuuuaagacagucucacucuguugcccaggcgggagugcaguggcaccaucuuggcucacugcaaccuccgccucccagguucaagcgauucuccugccucagccucccaaguaucugggauuauaggugugcaccaccaugcccagcuaauuuuuuuauuuuugguagagaugggguuucagcauuugaccaagcuggucuuaaacuccugaccucaggugauccacccggccucugccucccaaagugcugagauuacaggcgugagccaccaggcccagccuaaauguugcagaaaaauuucuauagugcagaguagagugagauuggucucaaagugucacauuucccauauguguagguccuagcacauagauuuucuuuauauuuuuauaaauaaauauguaauacacauucauagaggacaaaauacagauaagcaaaaauaugaaaacuagccaccaauaaauuacuauuuacuguuaauauuugguguauaaccuuccaaacuuuuaaaaguauauuuucuacauugccuggcaaguaguuaucacaaaauggauaaaguauuccuuuuucuuauuuuaacuaaaaaucagaucauacuguacauaccauuuuauggucugcuuuuuuguuucaccuaaaaugucaucauccucuucugcugccaguaaguacauuucugauuuuauugaauguacuguauuuccauuuaacacagccaguucuaguguguacaguuuuucagucuuuuaaaacaacacuuggauguaugcuguaauuuuuucuuuaggauaaacuuucuguaaguggucuuccuggucuuccuggaucaaagauauauucaguauaaggcuuucauacugguaaacugaccuccaaagaguuuggaccauuuuucacaacaguuuaugagaguguacauuugcugagcccuccuugcacuuggcaaaauucucuucuguccuugccaaugaaaaaaaauuauuauuauuauuauuauuauuauuauuauuauuauuauuuuuaaauuuaagagacaagaucucauuauguugccuggacuggacuuaaacuucugggcucaaggaauccuucugccuuagccuccuaaguaacugggaugauaggcacgugccauugcaucuaguucaaaaaugcuguuuuaaaaauugcuuuucuuuaaucaaaaaucgcuuuucuuuaaucaaaaaucuuucguuucuuugcguuggacuaccucuucauuucuuuggcuguuucagguauguucaucuuuuucuucuuuacuugcaaaauuaaaaauauaacuugauaguaauuauuaaaucuuaauuaguagaaauuacugcucagagccagacuugauuuucuuuuuuuuuucuuguuuuuugcaguuucaacaguaagaaacuaaaucacugccuuguacaauaaaaagcucuauguuggggugaucagacccaacaccaggucaugggggcgaugaguccgguggagucaaaggaaugagaaaaagacaguuugagagagaaagugggaccggggagccuacgcuauuuauuggugaucaaacaaagaaacagguggugaggauguggggauugaaagaaacugguguaucaagugaaugagaaaccuauggcuacuugagauaaugggagugcuagaagcaaggagcuagcaagucuagccgacaugcaagcccugccucagcuucucucccaacacucagcuuuucucccaacagauauauuugaaacuuaacuucagauauacauauaguaaaauugaaaacuuauuaaaauaacuuaugauucauauauuauguuugcaucuuauuuuaucugauugucuacccugaacaacuucuaccugcccugagcuagacacacccuuuugaagcagauagaaggcuagggguuuugaggggggaagcaagggaguuuuuugcuuuaaaaaaacuuggcaauuguuuuguaauacuaaucuagaauauauguaaaacucuuuguacuaucuuacauagcgucuuuaugugaaaagggauaaguuagggaguaagagugauacugcccagagaucucacaaggcaucguuuacauuauugaaauacagugcuuguggccucaacuuugagaacucggaaauuuuguuuuuguagauucacauaaaauaagcucagguuauauaugcuaaugauguuugcagagauugaauaaaucugaaugccagauuauuaauuuacugugaaaguugaguagugcuucugucagcauuaccaguauauuuucuucuucagguuaaucugcaugaaaauccaaacuauuaauuagaaggcuguuuggugagcaagagguucagauuaagguuuguuagucguuuggaugguucuagggaaggaaaugaucaaaacuguaagcccagcgcgguggcucacgccuguaaucauggugaaaccccgucucuacaaaaauacgaaaauuagccagcaugauggcggguaccuguaaucccagcuacuuggcaggcuggggcagaagaaucacuugaacuugggaggcagagguugcacugagccgaguacugccauugcacuucagccugggcaacacagcgggacuccgucucagaaaaaaaaaaaaaaaaaaguagaccccagcgagaugcuuucuaccuugcuguuauuggcacuacuggcucuaccacacgucuuuguggucaaguucucaguguuuucaagugugaaagaauuuguuuuuaauuuaaaaagugucuguaauagugcuugggauacagaugaguguaugaauuuuuugcaguaacugagcaguauccuaccaaucugcagcccguagacagguagucccugcuaucuccuaacaauccugcuucucuuuauacauuugguccaguuagagcccaauauaauuaauugguacuuauuccuuggaauuauacacccagguacuuugggugcuguuaauuucuugagucauauauagacaguaacuucauuuuucccaaagaugaaugaguacauuguguauaugcauacacguacacucaauaagcuuuacuuuucacucccaaagugugaccuuuuaccaguguggggaaggggucuaggggcuuacugcuugaccaauguucuggugagaaugguaaagcugaguauuucaccuguucgccucuagagcuuaguauccuagaguauaucaaguugcaucuauuuuaucuucccuuuaaaaaaguaaaguaaaauuuuaaaaucuuuaauuaaauauuuaaacuauggguuuucuuuauugaaaggguaaaccaugcccaagucauuuacuguucucauuucaggauuuuccuguagguauuuuuucuauuuuuaccuuuguuguuuuuuuauuuuugauuuuuuuuagagauaacgucucacucuguugcccaggcuggagugcagaggcacagucauagcucacugcagccucaaauuccugggcucagguaauucucgcaccucacacucccaaguagcugggacugcaggcgugcaucaccacaccuggcuuuuuuuuuuuuuuuuuuuuuuuugcaggggagagauaggaucuuacucuuuugaccagccuggucucgaacuccuggccuaaagggauccuccugccuuggccucccaaagugcugggauuacaggccugagccaccaugccuggccacauuuuuguguuuuuuuguuugagacagggucuuacucugucacccaggcugaagugcagugguucaaucacgccucacugcagccucaacuuccccagacucaggugauucucccaccucagccucacagguagcugggacuauaggcacaugccaccauguccacuaauuuuuuguagauauggaauuucaccauguugcccaggcuggucucaaacuucugggcuuaagugauccgcccaccuuggccucccaaagugcugggauuauaggaguaagccacugcaccuggccacaguuuuuuuguuuguuugaggcggaguuuugcccuuguugcccaggcuggagugcaguuguguaaucuccgcucacugcauccuccaccucgcagguucgagugauucuccugccucagccucccgaguagcugggauuacaguguccgucacuacacccggcuaauuuuuuguauuuuuaguagagacaugguuucaccauguuggccaggcuggucucgaacuccugaccucaggugaucuacccgccuuggccucccaaagugcuggaauuacaggcgugagccacuugugcccggccuggccacaguuuuuuuaaccuuugaaauagaguuaguauucauacaaguuuaacaauacuuuuuuaaaagaaacaguuuuucauuuaaaaaacacuucuauucauagggcguauuggugaccucucggaagaaagggauaaggagucgucacuuggccgguaagggaaauagacucaaguggaugagguccaacgauucagucuugagauuucacugcccuaaaagucaaauaauguguaagaggacagcgaagggaagacuuccuccucccccacccccaccucaggaaauccugaucuuaauucucacucuguauacccagucacucaaaccagaaacuugggcaucauaucuccucugucuccuccaguccagucacuuacuaaguccugcaguuuuuacuguggccuauuuaaguuucagugguuuaauauucuggaauacauaggcuagauuugcccuacucuguaggaauaaaucagaguagauggugauguuugucaguuaaaacuauuaagaauguagaagauuuuuuuuaauuucgcaauuacugccaggcacggcagcucaugccuguaaucccagcacuuugggaggccgaggcggguggaucacaaggucaggaguucgagaccagccuggacaacauagugaaaccccaucucuacuaaaaauagaaaaauuagccaggcaugguggcgcacgccuguaguaccagcuaccugggaggcugaggcaggagaauugcuugaacccgggaggcagagguugcagugagccaagauugagccacugcacuccagccugggcaacaaaaugagacuccaucuaaaaaaaaaaaaauucauaaucacagagaaauagguaguauaucaaaguaguuaagcacauggauuauagagccagaccacucacuucagauacuagacucuaccgcucacugguugugugaccuuaaacaaguuaguuaaccuaucugucucaguuuucccagcucagagauuaggauguuaguacaacuugccucauagggaaugcuuagaacauaccuuucauauaguaagcucuuuuuuuuuuguuguuguuuuuuuuggagagggagucucgcucugucacucaggcuggaguucaguggcacagucucggcucacugcaagcuccgccuccuggguucacgccauucuccugccucagccucccgaguagcugggacuacaggugcccaccaacaugccuggcuaauuuuuuguauuuuuaguagagacuggguuucaacauguuagccaggauggucucgaucucuugaccucgugaucuguccgccucggccucccaaagugcugggauuacaggcgugagccaccaugcccggccaguaagcucuuuuuaaguguuaacucuugauccauuuguuguuuucauucaagaauuagaaaaaucgauuuccucagcugaugauuuugaauuaacuauugauuguaaacaucucuuuuauuuacuaggauauuugagaugaggaauuuuaaacaacuaaauuauucuuauuuucugccacuuaagcuuguguuccaccaacugcaucuagaauaauucucugaccuuucauuugcuacacaaguucaguuaucucaguauuaaaugucauguaggguaguaaaguaucuuccauguguaaugaugugucuguaugcuguaggaauacauaagcaaauauugccuucuacuuuguggcccauguacuugcaaacaaaaaaucuuucauuugauuucuguuagugauuagaugacuguguuacaguuaccuucagccucucaagaaucuauuuuguauaacuuaauuagcagcugaaaagaggagagaaaacuuguuuauauacucaaagggaaagaagaacuuuuuuggaaaaacaaauuauggauugcauugugcaucccacaccuaaugcuagaaucaguuccccuuuacaacugucugaggaccuaggauaaaaauuaguucucccaaaguuguagaaaugagcacaagaagauagaaauuaaguaauucacagacuucguuguagagauuauguguaauaaagcuucuugccaguauugacaaaguccuuguugcucuuacaugccaucaaauguacaauuuuauuguuccagguccuuugcucuuuuauuuagcuuuguugucuuaauuuuaaaacuauuuucguuuuuaaaaaaucaucuagccugaagugucacaaaaguauuuucaacguguguguuguagccuaauggugggaagacucauuuaggcaaugacuugaucaaaaauugcauuuugaccccucagaaaagucaauauacuuauuagcauuuuuuauuuacuuuucuugaggccaaaaauaacuauacauuguuuuuuaaaacaugccuauacugccagaaauuccuggaguugcgacauauuuuuuuaguuaaugaggaauauaaaauguuuguugaaaaauguuuuucaaguaugucagauucagauaaauuggguuucaucaaauuaaaaaguuuuauauuuuauaggaugccaucaagaaagugaaauauuuucacagauggaaaaaaauauucacaaaccauguaucugauaaaagauuuacaggauguuuacuagcaaaauuuuauuuuauuauuuuuuuuuaauuauucauuuauuuauuuuuuagagcuggagucuugcuguguuguccaggcuggagugcaguggcacaaucucggcucauugcaaccuccaccuccccgguucaagcaauucuucugccucagccucccgaguagcugggacuacaugcgcacaccaccacacccggcuuauuuuuuguauuuuaguagagaccagguuucaccacguugcccagacuggucucgaacuccugagcucaggcaguucgcccgccucagccucccaaagugcuaggauuacagacgugagccacugcacccggccuaauuuuauuuacuuuuuuaagacagggucucacucucuugcccaggccagagugcaguggcacaaucacagcucacugcagccucuaccccuggggcucuagcgauccuuucaccucaacccccaacggagcugggacuacaggcacacucuaccauacuggcuaauuuuuguauguuuuguagagacgggguuucaccaugcugccuaggcuagucucgaacuccuggacucaagcgaucuacccgccuuggcuucccagaaugcuagaauuauaggugugagccacuacauguggccugcagaauuuuauuuuguuuuauuuuauuuuauuucgagacagugucucacuucgucauccaggcaccacgucauccaggagugcaguggugccaucucggcucacugcaaccuccaccucccggguucaagcaauucuccugccuuggcuucucccagguggcugggauuacaggcacacaccaccacgcccagcuaauuuuuuugguuuuuguagagacagaguuucaccguguuagccaggcuggucuuaaacuccugaccucaagugacccaaccuuggccucccaaagugaugggauuacaggcaugagccacugcaccuggccccagccugcaaaauuuuaaaaaaugauaaaggacguguauacagaauacauaaggagcucuuaugacucaauaguaaagacacauaacccaauuuaaaaggggcaaaugaucugaauagauauuuuuccagagaagauacacauaaggccaauaagcacauagaaggauacucaacauuuuagccaucaaggaaauguaaaucaaaaccaaaauugaaaucaaaaccacaaugagauacaacuucaugcccacuaggaugacuauaauaaaacaacacacacaagaauugguaaggauguggagaaauuggaaccguccuacauugcucuugggaauguuaaauuguacacaaauugcuggggaaacaggguugucauuuuacccaacaagucaacccagauauauaggcaagagaaaugaaaacguguucucacaaaaauuugcauaauacaugaauguucauagcagcauauuuauaauaaucaauagauggaaacaagacaaauguuaucagcugacaaauggauaaacaaaauguguauccaugaaauggaauauuauuuucacuguaaaggaugaauugcugauaaauccuacagcuuggaugacucuugauaucacugugcuaagugaaggaaaucagccacaaaagaccauauauuguaugauaccauuuauauaaaaugccuagaauagguaaaucuauagagacaguagauuagugguugucucgggcuggauggggaauggaggaauuaggaggcaauagcuaaagagggcaguugcucuaugggaugaugaaaauauucuaaaauugauugugauuguuacauaacuaugaauauacuaaaaaguauugaauuauacacuuuaaaugggcaauuauaugacaugucguuuguaugucgauaagcuguuaccaaaagaaaauuuucaaggaggacuuccaaauagcuaaagacaguaguggucaucgaucuacugccucccaauuuuccuucaaauaaauauagaauaagaaggacaaaaaucuauacagaauuugaagacauagcauaacuugaagagaauuuaagacuucaguauaacuguaacuaaaaagagagcacucaccagauccuggcaugugaucucuucauacucccauucagcuccugccugccgcaagacuuuguggcaagcacaggcaaagaaaaaugaacacaaaauggagagggaaucuuaacguuaucuaaauguucagccagaagaaguccauccuaagucugaaaauucuuuuuuuuuuuuuuaagguuuccaaauagaauaagaguagggauuauaagggagggacuuaaaaauacauacaaucugaagaggcagucuucaaagugcguagcuuauaggggagaaaaagaagguacauaagaagaggagaagcacccuuuggcaguugaguggugaaaagguaauaaagcaaaggaggaaauucagaaugcagcaaaacaaagagaaccacaaaguuacaggauucauagccaacuguuccccccacaacaaaacaaauaauuggcaggacuuugcuauacuaacagaagagggcacuguuaaaauaggaaucuuguaaaacaucccaguaauauggugcuuuaauaaaaaaauuuauagcaguaaacacauuuaucugaaaaaaugaacauaaaugaauuaaauuuccagcucaaaacaaaauuuaggaaaacaaaguaaaccuaaagagcauacccagaaggaaauaauaaggauaaaagcagaaauuaaugagguagggaauagaaaaacaagaccuaacaaaucuguauucugaaaauuuaaaauuauaaaauagacaaacgguuagcuaacuuaaucauguaaaggaaaggaguaaaacauagauaugcaaaauaagauaaagcgguaaauaaccacuaaaaauaauuuuuaaaaaauuuuaaaaucacaagagacuacuuagcagaccucacugcaguuauuugaaaaccuagaugaaaugaguaauuuucuagggaaaugcauauuaccaacauggaguuagagaaguugaagagacuaauuuccauaaaagaaauaauucuucuaaacuaucccaccaaaaggcauuagaccugaaugguuucacagagcaauucuaucagaccuucaaagaccagauaguuccacugcugcauaaauuguuccagagcauuggaauguuggaaagcuucugaauuucugugaaacaaauauaguauugauacuuaaaccugguaagaacaguauugaaaaaagaaagcuauaaaucagcaucccauaagaauauugaugcagaagugcuaaauuaaauauuaucauugugaagugauauaccaugaccaugugagauuuauuucagggaugcagggcuggcuuaauguuaggauacucauuaacauacucccuauugauagauuugugaggaaaacucagugucuccauaggugcugaaggagccuucaacaagaccacccauuuugugauauuucucucccgcucucucaaauagggauugugggauacauuuuugaaaugauaaaauuuauauaucuuaguccuaaagccaggaaucuuauauauaaugggaaauacuagaaguauuuccacaguauacagaaacaaggcaaaugugcacuaucuucacugcuguucaacauuauaauggagguauuaaccaauauaguuagauacaucgauuuaaggcauaagaauggguaaagaagaaagacuaucucugcagauuauaugauaacggguugagcaucccuaaucugaaaggcuccaaaauucaaaacuuuuuaagcagucacacgaugcacaaaguaaaugcuuauugaagcacuucagauuuuggauuaagggugcaaugaaaauaaugaagaaauuccaaaaugcaaaaaaauucaaaauaccucgacccaaacuguuuuuugguuuuggccagagugcaauggcacaaucuuggcucacugcaaccuugaccucccagguucaagcaauucuucugccucagccuccaaaauagcugggauuacaggcaccuguccccacaccuggauauuuuuguauuuucaguagagacaggguuucaccauguuggccaggcuggucucgaacuccugaccucaggugauccacccgccuggccucccaaagugcuaggauuuacaggcgugagccaacaugcccggcccaacccaaacauuuuugauaagggauagucaaccuguaauauggcuggaaaacuacaggggaucacugguaaaauuaauccaaaugauaauagaauucaauaaaauagcaggauauaaaauuaacuuaaaaaaucaauagacucauauacagacaguagccaguuagcagucagucacaaugguagagaaaacuccacuuacaauagcaacaaagauuaaauacuuauuaaacauaaaaauguacaaaaccuacaggaagaaacuuuuucaauacuuaagucauaaaauuagauuugaauaggauggcucaucauuauaaagaugucaguucuccuuaauuucugaaauuaaugcauucacaguaaaaacaccaagaagccuuuuuuacuuuuuaaguuagacaaguugauacuaagucuuaugggaaaacaaacauacaagaauagccaggaagaaacuggaaaagaaaaacugcuggugggacuagcucuaccagacauuaaaacauauacuauaaagcuucuauaauugaaucugugugcuacugucacaugaauaaauaaauagagaaguggaauagaaagcccagaaacagacacagguacaaguggaaauaauaaaaaugguaucuugggcugggcucaguggcucacaucuguaauccuagcacaaugggagggcaaggcaggggaaugacuugagcccagcaguuugagaccacccuggauaacauggcgaaacccugacuaaaaaauuagcaggcaugguggcuucucaggaggcugagagaugggacaauugcuugaacccgggacauccaagacagcagugugccaugauagugccacugcacuccagccugggugaaggagugagacccugucgcaaaaaaaaaauaaaaaaaaguguuaaaucacugagguagaaauuggcuuuuuaauaaaugguaccgauauaucugaaugucccagauaauaaaugauaccacugaauaaauaguacugagauauuuagaaagagauaaaauuagauacacaucuuguaccauguauaagaauaaauacaacauguacacagguuuucauagcauuauucauaacagccaaaaaauucaaacuuauauguccauugacugauaauuggauaagcagagugugguauguccauacaaugaaacauauuucagcaauaaaaagaaaagcagugauacaugcuacaaugugggugaaacuugaaaacauuauacuaagugaaauaaagcagucacaaaaggccacagguuguaugauuucauuuauaugaaauuucaaugauaggcaagucaauaaagugugaaaguagauuagugguugccgggggcuaagggaguuuggucuaaagaggggugacugaugaaagguacaguaguuucuuguuggaauaaugaaaauguucuaaaauuuauugugauggcuacacaacuguaugaauauacuaaaagccacugaacaagacacugaaugaauuuaaauggaugaauguaugcuauauaaauuauauccaauaauuagcuguuacaaaagaaaaaaaaaaaaccuccaaacagguuaagaaucuaaauguuuaaagagagagaaaaaaagaccauauaagaaaacccauguuuucuuauuuaaccuuuguguaugaaaaaggcuuuugggcuaugacucaaaaugcagagacaaccaaagauugacaaauacgucuauauaaaaauaagaaaauuuuacauggcaaaaaccgacaugaaaaaaagucaaaaacacaagcugacaaacuggaagaaaauuuuuucaacauauaccuuagccaaaaggccuauagcacuaauguauacuacacuugauuuuagccaaaaggcuaagaagccauaucccuaauauauaaagaacucuuaauaauuaaaugaccaaaaaaaaaaaaaaaaaaaaaaaaaagccuugagcaccaaaggaccaaagaccugauagaaaaaauggggaaaagacauaaauggacaacucacaaacaaugaaaauugggccuuaagcacauaaaaaguuuuaaguucauacagagaaauaagcucacgccuguaaucccaacacuuugggaggccaagguggguggaucaccugagguuucucaaccucgagaccagccugaccaacauggagaaaccccgucuuuacuaaaaauacaaaaauuagccaggcgugguggugggcgccuguaaucccagcuacuugggaggcugaggcaggagaaucgcuugaacucgggaggcagagguuacgacgagccaagaucgcgccauugcacuccagccugggcaacaagaaugaaacuucaucucaaaaaaaaaaaaaaaaaaaaagugaaacagcacuuagacgccauuucucaucuaccagauuagugaaaacuaaaaagaaugacagcuaauucugugcaaggcaccuucagauacugcugguaaaaauacacacuagcauagcucuucuucugaagagcagugccuaauaaauugacauaugcacuuaucuuuugacccaacaaucccacuucuaggaaucuucucuaaagaaguuuauccauuuuaggaguguuuguaauugcaaaauauugcaaguagccuaaauacccaugcaggagaaugaugaauagaugaugguacagccacacaauggagcaguacugugucacuguaagaaagaaugaggaaaaucgcugaacuacuugcagugcaauuaagggaauuaaguaugaagaguaucuauaauaugcuacucuuuaugaagcagggaaauacaggcacagaugucaacuuaaugugugaaagaaauaccagaaugauaaacuagaaacuauugaaacugguuucuuacagggaauacaugagaaugggguagaaagauugggaguaaugggaauaagauaguagggauagggagcagcacuucucugacuauaguuuuuuauaugacuuugacucucagaacccugguaauuuuuuacguagucuccagaaauaacauaaaauaacuuagauguuggcaaguguggagaaaggagcccaaaauguaaugcaagcacuaacagaugaacaauauuaacuugauuuaugaagucaaugaauaacacugacuugaguggggaagaaaagaacuaaguaacuuuggaaaacaguauuuugauuaggcauucuaaagcuaaacacaagacaaaaaacaaauauuguaaguaguaaauguguuucucacagagguaucgcuuaggaauucugaaacugccuuuuguguaaaguuuuaaaaauaagugaauauauuguagauaaugaaagucagacuucucauuguuguauaaagaaguuacagauuaagauaguaggcuagaauuaacccuguguucauugacuggaguuugagguauccauaugaagucgugguuuuuaauauauauguauauaugauguaugaauacaaaaauacauaauacagaugugugaauauguguauacuguacauacacauauucccgagcucuguccugagagagccagaggaaugauauccuaguaagcacauuaguguucggaucuucuuuaaaugccauucuccaguaaagggaaccauggguccuucgaaaaaugguugagucuggcgcaagaauaauacaagaugugccuggaacaucacguggcgccagaaaguaauucaaaaaaugauuagggcauguugaaaggacaacaggaaccaaucuguuggaacucccaauggcccaaagugggauaauuugagaaacaaaauaaugagaauauuagauuguaacccacaaaauaaaacacauguacaggcauuuagguagauaagauagaugggagggauaggaaggacagcucuuccuuacauggaauuccaauuagcauagaugaaaagagagaaauaaaaaccaucauuaggcagacaacacuaugauaaauauugcaugcaagaacuaucagcagauacucaauggagaaguugugaugaaaagcaggauauuuucaaggucacaaaauaucuccccacaagauaugaauuacaaagagaaaaaugguaacuaugggguggcggggggggguggaaauggcagauaccaccuuaaccagguaaaguagaagucacuaguaaucugagacacgccagcgucauguguucccugaugcacugaaagggcacaauuucacuuccgcgguaucccuaccaaaaaugccuaaguucagucuaaucaugaaacuggugguguuugcuuaaggaaucuaaauaaggucuguagauuaguuaauaguguuacaucaauguuaauuuucugauaucaguaauuguacuauaauuuuguaacacauuauaaggggaaguuggaugagguauauacaggaagucugugcuauuuuugcaacuuuucuccgagucuaaaauuauuuccaauaaaacaucuuuaaaaauaggggccgggcauaguggcuugugcagcacuguaaucccagaacuuugagaggccgagacaggcggaucacuugagcccaggaguucaagaccagccugggcaauauggcaaaaaccugucucuacaaaaacuagccgggcaugguggcaugcacccuuuaguccuagcuacucgggagguuuaugugggaggauggcuugagcccaggagguggagguugcagugagcugagaucgcaccacugcacuccaacuugggcaagagggacacccugucucuaaauaaaugaaugaauaaaugauaaagguuugagguaccagguaucuauuguuaccuaaacucuuguuaucugagcucagaagccagaaaaauuuucaugacauaguaagcuuugcuaucagggcucucacuauuugaacuaagacugaauagagucacaagagauacuuguauuuauuauugguuuuuuuugcaauauuauuggaauuuguucuaaauagaauuuauucuuauucuccuggagucaaccauugauuucuuugcuuguucucuuaauauacucucccuuagaggacucauccauuugauuggcaucagcugucacccuuuaagugaaaaaucuguacaugucacucuccuaauugucuucauuaucucccuaaugaguuucaggaaaagucccagcucuuaaacuucacucacaaggccuugccugucugcuccuacuuacaucuucagcuuuauuguuuuaaaacaacaaacucuuagcuuuccuugaacuugcagcucuugccuugcugagcuacucugaaauucacucauuccuugaacuugaagcuguugccuugcugaguuacuuucagauccacucuuccuaaugcuuuuuggaucuuguucauauuguucuuucuucuucuaauucuuugucuuauuucuuucccuggcuaauucuuucaaaugauagcuuaaguauuaguuccuccacaaaacauucuuugaccuucaaagacuggcuuucagugucccccucagauacuuccauggcauccuuuaguuccccuguccuggcacuuacuacucuauuauaaugcuuauaucuuauacuagaccaucuaugguaugaagaauaaauuagaaggcagcagaaccauuuuaaaggcuggagaccaguaagaagccucuuggggaaaucuaagcaggaacuaauaaugguugccuauauuaagguaguagugaggauggagcccagagauacuguaugaagaaagugggguauaagauccuugagagcauugucuguccuguuucccuguagauccacaguaggggaacucucaugcguccuuccuuauacucauaauuccaauuccauuucccaccuguggaacauuucacuuuaccuuuaacggucuuggugccuuauuucuauaauuaucuguguagucuuugaggcuggaacuuuggauaccucauuucaccauugguuguggacuguugauugaccucaccugacugacuaauaccacaaucuuuccucaccacuuauuaauaguaucuccucucuaugacauguuaaguugaagaggaugauuuaggauuguuuauuugcuuaaugcuuguuuacuugcuuuuggugaguggugaacaagaguagaaauuaguauuuuugccccuaucccaguugaccaugccgaauuuccuacuucuaguggcaucaacauucuuuuauuuauccagguuuucaaguuucugaauuuuuauuagccuucuaaguuuuacuuugaaguaucucuccacugucuucauuuuucuuucccaguuaacucucugaccuuaacucaugguaccuuaugucuaaauuauuguaaaaucucucaguuuauguucuuaauuucuuugcaucauuauccucaacuuagauucauaagaaguauauugacucuaagccuugacaucaaauuaucuuggugaauugauuuuuccucagaauuuuaaggacuaaaugagauaauagaugagugcuuuguaacuguauaucccauaucucuugauuuauucccuccuuuuaaaaauccuuccaucuugcugggcucacaccuguaauccuagcacuuugggaagcccaagugggcggaucaccugaggucaggaauucguuaccagccuggcuaacauggugaaaccccguuucuacuaaaaauacaaaaaaauuagccaggcaugguggcgcacaccuguaaucccagcuacuuagggaggcugagccaggagaaucacuugaacccgggaggcggagguugcagugagccgagauugcaccauugcacuccagccugggcaacagagcaagacugucucaaauaaauaaauaaauacaaauuauuuagucaaugguuuuaauuuuaaugaaaauuaaaaauggaucauaggaagugaauuucuuaccuccuuuuagguuauuacaauuuuauguucaguaaaagcagaaucuuaagggaaugaggaagcuuccagaguugaaaugccuuggucguuuugugucccugggcuguuggcagugugacucugcuacagaauaccacuuggggagaucagcuuacucaguacagggugcagggaaugggggaagucuggagggccagaaacccacacugcgugguauggaguaguggaaaagaacccucccuuaggaggauaacauccucugcagucuauuuuuauauuucaaagugagguauuuuuacuucaaauuacaguacuguauauaguuaauaggagaauguuguauauuugcuaauagaggauuauugcuauauaauggucuccuucugccccuguaacauuguaaagaaaaaauaauccuaaccaguuuuuaaaauguuuuaaauucuuaauaaauaaaaaaugcugcaguaaauauagaucuuuacuucaaaaagaaaaggaaaggaggccuacuggaaaggguuacacagaaaaguuuaaaguuauaaaauagacacacagauagccuucugucuucaccaguucuuaacauuucggcacauuugcuuucucucucugugugugucucuguuucucuggcuaauguauuuuuaucacacccaagaaauuuaacguuuauaagauguaaucauuuaauauaccaaccauguguauacugcuucaguugcuccucagauuccugaaucuaaucagauauaacacuuugcauuuuguuuaccggucucucuagucuucuguaauuuucccaguuuuuucccauaauacugauuuuuuuuucagcauuaaagcuagcucucuuguagaguaguccacagucugaauuuaucugauuguuucaugauuagauucagauuaaauauuuuuggagaaauacagcauaggugauuuuuuuucccuguugcauuauaucaggaggcaugaaagguuagccugcaugauuauuggugauguuaaauuugaucacuugauuaagguagagucugcugguagaaaacauaccuuugaaauuaaaaguuaucaguaaccaaagauuaucuuguucaaugaccaucucucaucuaauagguuuugucauuuauuuaugauccuugccagaaucagugauuaccuuagugguugcaaaauauugauuuucuacuucaagagauguguuaaauuucuuuuaaaaauuguuacccuaagauggcccuuggcuauaguaaucauuugcucuuuuuauuuagaauguauuaggaaguaugugagaggauuagguucaaauguugucuuuaccuguaaagguugagaucuuuaaaaaguuccgcaagagcuaagccaccagaaaaauaaagaagaaaguuuaucagccauguuaguaauucgauuuagauaauuaaauuucugauguuagucccauaguugccccaguuccuaucauucagauggguauuaucuuuuuaccuuauaaccacaguuaaacccuguagagucaauauacuucuauuuuugcagaaguugcuggacauuccaaaauggauagcacaaaauuuaaggugcaagcaaaaaguuaaauuuuauuaacucaaauuucagcugggcaugguggcucacaccuguaaucccagcacuuugggaggccaaagcagguggaucacuugaggucagaaguucaagaccagccuggccaacauggugaaacaccaucucuaauaaaaauauaaauauuaaccaguugugguggcaguuuccuguaaucccagcuacucgggaggcugaagcaggaggaucgcuugaaccugggaggcagagguugcugugagccgagauugugccacugcucuccagccugggugacagaacgagauuccgucuaaaauaaauaaauaaauauuaacucaaauuucuguuauugaggauuuauuugaaaguuuucauuaccugaccucgguagcauguuuaagcacaguuccacaacaucauuagaaaccuaaaccuguuucauauuuguguuuuaacauuuguaagguagagacacagccaacucauacaauuaccaguguagcauccaaaaagaauauuaaaagauaagauucugucuuacuaacaaguuguagauuauuccuaaauuaacgguuuauuaucacuaaagcucacuauuaacagcgaaguuacuucccuucauaauuagaggaaggccucuacuugacagcaauaaaacuguauuuuaagauauuuuuaauuaugacuuuucacuaauucacaauuacuugaguuuauaaggccuaccuaacaauuuccaaagcuuggagagagagagaaucuuuugaaauguaguagaaaauauucauuuguuuuugcuacaguguaaguggguugcuucauuauucugcauuuuagcuuguccaucuguuucauaacaagaguuucuguuacaguuuuuaagaaaagcugccuugaaauauguuucucauaaguaacaaagauuuuaucugagaaaaaaaucauuuauacccuuuggcaaaagcaguagcucuuuauggaaaaaaguuaggagcuuggauauuuguuucuuggguaccuaggcuggcacuugauuuuuaccagaaaguucagggugcaguaaaagauuguacacuggagaaauuuuagguaaaucagcgggaagcuucucagauaagucucaguguuguuagcugccucaucaccuuuguuguuugaagauuuaggaagauuuuguggauuucuauguauuuuuaacaaucuacuucuagggccgagucuauuuuuggaaagguguuaauauuuuuucacauuauacuauaaagcugguaucuuuuaguguuugucaaguugguauaaagaaacugcugguuuauuaauccguaagguuguguaaacucuacaugacuuaacauuuuagugacauagaaaagugggauuucugguugguguacagaucuuucuucacaucgugcagguaacguaugagcauugucugauggauccuuacaacauuccuguaugcuuuuggaaaguaugaucuuuguuuaacaaaaugggaaacagaggcacaugcuauacccagcuaucacagaaaacaauaguuagaauccagaaaacauacucaucugguuuaguguguugcccaauagaugcaauuaguauucuguuuuaucuuauuuguuugccuuauaauuauuaaacauuguuuuuuaaauuugguuuugguugauuccuuuucuucuaaguccgccacuugagcuaauauagccaacaagcaucugacaugaggcagaauuguccucggaucacaguucuauugcuaucuccaucuguugguaugaagaaguaaugcucuugccagaauaagcaagcuucuuuuaauuuuagcaaaaacagauuaagaaauaaggaauugugcuguuaauucauuuucuuugugacagguaaagucaguuggaagaugcaaaacugucacaggaaguuagcuauuacagacaaauugccuuuuuuuaaggcuuuuuguuaguaauacuaaaagugucaaagagaguaauuuaaaaaugauauauuaaccauaccuaaauuauuuauggcuuguucuuuaaggaauuauagaaaaauaugguugucucaacuuuuuuucuucaaccugggaucaggcauuguugugcaacaauauuuuaauagcgagaaaucucaaaaauccugacagucuuugcauauucacaguuucaugggcuuuugcaucauugcuucugaauugcuaaugaagagcucaauauagcuucugaugcauuucagauauucuggguggugacuggcuagaguguuacugacaucacaacauacagcuguugacuuucuauugucugaguccuccucggcaagugcuuuagacugcucuagcaggcacucccaaugccagacuaaucagcuggaugugugcagugagcucuauagaggagcaaugcagagcaucaguuuacagguacuauggaaagaacaucuccuuaacucuguaugaugaagcaaauaccaauacaaugaagguaugugacucaauucuuuugcuaaauuuguauagaauguaaucugauacaugaaguauucauguucacuuaguaccauaauuuuuguuagaggaugugugauaaaauucuacuauauugaaagugagagcauuuuaaaauugucuuuguuuauuuuugcaaaaauauauuuguuuagguugguggagugaaaaguagagucauuuacuucucagcuguagcaccaauuucuucuccccaccccucacauguuugauauuucuuguaacuuacugauagaaugguuuaccugugugcuaauugguauuuguguauagcacagcaaauugucagcuggaaaaaugacuucucuuucaaguucaucuuaaaauagacauacuauauggcuuguugaauuuuaaaaauuuuauuguggaacaaauacaaugugaaugagacuuuuggaaauuaagaagcuaagaaucuuaacuuucaaaacucaugguaacgguuuucuacccuuuugggggaagagguagaauaauuuuuaaagugcuuguaacagcaaaaccuagaucugucauugcuaugauuaacauaaucagauaucacauugcaaaagagagcaaaugcuaaucaaacuauguaauuuuugaggaguaucuuauuccuaauuauacagucugaaaacuuugacauuuaccuugauacuuugauuccucaaaagugaaaucucaucauguaggugauacugaaugacuaacacauguccauuaguguaaaauugaauuguuuagaagguuuuugagaguuuugcuugcuuuuuaucuggaauuagcugaaauuuuaacagcauuuggaauuguuaugauaugaauuccuucccccuccauuuacaaaacaauuauuuuguucuuaagaaauaauucaucucuuuucuagaggaaauaggaagaaaaucacuaaauggccuuuuaucaacgcugaaugucauugcucuuucuuuugucuauuucugauucccaacuguguaaguaauuagggucaugaaaauauuaauagcuauuauuaaaauuagggucuucuaucagaugcauugcuucacccuaaugccaagagaauuucauuauuuuuaagccucagauuuuaaguuuuuucuugagaacuauaaaagaaaaaauuaaaauaagcaacacauacucucaguucuuacuuacaacugcuuuuauccauccuuugucauauucugcuuugcuuuuucauacuuuugcucauuuucauuucuucuuuuuccuuuaggauucuguuugucugugcgucucuaucuugcccucccucucuuuuucuguuugacuuucugaauauuugucucucccucuugauuuaucucaucucucccuccaucuuccauucucccuauccccacccauuuuucucccccucucccucuacauuugucuuuccuacuuugucucagucugucucccuuuuuuguucaucuaccugguguuucagggugucucucccuuucugacuaaaucuaucuuaaucucucucucucucucuuuuaucuuucuaccucccuccuuccucuuuucuuucucuuucugucuuuccuuuucugccccucugacucucucucccugucuguuucaguauuucccauucucugucucuugcuuucccacugugucuuggucucuuccugucccuaucuguuagucucuguccaucauucccucuuccuuugucuguuucucuaugugcccuucuuucuucucccucucucauccuuuugcucuuucucucuaccuuucugucucugugugucucccuggcuacaccucuuucagucucucugccuccguccuucccucucuuggcacucugcucccuuucccacccuacucccagaucuuucucuuuucugucuaagcuucagucacacacauucacucugcaaauuuucauucucauacagguuuucaguucauuggagccagaucugcacuuaaauuuaaauuuuuuggugaauuaauaaaccauuagauaaagaaauuaaauacuauauuuuaaauaaacaugauuuacuguuugcucaguuuuuuaauuuugagaaacuuaugcuugaggucuuauaaguggauugaagucauuauuuaaaaauuuuuugucuucuaaagauauauguguuaggcuacuauuaaagggaauuauuuuucucuuaaaggauuuuuccauuaauuuuuaagauuuauagaaagcaauuuaaaauuuuuuccuuuuaaggauacauaagauaauaccccacuucauaguuauauuucagauuauggguaaacuuguauuuaaaacuuguauugacuuuuuuauaccaucuguauuuuucaaauguguuaacagcagauauaugcuaguauuuucuucuuuuguuuuuaaccucuuguuuugaaauaauuauagauuuauagaaaguugcgaaaacaguacagagaguauuuuuuaauguuuuccucaagauuuuguauuuuguaucugaguauuuaaaauagaagaacagacgcucauuuagcauuuacguguuuagauaaucacaaaccuagcaacugucauuauauuguuuucauuuuguaaagcagauuaaaauaccauuugauucaagcauaguauauauuaauagcaguauggcuuugucauaacuagcauaaagcuaucaggaaagaaaauuagauuuacaaguaacaaguuauauauauaaaguauucaagaagcaaagaaagauguauaagaugaaaaucuucucagagcugaguuaaaugucauuuucacauacagcucuuccuccucugaaauuauguagcauuccuuguuucugcauucuuuugaugucucuccugcuuuguauaguuuucaucucugcucugugaucccccucugguuguaggggacaaaagguggaaaugaaacagaaccaacaaaaucaucaucucuaaaucuugccauacuugcacagcugaccaacccuccuucugauuaauaacugagaucuuuaauacaguuaauauaauuuauuuuuuccaaaccgaguuccucuaagccccaggguaccacaaaaguacuucaggaaauagagaaaagccugaagcccaguuaacacugcucuacucauccccaccuucucacuugaacagagcaaguuuauauaauaaauauauguuuccacaguuuuaguucuccagaagccuauauaugaauccuacuuaacccuuauuuuauauuuuauauauguauguuauaaagugacuuggauaauauaucugucacauuauauaauauauauuaugcaaaucuguuacauuauauaauauauaugaugcaaaucugucaucuuauaaauaugcaugucauuuuauuauaauauacauagauauaaaaaggggguuguuagcuaggauucauguauaggcuucuagagaaccaagcagucccuaaaagcauguguaaacugugaacauacacgugugaguaagcacaugugauugcugcauuucugaggagaggauccuuggguuuaauaagauuuucaagagggauccuuucauggcccaaaaauaaguaagagucacugcuuuauaguguuuauaaaucauugcucaauaugcuuuguuaauuuuaaauuuucucucuuuucauuuucaaaugcuuagaaaguuauguaguaccucuacaauagcagacacaucaacagagaucacauacaguuuuuggaaguaguuugaaaauauacagugacugauuacuaggcacaucagaugucagacuucagcuuggggucacuagagagagagagcagaacauuuuuuuauuccaguacuuucagaaugcuggcuaaaccacagcuuuccuuaacagguagaaaaugaaugacaaaaaaacuguaugcccccuugagcuccaaugagacaauuguaaagaaacccauggguuaaauaugaauaacuacuaaaacaauuugaugugguagacauagcuaggaaauaaagccacaaaaaaauaaaaucugaaaugcauuaaacccauugaauuuuuguguuuugugcaaagccauaggaaguugagccaauuaaauuggacagguacuuuaaagagaaauuauaucugcuagcucuacauguauaguauguagugugaacuaugagagauugugagcuuuuuagcaguguucacccaugcccagcagcagcaccuucaagcuguaaaauuguuugcacuuuguuguacacauccuuuuauagaguaugaaggcagaugauggcaacugaaagacagcaccuguucugccucaagcuguuuuuaagcuauuuuuacuggccacaaaaugcucuuugacagaaagaagaaaucaaacguuuucuagccuuuuccuucuaacauaauccuuaggugcuuucuugagagagggcugugauccuuuguuagaaaaaaauguaguuggcaauucaagaaauaaaggguggcacauuaguaguuaugaaacugaaugucuaccaauuguaaccuaaauuaaaauccuauaaaggaaacagauuuuuugguguaggaaggaaaugggucauguuagaucuaccaauucaacugcuagagaaugugaaguuucacauuuuaagccaucaaagaaccauuggguggguuaaugugccaggagcccagcgugaauuuugcuaagauucuuugauaauaagcuuuguaccuuuaagaccuguaaaggauuuucauugugacccuauaauaaaaaugaaauguuggucauggguaaaaaguauauagagauacauucauuuaguuauauauuaguaggguagagaaaaauauaucaagcgaaaucgaauuuugaaagcaugaagaaaauaccacaucaaagucuagcuaaaauacgauaagacugaggguuucuuauaaauaguccaacacuugccaaagucuguguaaagcaaaugccuacucauugauggcauucugaauggcuaaauuuuagaaaccaagauuaugcucauaaugauguucaccuuaugaacugccaacauuaucaugcuaugaacaaagcacaaaacacauuaaagaauauaacuuaaugagacuaaguuaugcacccacaaugacuuuugacacuaaugugcaguuaggccagacaaguccuacacaagacugcccucacuucagccacugggccacccugcugaucagcuggcuacaaauuuggagguucccucagacuuaauugacuagaauaacucaaauuacacucagcauuagagcuuuauuguaccaaaagaauacaaaccagaacuagccaaaaggaaagacacacaggguaaggucuaggugagucccaaaugcaaagcuuuuguucucuccccaugaggucaagauguauugucuuuccugcacauuggcguuuguuaauuugcagacaaucagggaggcucacccaagcuucaguguucagaguuuuuauugggaucucauuacauuggcaugauuaauugaaucauuggccaugcaauugaauucaauauccagccucacuuccuuccuuggaagucagacaguuuaucacauuccucaaagccccaacuuucuaauuaacauguuuagucuuuccagccaguccccaucuggaaucaccaucuuaacauaaacuauaucauaguaaccucauuagcauacauuaucaggacccaccaugaaugacaaagacauuuccaucaguccagaaauuccaagaauuuagaagcugccuacuaaggacaaaggucagccaaauuuuccauuacacaauaucuuauuuuccaauuauugauaaugucuuugguguacccuaugugggaaguaauuuacuuuuaugguaauuauaugugagauaacuccgaggucaagacugagugagugaucuuucuccuucugaccacuucccuuuagcugauuuuguaccuuaaaagcaucucuaaacagaucacuuuugaaagaaugaaugauuuuuugaaaaaugaauuguaaacaauccaguauggaaacaaacaaaaaaaacuauguuuucucuuacaugccuguuaucuuaagcucuccucucacauccuuauuauccauagcucaguuuccaggaauccaaaccuuuugaauguucuuugcuguuuauuucucaaagcaugacuagaugguaauaccaguuuggguuuuuuuuuuccuccauguaguuuuuuauuauuuuuuuuuauuuuuauuuuuuaagaggcagggucuugcugugucauccagacuggaaugcaguggcgcuaucguaguguacugcacccucaaacuccugagcccaagggauccuuucuugugguagaugggacugcgggcaugugccaccauacucuaccuccguguagucuuuuuuuuuucuuuuugagauggagucucacuuuuucgcccaggcuggggugcaguggugccaucucggcucacugcaaccugugccuccuggauugaagcgauucuccugccucagccuuccaaauagcugggauuacaggcgccugcuaccacaccuggcuaauuuuuguauuuuuaguagaguugagguuucaccauguuggccaggcuagucucgaacuccugaccucaagugauccacccaccucagccucccaaagugcugggauuacaggcacgagccaccacuccuagcccuguguguagucuuuaaaagagauuuuaccucaugccaaucagaucauauuacacccugaguuauuuauuucaguccugcauuuagcacauacauggggagcucucaguauaacccuggacuaugguagguucagaauuaaggcaaaauacauuuuacccucacuagcacuauauuaggaggucauuaacuucagguuuagaguuacauuaauggcccugacuuucuugcauugucucuuaccuauaucugccaauaucuaaaccccuuuagaaucucaccagguuauccccaggauuauccaggaucuccucaugagcucaagaacagccguuucaugaucuuccaguuuugucuuucucuggcccacugcccacuaccauuuugcuaguguuugccacgaauuagcucauguccaugccaaagguuguaucucuuaguguucccaacauguuuagucuucaggguaccauauucucuagaauuuucuuuuuuauuuuauuauuuuauuuauuuuuuugagacggagucugacucuaucacccaggcuggaguacacuggcacagucucggcucacugcagucuccaccucccagguucaagcgauucucaugcgucagccucccaaguagugggauuacaggcgcgcaccaccacacccagcuaauuuuuguauuuuuaguagagaugagguuuugccauguuggccaggcuggucucaaucuucugaccucaggugauccgcccgccucagccucccaaaguccugggauuacaggcaugagccacugcgccuggccuucucuagaauuuucuauguaccagcaccaugccauccucagagaaguuaggcaagccauucacccgcuucuguggugggcuuggucaccugggcaccaggagcugcuugucucccacaucuccccugcuuugguucuccagugaaaacacuuccuuuagcuuuugcuuucauuuaaacuaggaucacugcuacauuaagauauauguauaguucuuuuaguacucuagcauuccuaauuuccagcuuuuuauguauugauuuggcauuuuaaauuacguuucuuaagcuacuauaccauacagugauaaaaagucagaucuggaaauggcugugaaaaaaacauuuagccuauuauauagccaaguagcaucugagcuuucucauuugcaucacucucacucauuacaaugcccucagucaaagaauuagagauacccccagucuuguaguuuacagacuucuccuuagaaggacugugccaaaacaguccugaauguucguguuggccuuaaugaaccaccccuuagugacucagucaccauucuccacaagcccuacagccaucccggcucccucucuucuagcaaauagguucgggguaaaaaagaagaaauuuauuagguaugaauucccuccuuuuccugccacauucccuucaguaucuuaggauaauguauacauuucaggcuuauucaccaguuuguacuucugauuacauuuucucauuucauccacuuucagauuuuccuucuuauuaccuuucuucccuccuaaaccucuagccucuccccaucuuuccuuacuggcuucuguggccuacacacuuuuucauucugacaaccuuccucuaacuucgcaucuccugguaacuuuauuaccaaaucauguauacucauugugaucuuccacuuuccuccucaauccuuaaggguucaguguucccuagggauucuacaccccccccccuuuucaaugaaggcuugugggcaacuucauuaacauugauaacucaaaacuucaaucuauauagugauucuccaccaaauaaauaacauuagcugacuucuuuccugagcuccaagucuauauauccaauuuucuguuagauuucuccaccugaauguccugaagauaccuuaaaauuaacuguaggcaaaacugaaaucaucguucugccaucaaauccauuuuccucccagauauauuuccuauauuuagugguagcaagcacuaccugcaccuucaguguguccucucauaacucuuccagcucucacagcccuuaccuuuucccugaccacucauguauugaauuggcuucccccaguuaguuacuugcuauuauauuaaucuauucauuucuacauggaguacagguaguggcugauaccaagggcucuggagccaacacuaccugaguucauaucuuaacucuaccccuuacuagucuugcuacuuugaaaaagcugcuuaaucuuccucugccucagcugcaaacuauguaauacugcuuuuauggggauuaaaugaauuaauacacuuaaagcauugggaguagugcuuaguaaauaauaaauaacucuuuaaggguuugcuguuaauauuaccaguuucacagcacauauugcaaucaguuauuaucuuguauauuuugucucugcacuagaauguaagcauuuuagguucuaggaucccaucugcuugguucacucauguaucccuauuaccuagaacagugcucuguacauaguauccagucuggagauugagugaauggaauaucuuuucuccuuuucagcuuucaccuuuugauucuuugucuaaacccuagucacuuuccaucaaaacuuucauuuuguuugcuagaacaggguuaaucuauauuguagcuaaaaucauucucccuggcuucucuuaaaauguguuccucuauuacucaagcuuccuguugcuccugggaucaguacuaaguuucuucuuuuucuuuuucuuuuugagagggagucucguucugucgcccaggcuggagugcaguggugcgaucucagcucacugcaaccuccgccucccaggcuccagcgauucuccugccucagccuucugaguagcugggauuacaggugugcaccaccacgcccagcuaauuuuuguauuuuaguagagacaggguuucaccauguuggccaggcuggucucaaacuccugaccucaagugauccacccaccucagccucccaaagugcugggauuacaggcaugagccaccgcgcccagccuaauacuaagcuucuaaucuuaauuucaaauauauccacauuuuuuguuauucucauuuauuuucaggacauuuuuaaugaaaaaugucauaaacaaaaaaaggagcauuauaacacucaguacugaccacucagaauuaacaguugcuaaccuuuuuuauauuggcuggagaucuuuuuuuaaaauaaaauaauacagaugugauuugaagucccuucuccgucuuacccaaucccuuucauuucccucuccagagguaauuacuaacaugaaauagguauauacucuucccauccaugcuugugugguuuuuaaauuuuuauauacguuacauuuuaugguagaguucauucugcuuuuugacuaaacauucugacauucuucuuuggacuuauauuuguaccuauaguuuuaguucauuucauuuuaaucguuucaugguaucgugcaacaugaauaugccacaguuguuuuuacuuuaaaaagaaaaaaacaguuuuccuauuaauacaacauuuggucuuucccauucuuugcuuuuaaauaaaacagugcagugaauauuuuuguacaugucccuuuguauaaggcguuuccuuaggguguaucuacaccagaaguggaaauguggagucauaggauaugugggauuuaaaauucauuugauagcacaaauuguuuucuaaaguggaucacaauguaugagaggcccauugucuuccccauuucuccacucagaaugcagcacauucguguaacaccuugccucuccauauaacuuuuucccuaaaaguaauuuguuucauauagucuuacaagacuccacuaauuauucucucucauucuucaacuaccaaaagucuuuccuucuugcuuauaauguccuccuaaaauuauuauuuauauuuguugguaagugucaucauuaaccucuucaugguuuaacgaacucuuuuaggucaagggaguucauucucuuuacucuuuuuaaauguaacugauauucauuaaagcuauagugccuucugugguuauuugguaaauuuuuguuaaaugacaguaacuguuuacaaaucacaugcacauuuaacauuuugaaaugucagugcuuauauucuuguucaagugacugacaaagugacugcaaaugugaauuuccacuauuucuaaauagagcauaaacagugcucuucgccuuucuuucuagaggcauuugaacaauuugguugugccaauuuauaaccucagggagaacuugauauggguugcuuuugugcauuugauuuucuuuauagaugugccugcuugguuauauuucugucucuaagagaaaaaacauaacaucuuaucuaaugaaacgggauuggauaacuagauagugauaaggaagcaacaacccuuuuuuuugggcuuugccaaauucuguucagauaacaucaauaauguaacucuuuuuccccuaaauauuuuugugaagaauauuuuuaccuauaggagcgagauuucuuucccacauauaaauuaacuuaaaugauuuuuaaauauuuuguuaaccuagaguaaauugacuuuuguugugugaaauuugaguauuuauuguuggggcuaccgaaguuuccaguucuuuuguguugugaaaccaaaacuuagaccccaaguauaauaagugauauuuugaauugucagugucaguauugcauuuuuguuguuaauacuucuaacuaaaauuuucacuagagaaacuacuugucuuuagacuucauauauacuaguuugccuuugaaaguguugauccuaauucugccuugcuuuguuucauagaggaagguacuuaaccaugcauauuuaucauuuguaagcuacugccuucucauuguuccuuagccacaaacucugaauccuuauugccacccaaguuugcauaguugguacucaucaucacaggcgauaggaggauugagagaaagaaacaaaaugguuauauaauuccuggcaguucugauaguuugguagugauuacuccuggugaccauuaauacaaaguuaauaguacuaucuucuuguacacacacaaaaaauacauagcuccucuucaugugaaaagaauaaguuuacuuugucuuaaguccaguacaaaggaguuaccaugucauaauuacucuugaaaugaaagugcuccguaaacacaaauugccccucuucuugguaccuacagaugaugauacaguauugcggguaagagccugaaauggagcacuagucuguccaguucaaauccuguuuuccauacuuacuggcugugugauguuggacaaauuacuugauuuuucuaucugccuuaguuuccuaaucuguuguaggacagagugauaauaggacauacuucuuagaacuguugugugaguuuuaaaugaauucauuaugaaaaauauuaccacagggccaggcacaugguaaauauauguauuaguauuugguuuugaugguaguuguuuguauucuuuuuuagcuuaccuguuccugucauucccccauccuuuucuuuccuuugauuuauaagaccuucuuugcuuucaacauuuugacccuuucauguuggaaauaguucauauguaucaucugccuuuuguuuauguucuauuuuauuauacaggaauuuuaaaacuuuguucuaaguuuuauaacuauuuaccuuuaauggcuucuagauuuuggugucacacuugggaaggacuuucccacccaaaaauuauaaaaagauuuccuauauauccuugugcauucauaguuuuacuuuuuuaagguuaugaccuuuaauuuuaccuguaauuuccuuucauuuaugguuucagguaagugccauccuuuuugugcauauguaaacauacauguggcguuucucugguuaucuaccugguagcacaggaauuauauauaagcacaucucugacuugucccuaauaaauagcauguugacaauuagaauuuuuuuuuugaaguugaauaugaauuuugagcucauauauccaucucucuuagguugacaaagauucugaaaaauucaguuuuuaaauuucaguaauaguaggaacugagauauauacuugaaugucuauauuuuguucauuuuuuucucuaaguugucuuccuaaauuuuguaaguuccuaaguaucuuucacuuacuguacaacuauuuauuauauuaagacaguacauuuaauggacuucuaaauguuguguuagagacaugaugugccaugucuaucuuguagcuuucuauacuugacacccacgugcccacacaaccuuuggcaaacugagaaguguaggcuucauggguuuaccaaaaagggguuuguuuuuguuuuuccagugaguaccaaaagcugaaacaucccuuuuacuugaagauuuggagagggaaaacauuuuuauaucaaacaaguucauuagcugggcaaaguggcucacaccuguaaucccggcacuuugggagguugggacgggggauuacuugagcgcaggaauuugagaccagccugugcaaaauagcaagaccccgucucuacaaaaacaauuuaaaaauuagcugggcauaguggugggcaccuauagucgcaguuacucaggaggccggaguggaaggauagcuugagccucaaaggucaaggcugcagugagucaggauugugccacugaacuccaaccuggguuacagagugagaccuugucucuaaaaaaaaaaaaaauuaaaaauuaaacuagugcauuaauauuuuggagaagaauacaaaguucguaugauuuuuuuuuuuuuuuuuuuuuuuuuguagagauaggguuugcuauguugccuaggcuugucuugaacuccuggucucagugauccuucugccuccaccucccaaaguccugagauuacaggccugagccacuauacccaacaguuuguaugaauuuuuaauauucaauuagaagccuucaaaugagagccauacacaaaaaugcuaagccgcuuguacacaguguuaggccuccugucagucuacugcuguguagugguaggggucaggacacagcaaauuuaggcucagccaacugcugaucuaaagggauucugaccagagaagacagcuaacauuuuuggagggccugcccugggagagaggcugugguccgugcucuacauuuaaaucagucaguccucacaacaaaccuagaagcuagauauucuuuuuuccacuuugcagaucagaaaacugcagcucagagagauuaaguuauuuaccgaaaauauaacuggcagagcugggauuuaaauuaucgucuaaugcuagugcacuucccuuucuauugccauuucuauaugccauugacuccuucccaggcaauaacuggucauuuucauucugaaucauucauuauuuagucuguuaucaaaugguguggcauauuaccaaguuuuggucacacauacugguugugugacuuugaagaagucauuugacuucuaggcaauaauaacuugaaugcugaauuacaauauuggacuagguggucucucagguucuuugggguuucauggaaccuugggauccuaagaggaucuucuaagguguucaccucuucgguuuugccccuuccucacucuccccugcagcuauugccuuaucuaguaccuuauuuauuucuuaaauggauuaaaaaccuugcuuuuauggaauuacaaaauuaagagauucaugauaaaauuguaaagucacuuuacaaagaacacaaauaauuugguugcuuagagaaugcugccaucuugugucuaccauuuuaugagauaaaaagcuaaaauggagaaaaaauacuugaaggauuuuuguuuuguuuuguuuuugguggaacuuaaucauuugauguaguggcuggagaaucuuggucagauugagaugacacgguaucaauuaaaaguuuuuugauauuuguuuuugauacccccuuuucuauuauccuugugucaaacauugugaaaucaaaaugugaaaaguaauguaaggauauaucggguuccaagugauuguauuucaaaaugguuuuugaagaguuaguauaaaaugugaguuacucuauaaugcaugcuuggcugucuugguauuaggucucuuggugcuuagaucucauuauaugcauauauguaugcuuagcuauuucaccuuaaaauguacuauucuguuuauugacagcaaaauugucaaaggacaauggaagagguaaauaaucuuuuuagaguuguuuacuugcuaggcuauauucauucauaccgaauaaauauaaaauaaaaccgacuucaaaaauauaacauggagaaaauuuuguauuuggggauuuuuguuuuguuuuguuuuguuuuugcucugccauccagacuggagugcaguagcaugaucauagcuaacuguaacccccaacuaaagcuauucucccaccucaaccucgcaaguaacuaggacugcaggugcacaccccuacacccagcuaauuuuuuaauuuuuguagagauggggucucacuguguugcccaugcuagucuugagccccuggccucaagugauccuccugccuuggcuucccaaagugcugggauuauaggcacaagccacugcacccagccaacuuuuuuuuuuuuuuuuuuuuuuagaacagacaauguggguuucauuaaaaauguuaaauggcuuguuauuuuuguuuuauuuuuucuuuuguauuuuuaaaaaucuagaauguuauuacgguucaaaauuacagucuuaaguccauagaguuacacagcucuagaagagaacucuaaaaaugaugguucuuggaguuaaaguguuucugauuaugaucuuuuuucucucucuuuaucuauagauacuaucucaauuauaacccugacugcauuguagcuucucaguacauaucauuuucuuuccucuucucucuucugcuuuuaacuaaucaauccucucggccucagugacuuauucagguucacaaagcuaauauauguuagaauucauuguuacucaguguucugacuuucguuuaggaaaauaauguaauaaaacaacugacaguaauauuuuuaauuucucaguuucauguggaguguuccauuucccuuggccauuuuguuaaaaugguuucuuuuguuuucauuuuaggccacggaaagguaugauauauuugauccaagacaguccauuccaguccgggaaucuacaguggugacaaggacaugggacuccuccugccagauuacagaugguucacuacaguugacauccuggcugacaacugugaaaaagaaccuuggauuauuuuauuuuauuuuugugggacaccacaaucccaaauccaaaggacgcaucagguaaugcuucccugucauucagaaaaacauauuuuucuuacaaaaucucaccuauaaaaagcaagaagccagugucuuaaguaacuucaccacccucucccuacuuugcagcuguuuguuuucggaaugaaccaauuaacuuuuguauggguuauaauuaaggaagacaugguuuucuuuuuuuaauucaguucagucugucugugacuuuaagaccuacuucucuuuggcuuuuuuaacuuuugagcuguauuuaucaauuccuaaaauccauuuauuuauguauuuauugagauggagucucacucugucacccagacuggagugcaguggcgcgaucuuggcucacugcaaccuccgccucccagguccaagcaauucuccugccucagccucccaaguagcugggacuacaggcuugcaggcacgugcuaccaugcccagcuaauuuuuguauuuuuaauagagaugggguuucgccauguuggccaagcuggucucaaacucuuggccucaagugauacaccugccucagccuccuaaugcacugggauuacagguguaaaccacugcaccuggcccuaaaauccauuuagauugcaaaacauucuuucaggaaaugaacuuuugaauuuuucaaauugauauagagaaaauaaguuucacugguuucccccccgccacaagauuuuauuacgaaaauuuucagaaauauagaaaaguugaaagaauuuuacagugaacaucccuauaaccaccccuugauuucaccaguaacauuuuagcauacuugcuauaaccuauaucugucuaucccucuauauaucaaucuguucauuuuuuuuaaagaugcauuucagaauaaguuguuuauauaaaguucugccauuauuggguuuuuuuguuuguuuuguuuugugacagagccucacucugucacccaagguggagucuaguggcgugaucacagcucacuggaacacacgccuuuuggcuucaagcaauucuugugccucagccucuugaguagcuguauuauaggcaugcaccaccaugccuggcuaauuuuuguauuuuuaguagagucuggguuuugucacguugcccaggcuuguuuugaacuccugagcucaagcaauccgcccaccuuggccucccaaagugcugggauuacagucgugacccaccgcagccggccaaguucugcuguuuuuauuacauuuuuugcagcuuaaaaugagugcuaucuuuagcuuaaucucugauacauuaauccagugcaaaaccagugauuuucuuaaacucacuaaugacaugaaaauauauuggaaucuuauguauuugauuuccuguggauuccauauucuagagugccuggauaauguguuguuuggcauugaaucacuuaauucaggagaguuuucaaugcuuucuucauauugcugaacauauuuguuaauccagauuuacaaguguauuuuguaauagaauguuacuguuuauuuuuaaauuauuuccuuuuggaaauauuucaggguaauuuaagaaauuuggaauuuuaggaauccagaugaaaaagcuauuauagguaucccuuuggagaaaaagauuucuaaugucuucuaaauacacauauauuauucuccagccauuaccuucuaccuugaucuggcucgguccuuaauguuucuuaagaauugccacaaguauaugugcaucaaaaucacuccauauucuuuuuuuaaauguaaaaaaaacacacuuauguguuagcaauagggucuugcuauguugcccugguuggccucugccuccuggacucaagcagucauccugccugacucccaaguagcugggacuacagcuggguaccacugugccuggcucacauacuuucuauagcucuuuucucacuguauugugaucuuuuuuuuaauuuggauguaucuagcacaaaauuauauacuccuugaaaucaagaauuuuguuccugucuauauucaacauuauuucuggaacauaacagacaguaggucaguaucaugcaguaacugaauguaaaaaaguuucaaacuguauuaauuuuuuuuucuuaaggcuucaagcucccuguagaauucgaaaauaaccuuuucuaaugaggaugucugauacuguuacuguaaaagaugaaacugcaacaaugaaggauuuggaggcagaagugaaagauacaaccagaguugaaaaucuuaucaaaucagaaaacuaugggaagauuuugguagagaagaaugaacauuguauugagaacaauauagauuugcagguaaacaggaauuuuucucuggcuacaaauacuaaauauucaguauauauuuauguuuauuuucauacaaaacucacuucucaaaauucuaaaaggguaaguugacccuucgugacaugcuuacuagcugguuuuggagccaguuggauuagcuugcugugagucuuaacuuggcuuguaucauguaauauacuucuuuuuauuuguauguggcuagugcauuuuuauuggcuuucuacuuucucauuccacccuuuuccuaauuaccagugcugugagaguuuugaacucucacaguuaaauuuugaguuuaaccuaagagcucuuaaaggaaagacaaauagaauacaauaaaacugcagacgaacuauuggcaaaaacagcccucaggggguuccucagucacucaaccugacugacaaaaaagauuugugggcccgggggaaguuaaugcuuuuaaugcugugcauauauaaugacuuagagcuagccacugagaaggcuucuaauuccaggcauaaauggaaauugaguugauuaacaaauugaagauagguaaaaauggucccaaguaauagcauuucuaguacuauucauuucuuugguaagguuuuccaguuaucuauuuucucagaaugaagggcuaacacuuuuaaacaauuuauuuuauuuuauuuuauuuuuuugagauggagucucucucugucgcccaggcuggagugcaguggugugaucucggcucacugcagccucccucuccuggguucaagcaauucuccugccucagccucccgaguagcuaggacuacaggcaugcacccccacacccggcuaauuuuucuauuuuaguagagauggaguuucacuguguugccuaggcuguucuagaacuccugagcuccggcgauccgcccaccucggcuucccauaaugcuaggauuacaggcgcaagccaucgcaccuggcccacaauuuuuuuuuuaauaucucaucauuuaucagucaggaaacgaagcaaggcuugggcugagugaauuuucuauucuacaggguauccaaagagguccuuuguuggcauuuaacaggccgguggacuuggucuggagcaucccggauugcuucucgcaccugucuggcaccuagguaggcaaggcugcagugcugggcucagguagaacuagaagcaccuauuuauggcuccuccaacaagguggguccaaaguagucagacuucuuauguggcagcucaggggucccagagagaauguuccaagaaagccaagcaaagcugcaagguuucuuuugacauaggcccagaaguuccagaacguuacuucagcuaucuucuuuugaugacauaagucaauaaagccaggccagaggauggggaauuagacccuaccucucaguaggaaagaauuuguagccaccuuuaagcuaccacaaaaaguuauucaaaaaaaaauuguuuaggccgggagcgauggcuguaaucccagcacuuugggagaccgaggugaguggaucacaaggucaggagaucgagaccauccugaccaacauggugaaacccugucucuaguaaaaauacaaaaaauuagccaggcaugguugcgcgcaccuauagucccagcuauccugaggcaggggaaucacucgaacccgggaggcagagguuacagugagccaagaucgcaccacugcacuccagccuagugacagagcaagacuccaucucaaaaaaaaaaaaaaaaaagaauuaaaaaaaaaaguuuaacaauguuuuaauuuuugcuuugcaauuaaagaauucuauuuuuggagaaaauauucuaucauucuauaugcuaaagacuuugaaggcuauaagccaaaaaguauagcuucauuuuuuuuuucuuuuguguuuucuuuuuuagcuucacuuuuuuaaaguaaagaaaccugguuuuuuugggugggggggcgggguuuuuuuguuuuuuguuuuuaagacagagucucgcucugucaccaggcuggaguguaguggcgcaaccuuggcuuacugcagccuccaccucccggguucaagcaauucuccugccucagccucccaaguagcugggacuacaggcgugcgccaccaugcucagcuaauuuuuguauuuuuuguagaaacaggguuucaccauguuggccaggauggucucgaucucuugaccucaugauccaccugccucagccucccaaacugcugagauuacaggcgugagccaccgcugcuggccaagaaaccuguuuuuaaagguuuucucauucuuuuguucagucaaaaacugucuuuuuuuccuauuauguaccagacaccagguuagacaaugauagcaauuccuccagcuauaaaaaaagcauuuaggccccacuuauagucaagugguaaucaucuaagaaauugggagaaauaacauuuuuuucccagucauuuuuacuaauagcacuuucuagaacaacaaaaaauugccauaccuguaaucaguacacucagugaugacagcaugccaguguccugauugcaucagagaaaaucugcuaaaauucuagugcauuugugauugaaauaauaaaauacuucauuuuagccucuuuucuacaccuaauauuucuuuuccuagaucaugcuuaucaacaagucauuaauuuggguuauugcauuuccuaccaugucuauuguguugcccuuggcaguaagccacaagaacauucugaugaccacuuuugcaucauggcccaguuguuuguaguauaagaaaauuucccacauuacccaaaccauuuauugaaaaaucucuucuuuaccaagggaauaccauaguaaacaaacauggguauggucuuugaccucuuguuuccuauagcauagcgacuguaacgauuuggaaggagggaaaaagagaaugugagaauuuauuuuauguuaaucuggugaaugccauauucauuguuuauugaaguauuuauuaauaauuuacuauaugggccgggcgcaguggcucacaucuguaaucccagcacuuugggaggccaaggugggcgggucacaaggucaggaguucgagaccagccugaccaacauggugaaacccugucacuacuaaaaauacaaaaaaauuagcugggcaugguggcgcacgccuguaaucccagcuacuugggaggcugagacaggagaaucacuugaacccaggaggcggagguugcagugaaccgagaucacgccacugcaccccagccuaggugacacagcgagacuccaucucaaaauaauaauaauaauaauaauaauaauuuacuauauguaagaauauugacccugcuuugagcuuuugaggcccaaaaugcuuucauccaaggugccuggcaagggguguacaguugagauaccuuguauagaacagauuuaauuaauggaaauugggaauuggaaguagauaaaacuggaaaauugguuucuucuguguuuucauuuaaaauauuguaaaacaaaguuaacuguuuuaagcaucaacagggaauaaguguuuuguuuuaaaaagucugguuaauacagaguuacuuuuaacuuaauguggaguuaacuauucuaacauacuaccagauauuucaucuuccuuugguaccucuaagguacugccuaaagguugucaucuuaaauagcaacugcuguuuuucacucauaaguuuggauguauguagcaaauaauguagguuuucuauugagauuuuuggauaaacuauuauuuuuucuaauagagugauaagauauucucuacuuugcucucauucugaaaaucagcuaccaugaauauuauaacuuacaucuguuaucuugcuucagcauaguaauauuuaaagugauuaaaggaaacaaauguuuaccuuccaaaagaugcauucauuuuauucauuuauauaaaaaaacugcacguuuaauauauacauuuugagugaagucauuguuaauuaagggauguuacagccccuuuuguacuaugaagagacuuuaugauuuucuuucuguuaaggguaguauuuacauaaaaaauaauuucaucaaaccagagagaggccaacagacauuacaugucaucucaggugguuccaagcagagauuaucucagagagcucuuugaccauuuaauuuauaaauaauucuacuuguguuuucuuucuacuuucacuaguuuucucuuuccacuuuuaaaaaauguuguguuucuuauucaggguuuuguuuuggacuguaauauuuuauagaaauuuuaggauuacuuucauaaaaauuucuuaauacuucagagcuaauucaagaaaccugugugcauuaacgucaggaaguuaacugucccacauaauugccuuggaguuguucugaauuguugauuauggucucaaauaauuaucugacagguuuuugguuaggaauuuuucugcugccacacacuguuccuguugagaauguagagguacauuucggacuuuauauuuuuaugaaacauuuggaagguuggggugguggaugccagguuucuaaauccagaaaaauguauuuuguuagacuaugaguaucccuaaucuuuaacauggguuaauuggaugguggggaguauuugcuuugauuuccuguguauaacucaccgauggguuuccauuguuugauuuucuucgcggauagguuuuucagauuacaauuagucuaaauuagccuggugcgguggcacaugacuguaaucccagcacuuugaggaaggcuaaggcaagcggaucgcuugagcucgaauucaagaccagccugggcaacauggcgaaacccugucucuaccaaaaaaaauaaaaaaauuagcuggaugugguggcaugcacuuguagucccagcuacucaagaggcugaggugggagaauugcuugagccagggagaucgagguugcagugagcugaaaccgugccacucuacuccagccugggugacagagugagacccugucuuaaaaaaaaaaaauuuaaaaaacuuagaguaaauuauuuguguugauuuuuacagucauuuauuuuaaauauaaaauucagaacucugugcucugcuuauuaaagguucaaacucaacuuucccauucuuuuacaguuguaucuuuguacuuaacaaauaguuuguccagggauguucaucuguauacauguguauaugcacacaauucaaaacauaucugggaacaguucaaacaaugccucucccucacauuauuauuaacaauaggauagggaguccacauuguguugguaacccuugucauggagaaaauaagagagcugauuucuguuaaaaacuaggccuugugugccagagucaaugaauagcucugacauacgugagucaauuuuccauacacagaguuggcuaaaguacauguuuuguauauucuguuucaguaguaagcccuucgauaaucaagaugagacucuuaugucuuguaucccucaaguuaauuccagugcauuucuuuaaaagagguuugggcaagaaagcaaugaaucuaauaaggcuaucagaaaaguucagaacacaaugccacgcuucuucgacaaugaaggcaguacauaacaaauucccucauuugcuuggaaaguauugaugaaacaauuaacuuauuucauuaaucuguuaagaaaugaaguauuuuuuuaaaggacugaauaaaagucucuuuauauaaaaucauucaaauaauaaucuuagcuauuuccuguuugucaaacaaagauuaaaagcauguauguggcaaagcgugguggcuccugccagcacuuugggaugccgaggcaggagguuuaccugagcccaggacuuugagaccagccuggacaacacacgaagacuuugucucuacaaaaauaaaaauaaaaaaauuauucaugcgucacgguacauaccuguagucacaguuguuugggaggcugaggugggaggaugacuugagaguucaaggcugcagugaguuaggauugcaccagugcacuccagccugggcaacagaguaagaccugucccuuaaaaaaaaauaaaauuuaaaaaaaaaaaaaaggauggcugcgcacggugguucacgccuguaaucccagcacguugggaggccgaggcaagcagaaugcuugaguccaggagugugagaccaguuggggcaacauggcaaauccccaucucuacaaaaaaacacaaacaauuaggcauggcggcuacucuggaggcugaggugggaggaucaucugagcccaggaggucaaggcuauagugagcugugauugcaccacuggacuccagccugagugacagagucagacccugucucagagaaaaaaagauauauguaauguaccuaguacauagagccuagcaaaugguaggugcuauuaacaauguuauaauuguuacuauuagcaauaacacgauucuauggcuucucaaaaauuuguggcuuuauugucaugcaagauuuuuucuuuaguaauaaaacagaguaaaacuuaauuuuaacauaaccuccccacauuuucaguacaguaguuuuaauucuauuaaguucuguaucuguaugcuguauuuuuauuguuuuuuauuaauauugaaugaguucaacuuuuuaaaacuuaugauacauuuuccauaguauauuuuuauaauuauuucuaggauuugguacucuuucuacugaacuugggucauaugcacauaugguaguucuuuuaagcacauuuacuuuucacggugcuuucuugugcugcguaaagauguuggcuacaucuuguagauguagaaaugcuuuugcauacuuaccguuuguacuucuuuggauaauuuucauguacaucaccagugggaugggaugauccuguaucuucauuuauuauaaggaauaacuauaaaccagauaguuugugacuuucuccacauacuuuucguuagaaucuaagaguuaggccuuugaguauuuaacucugugcuuuauggcucgaaagauuaaauguuaaaaacaaauuagugauuguguuuaguuuauugauuuuuaaaauagcucucccaccucagagaacuuuguauuuuucauuuauuccaguagaaauuagcauccuggcauccauuauuuuuacugcccugaccuuaacuagacauggaacauuuuaauucauuaucuuccuuacaauugccacuaaucuuuacuauuaccuagaaaaguacugagaauucguaaccucuucaagguguuuugagucugguugaaaggguguaaccauuauaauuuuucuucauaacaauuauuaauuacaaagagaaaauuauuccuauuuuuuaaaugucagauuuucuuaguugagugauauuuaauugguuauuuuugugcuaauacauauauaacucauaaggauugcucuguuuuuuucaguucuccaaauucuaguagcugguaacucugacaacguauuaguaucaauuucaaacugaaauucuauuaaggauguuucauauucugcacccauuuuuucgccuaguuccugucuuauacuucaguauaaaacaauguaaauuauaaauuggggacuuugucccuaagccuucuaaauucuaauauaaauagcauuucucuggacuaauacaggucuauuaaacaagcugcuaaauuuuugcugugacagugaaauucugcuaagggugaaaagugugcucuaaauaauaaaauccacuuuuaaaauaauuacauaucaaauagagggaauugcuacuuaaagccaaaucuggcugccaaguagauuacaaaaauaugaaauaaaauguuuacuuuaauaaacaacuuguuuucucugcuuuguuauguauguauggcauauuuucuaguacauauaauuucuauuugcuguuugaaaggaaaucgaaauaaauuauguuauugaacaaugccacuuuagcaauuuaugguuuacuuauauaguaguguauuaguuuucuauugcugcauaaaaauuaccacaaacauagaggcuuaaaagacaacacccauuaucagcucacagugggcccaacuguguuguccgcuuaggguucuaugaggccaaagucagccaggcugggcccuuuucugaacgcuuugggaaagaauuugcuucaaggcuuauuccaguuguugacaaaccuuaguuuguugaagcuguaggucugagguccuguuuuuuggcugguugucaguaaaggccacucuguucugagaggcugcucauaguccuccuuacauggccccucuaucuucaaagccaucaacgauaugucgaguccuucucacgcuuuaaaucucucugacuugcccccgugcucccaccagagaaauguuugagcuuuuauagggcucacuugauugaaucagacucaccugaaucuuaaauuguaucuuaaggucacuuggcuuggagcuuaguuaacaaaugcauaaauccagcaggguaugguaguucacaccuguaauuccagcacuuuaggaggccaaggcggacugcucaguugaggucaggagguugagaccauccuggccacccagugaaacccugucucuacuaaaaauacaaaaauuagcugggcaugguggcaaacgccuguaaucccagcuacuugggaggcugaggcaggagaauuacuugaaccugggaggcggaaguugcagugauccaauaucacgccacugcacuccagccugggcgacagagugagacucagucucaaaaaacaaaaaagcaaaauccuuucuuagcaguaccuugauuuguguuugauuaaauaaccaguggaugggaaucuugggugccaucuuuagaauucugucuaccucagguagaauuuaauccacaauaaaguuuuuuaaaauauauuaauugcacuggacuaagauucugaagauaugggguucuguuugacuuuaguaacuaauucuggacugugaggucuuuaagaccaggaacuaugucuuauucaucuucauagcucuagugccuagcacaguaccugguguacagcaggaaccuaaaacauguuuguuaaaugaagucaaauuaagauaauuuuacuucucuguaucuuccuuuaucuuuuccucauuuucaucaaagccuccucguagauuaaaagugagauaaauacauguguaagucuaugaauauucucaagcauuacgauaggaacaauauacagcacccccauuuuauagacuuuuuuuuaaauuagcauuuguuagauuaaguaauuuuucuuaaucucauugcuaauaagcagaggcagcacauugguuuucugacauggucaguuccuaaccuuuaauaaucgauuacauuuaugacacacuuuagaguuuucaaagccccuuuguuagcuacgcuuucacugaauccuuucaagaauccugugaauuagugcaaguaguaugaacuuuuagacagauaaaaguaaacugaaguaauuugaccaugguuacccacuaauaagaagcaaauucaaaaauuuaaguccagcuuuucugcauaugaauacaggauuuacauugacaguuaaugaccccuuuccuuuuagaauuuuuaauagaagauuuuauaccagugauacuuaaaauuacaagagauuaaagcagaggacugggaguaagucacaaauuauuuucccuucugcuucuucagaacucauuuagguaugugcauuuucauaguauucaccuguugcuuuucucucucuuuuuuuuuuccuguaaucccuagaugguggcaucuaccaccuagacuagaugguaguacaauuuauuuuacuuuuauuguuagaugugaguuacaguuaauuagaaauccucuugaacaaguuagagaguagguaaaaacagaagacaauaccaacaugcagaagaccucuuagguggcacugccauauucaugugugcgcacacaugcuauuuucuucuguauaagaaacaaagucauuuuucuuuuauuuuuucuauuuuccuuuuguuguucuguaguuuguauaaucuaggguuaaaaucccaagaauacagugcuuuuuaauuuugaagaacuuuuggcucaaaaugggagcaggacauacugguacuguagacucuuguuucuguugacucuacaaggaaggccuuuuugaaauaaaaugauggguuuuuuuuuuuaauguaaagcauacuagucuggauauuaaggauuuuguaucuguuuuauguuuguuaccagacuggcucccucauguuaagaaguaaaaaugauagauacuuuugccguguacuauuugguguuggguuuggggaggaaaauuggaagaaaggaguguuuaaaaccuaucuggcucugguucacaggugcuucagcugguuucccaaaccaaagcuuguaucacaaacuugaguuaguuugccuuaccgcauucuccaaucaugugacugauggucggccugucagucaugcuggacauccguauuggaagucugcccuuuuuucuuccuuucugcuucauugccucaccucagaccugaugaauagguuucuaucacuaauaaacuggugguguacuuuauacaguguugaaacaccucaguagauuugugguuggacucugacuuacugugcauuugaaacauuaaguuuggaacuuuucugaguuuauccaccuuuaacugcugguuuuuguguguguucuuuuuccuuaaccuuggcuaaacuauaauauguuguaaaauaaugaaguauauuuuauuucacuaccaagaagucaccauauaaguuccauuguacucaauuaacacagaaauuguggccauuugcugauuuaaagaaaaaugccuaagaaagaaaaauaauaaaaaugccaaccuaucaggauuuuaaagaaacuucugcaagugugcuucugggaggaaucaguacuccuuuacugaaaccaacuuugauuuccucacuuuucauacuuuaugcacaguuaguuuuucugugguuuaggacuaugaauuaagaagcaaauuuucuguuucaguaugaaauuuaauacaaaucuuucuuguauauucagcggccauugcagucauuuggacagacaggaaaaaggucuaagguauaguaaauauuuuggugugcuggcaugccaagggccuuccuucaugcuugaugaauccuuguuuucauauagcacuacauucaguuuaguucuuccauauuuuauggggggcagaaagcuuauuuuguuuuauuugggauuuuugucuugccuagucgcuuuugugcauugcuuuuuuuaucuugaugguucuuuaucuguagagaaaaucgcuuucucaccauuuuuggggauaugaaguuggaauuauucccauucuuucuauugcuauaauuuucaaaacugcaaauguuuguguuccuucuuaacaaaggccuucaguaguguuuaaugauauauuuaacuugcacauuucaucuacuguuauacauggcagaaacuauaaagaaacuuagaaacucuuucuagggggcuuuuggauaugcccuagauuucugaaauguaguguuaauuauaaauacuucucuuuagucaagcucaaaguuaaagcuaguucggagccuugcagugugugaagaaucuccaccacccccugcaccagagauaucacaggagaaccagguaaaaaagcaaaacaaauguuauuucaagacaugguggaacuggagaauuuuuguauaugauuuaaguuguguuuguuauauuuguuuuauuuugacuaaaugaaacuuauucaauaauacuuggcacccaagagauauaugaaaaguuagaaaaccucuuugcuucaaucuaaggcuuagagcaauuauuacucuucuggaagaacuuaggaaucauguaauuaauuaggaauguggcuuuaagaaaguuauaaauuaauuuuuauaaaguuaaaaaauguuggucgggugcaguggcucacgccuguaaucccagcacuuugggaagccgaggugggcacaucacgaggucaggagaucgagaccauccuggcuaacacggugaaaccccaucucuacuaaaaaaaauacaaaaaaauuagccgggcaugguggugggcgccuguagucccagcuacucgggaggcugaggcaggaaaauggugugaacccaggaggcggagcuugcagugagcccagaucgcaccacugcacuccaaccugggcgacagagcgagacuccaucucaaaaaaaaauauauauauauauuaagguagcauuuccagugaauauaauuguggugaaauuugcccuuuuaguuuuaccuuuuagaaauuucucagauacuuaaugcuuguuuguaaagagaccagccaagacuucuucuugauagguuauuuaacguaaccugaaugcauggugaaaccaauuuucauauuagcuuggcucuuuaauaguuaucuaguauuucuaauuucucacauaucuauucuuguaaaauuuagaacagugagguuuaggcaaaccauuuaguuugcauucuuuuuaaugcuaugacuacuuuucuguuaaucucagcuauggguugaucucugucucauguuacaucuguauauuuaugcauaaauauuuuuggauccuuuaccaauguuuaucuugugauaacuuugccuaguggcuaguuguacuuaauaagaguuugagcaacuuaaaaugcuccuuuaucccaaaaaacaguuuccaaggaauuugggcaauuuugugguuauuuaagaagccaugacugauccaugacauguacaucuuuuuuauaaaguaaauaucauuauacauuuggugauucaaacuaaaauuguuaaacuuucccuugauuuacaugauacccucaaaagccuauuacagauauuuaggauaguugucacauauuuagaauaugcacuguuuuugaaaagcacuacauuuuauugcuugaaaaugcaaggaaaauguuuugaaauagauuguugucaaugaaauguacuuaaaaaucuguuugcuuugacauuucuuugcaucagaaacauagggcugaaaauuaauuuaugauuuuuuuuuuuuuuuugagacggaguuucacucuuguugaccgggcuggagugcaauggugugaucucagcccacugcaaccuccgccucccagguucaagccauucugccucagccugccgaguagcuggaauuauaggcacccgccaccacgccuggcuaauuuuuuguauuuuuaguagggacgagguuucaccauguuggccaggcugguugcgaacuccugaccucaggugauccaccugccucugccucccaaagugcuaggauuacaagugugagccaccgcgcccggcugauuuuuuuuuuuuuuuuuuuuugauguaucuacauaggagauagcuguaugcauuuauuugauauaauagaugcauuuuagcaaugaaauagacuuucuagcaaaaagcagaaauacagucaaaguauuuacuaaauccuugcuuggagaauauuuucaaauauuaaccuuuggcuuuugcaugauuguaauaaagcugaagagcuauauaauacagucugaaaaaaaaccaauaaaauuguuuuuugaaacagcacuuuuaaaaaguucuuuuggccagggacaguggcucgcgccuguaaucccagcacuuuugggaggccaaggcagguggaucauuuaaggucaggaguucaagaccagccuggccaacauggugaaaacccaucucuacuaaaaauacaaaaauuaggcaggugugguggcacacgccuguaaucccagcuacuucggaggcuggggcaggagaaucgcuugaacccaggaggcagagguuucagggagccgagauugcgcuauugcgcuccagccugggugacaagagcgaaacucuuaucucaaaaaaaaaaaaaaaaaaaguuauuuuguacaagucagaguaaagaauacgccuguuugggauggaguaguaggcaguguaauguuuuugaaaauucauuucuuuguucuguugaccaaaaaacagauguuacaccaucuuagcuucaugacagucuaaagagauugaggaaagaagggucaggcauucauaaaucuguuaauacagaggaagcguauacuuuuugaaaaaacaaaagcuguaccaugacccuuguuuuuuguagugcauuuuaccuguuugaaaaaucuugagggagagccuguuaugguacuaaauuuggcuagugaaaauuuauaugaagaaaaaauaacaggaauauauguuguguauugauauauacauuauugaucauagauaauuuuuuguguugacaguucaaaaagaugaguuauggcauguggauaaugacuaaagaaguuauaucaaaagucaauuauuucccuuaauauauucuuucucaguuucucuuagauacaauaagcuuuuucuuuuuggauaauugccuaugaauacaauccucugaauaaaagauacuucuucuaguaggaagucuuuuuccaagccuugagauaaauaaauugcaccugaguggaaauuggaaaauaaauuauuucucaugaaagguacuaguaucuaauccuugaugguagacacaguuuccaacuaauuugcuugauucagaaugugauuuuugaggaauuaaucuggaauaaaacucauuauucaaaaaguugagaggcaauuaagagagagaugucacuuguaucugaugagagcuugugagagggaagugaccucaauaacagauguuauugacagagugaagaguaaaggaauugcaguuuccuauggagagguagcuauuauuccaguuauuuauagucugaagauuuuguguauaagaacuucaguguuuaaaauauaucuuguuuauuugcuacugaaaacuaggccaacugaagacaggccucaguacauuaagcuuacaagauuuuaaaaauauaguucaucuugauaaaauaguuuaguaucuguaauuaaaauauauggcuuuuugaggagagcuuagaaaugaaaucugcuaguuacuggaagugccuuuuagugaagaucuaagaggagguagugugaaaucuuuucucccagccuggauuucacuggguuccucuugaguaaccagaauaguaguuacaagucaagaaaacuucuaaauauuauacuucugaaaaauaguucugggauucauuucuagauaccuguuuuacaguuaugaaaagcguaaagaaaguggguuggaaaaugaaucacaauaagaaaaauuacuuacugguugaugaguguaaggaaguugccagugucuuugguaaacaagacagagagugcaaaaagcaaguguuugucauccuaguaaaaacugccagugugcaucauuuacccuauauuaugaacacaaauuuuaacugguaugaugaauuaagaagaagaaaagagaugaaaauagcagguagcaguccuauugggguaaaaagucuacgugucugauugaugguuuucuugacuauagaacaacaguauaauuuagucuaaaaauaggcuacacuuuuaucuuuaguaaaacugguguagaauuuauuauagcuuucuuuauaacuuuaccuaaguaaacagagcuacaugauuuuugccuuuucuguguggauuaauuucuaguaaucccuuuggguucuggaauuacauguaauggcauuguuuuuaaaauaaaacaugaauucuccuuucagucuuacagaaugugguuacuuuacaauuaaacauuacguaucuguaaggauacaauuuuguuugaaaucuuucuaaaaaacuguggugauugaaggauugacagugauauauaaaucucaaaaaggaaauaaagcugugugccguugauuuuggaaauguuuguacuuaacauuuuuauaugguaggagaaugaaggaaugugugauuauaauggauacucagaaaccugauuuuuauuaaucauugacuugacacuuauacauucguauugucaugauugaugauaauuaugcucuugcuuggcaucuuccuugcaaaaauaaguuaagaagaccugaguucucauccuccggggauuuuacaaguugaugcacuuaaacuauaauagaaaacauuuauuuucucuauaauguugaggauuuguuuuaauugauauauucaacucagaacguuaguuuuacauuuuauauaaaguauuugauaaaaguaguaaaguauuauuaaguuguuuuuuaguuugaagaauccaguuggguaaaauaaucuuuuuccucuguacaauucuguguuacucaaaaaauauaaaugugugguauuaaaugaauuguauuguauuuucauugaauaauugacuuugccuuccaacaggagaaaauucagauccaguuaacacaaucauuugagaaagaagagaagcccucaaaagaugaagcagaaaaagaaaaggccagugauaaguugcccagaaaaauguuaucaagagguuugcaguucuuuuguuuuuuuuuaaaaaaaaauuuugcuaucaguaauuccauccuuuuccccuugaauaauuauauauaguauaucuuuauguaaaaugacacagaacagacuggaaggaugauacaguacuuaacucaucugggcaaaaugguuuaacacaguuccauauaucaguaagacguuucagccaaaaaugcaacacauaacagacguugaggacaucuuaaucucuuacuggucccucacucauaguaaaauacuaaagucauuauaauuuuuauauugauucaucuaaggauacuaucacucuugaauuccuuaugguacaaagagcugaugucauaauauugaguauccaguaagaauauucuuggaaacagaguguuuauuuuuuauaaguuuggagggucuucacuauuaccuagcauugcagaucaauagaaaugcuuuuuaaauuuaaaaacccaguuauguugaccaguauuauaaauaguauaaagauacuacauuuaaggcgaagauagcaugaauauuugaaaaguauuuugaaagcaagccuguaguaauagaccugacaaaaaucaaauucuuucacaacuaaaauuucuaucuaccuccaaauuauugccuccauuauauucauaucugaacuaagcugucuuaauuugcuacaaauguaguuaauuauguaaaucauuuaaauuuuucacccacggaggcauuuugaacaugagguuguggugaguauauaaaaggaucuuuaaagaauuuagaggaaauuaaacagacacaugugagagguuaauuuuuuuuuaagaaugugcguggauaugcaguuauauaaacucaugucaugcacauuauaugggaauagaaacaucguggucaccugauuucauuguaacuuuuccuacuuugucgaauuuuuuucaauguggggcaucuuguuuuauuuaagauauauauacaucauguguaaaagggaaugggacuuguuuucaaacaacuuuauacuggguuuuuguguuguuguuuuuuagauuccagucaagaauacacugauucaacuggcauagaucuacaugaauuuuuaguaaauacauuaaaaaacaaucccagguaaaaauuaaauuuauaagguuuccauugcuucuagaguaccauaauuuugcuauauauguuuucauuauugaguuagaguaauagaauaagauugcagauauuugaaguacaccagaaacauuuuaguuuuuuagggcaaagauguuguuggucuaguauaugcaaauauauaaauaucuuuuugcauuaugcaugucaccaugauguaugaauuuugggaaauauagaaucacuaagauauuuaggcucuugauugaguuagacauauaccauuaaucaugagaaaaaagaaaaauagguaucucaccauagugcacucaaccaaauaagaacuuaguguauucacuuaugaguuuuugaaguuuuuaaaugcaaaguuuuuguuccuucuugcugaguuuauaaaucaucaacccaaagauuuuugagguguuuauuugagucaguacuuuaauugugaaaucuuucauuuugucagauuacuaaaugaauaauuuuuaacuuuuuggcaacucauaagcacuuugagacauucucccugcaaaaauggcuacccacaaauuaucugaccaacacuuucauggagugaaagaugccaaggugaagaaaucuuccucuagauguuagcuuuccagaguaguagcuuuccagaguugacauacguugaaauaaaaaugaugucacuagauaugggcacacggaagauaagagaguuguuuaucucuuacacagucuugcuucaagauaacuuguuuuuauucaggauguauuguauucaguacuaucuugauuuucuguuucguauuuaauaucaaccccaaagagaauuaccaaaaugaaguggucucuauaauaggagcugaaggauuauagguaaggauuuagagagaagguaggcaacucuccuugacuuuuuuuccuccaguucaaguuuauuccucaguagucccaacagaaagauaaauuuaugagucuauugaacagcucuaacuaugugccaagcauugugcuaaacauuguagauaugaaaagguauuacauagaagcucugacccuacaguauucacugucucuguacuagaaaaagacaccugauaauuaaaauaaaacaaauguaaaagagguuuacaggugcuguaauagccagagaagggccacaaccucugaaaggauuuuggaauaugucacugaaaagguagugccuaaccugaaucuugaauuaagaguguuuuauauuggagcugucuauacagagagacaugggaagggcauuugagauagagacuagaggauugccaaggcauaguuaugugagaggaaguguuauauucaaggaaagauaggcauguggcaaguuauucuagaaagugaugguaaaggucgggcgcaguggcucacgcuuguaaucccagcacuuugggaggccgaggcggguggaucacgaggucaggagaucgagaccauccuggcuaacacagugaaacccugucucuacuaaaaauauaaaaaauuagcugggugugguggcgggugccuguagucccagcugcgugggaggcugaggcaggggaaugguguaaacccgggaggcagagcuugcagugaguagagaugcgccacugcacuccagccugggcgacagggcgagacuccgucucaaaaaaaaaaaaaaaaaaggaaagugacaguaaagguacuggugagauaugaagcauaggccauauccaacuaucgucagcaagggauaauaccaacacccuauggcagugaggaaaugugaggggaccuuuugauugucccagugagugcagagugcugcugggaagccagggaugccaaaaagaccuauaaaacggugaugaaccacgaaaaauugucuugaaaugccaguagugcaucagucgagaaauacugacuauggcaugccaaguuaaggaguaauuaaacuggauuuuaaauagggccauaccauaaugagauuuguguuuuggaaagauuacuuugguguuuuagaaagauuauuuuggcagagauaacuguaaagaaaaagaguggcuaggagaccauagaaaagaauggagaggaaaagacacauuugaaagauauuuaggaaguaucauggcaggacuugaugaucauuuuuauauggaaaggcaauggggacaguagaguagaacagaaaggccaaguacuaaagauagcaaaaacagggccugguggcaugugcuuguagucccaccuacucaggaggcugaggugggaagauuacuggaguccuggagguugaggcugcacugagcuaugaucucgccacugcccuccagccuggacuccaucucuaaagagagagagagagcagaggaauccugagaacauuuguccuggaacucaaccaaaagggaacaguuacacugaaaauaaaauaacagaggggcccugcacaaugauucaugccgguaaucccaguacuuuagcaggcugaggacaguggaucaccugaggucaggaguucgacaccagccugacuaacauggugaaaccccgucucuacuaaaaauacaaaaauuagcugggcgguucaugccuguaauccuagcuacuugggaggcugaagcaggagaacugcuugaaucuggaaggcagagguugcagugagccgagaucacgccauugcacuccagccugggcaauaagagcaaaacuccaucucaaaauaaaugaaugaauuaauuaaaauaaaauaacagagggauaugaaaauauaaguauuguaagauugcgaaauauauauauuuggucugccuccguuuccuagcuuacaacuaaaauaccuguaaucuccaaagagcuaucuuuuuguaugcuaauguugacugauagcuucaagauaucagauuaggcgggucacuggaaggacaaaggcauguucagaggguugggacuucagccccugcucccaaucuccuggaugaggagauuggugaaggucagucuccucaacaaucauaccuacauaaugaagacuucauaaaaacccaaaaggacagauucagagggcuucccgauagcugaacacauggagguuccuggaggaugucaggccccaggaaaagaaugcaagcuccaucccucuucccccauacuucguuguaugcaucucuucaucuguauccuuuauaauaaaccaacaaauaugaguaaguguuucccugaguucugugaucugcuccagcaaacuaguugaauccaaagcaggggucaugggaaccccaacuugaagcugguagucagaaguuccagaggccuagacuuggaacuggugucugaaguggggcagucuuggggacugagccccaaacugugggaucugacacuaucuccagguauagagugucagaauugaauuggaggacacccagcuguuguccacuguagaacugcuugcuugcgugcgugcgugcgugcgugcgugcgugcuugcuugcuugcuugcuugcuugcuugcuugcuugcugguggagagaaaucuccacauauuuugggucacagaagucuucucuguugauuguuguuguguuggugugagaacagagggaaaacaugauuaaagagguuuuccaaaacaaguaccaaaaauaauuuguuagauucagaaguuagaaauuguuggcuauuuuaacaagucauuucauuugggauaggguggugggaaccagaacucaguggguugaguaauaagugggaagguaggaauucauaacuaguaugaguaaaauaagauucuagacaggcagaauuuuucuucucucucuaaaccugugggaaagacaucagcaaggaacaaagauuauaaauccauuuuuaugucuuccaaauuauguuuugauuguguaguuauuuuuccucuauagaugcaaacguuuuuaaguuauccacauagacauuuuuuaacuguacgguuuaaugguuuuuaguauauucaauauacagauaggagcacuaucaccacaguuauagaacuuuuucauugccccaaaagaaaccccauacauuguagcuauuccuaugcuaauaauaauaguaauacugauauuggaugaucccaacccuaaucuguuuucuguuucuguagauuucccuguucuggacaucucauaugaaugaaauuauauaauguauggucguucaugacuggcuuuuauucacuuagcauaauguuuuuaagguucauccauauuguagcauguaccuuuuuuuauuccuucuguguaugcauuuuuauuugagcaaauauacaagugaauaauucguguaauggcuaauguauaaguuacuauuagugucauugugguuuuaggaaguugaagcuaauguuaaauuuugugagaaauaagguuugcuuaauaauugauucaguauucucucucagugaagcauacagcuaauugccagcuauaccugguacacaauuaguuagaaguauggcaaauucccccugaagcauucaggguugaauauugccuggagaauucuacuagauguuaagcagauuuauuuuuagugauacuaaaauuuagucagccuuuccuuuuuggauaucuuuaauuucaagauuuuuguucacaucauuaaaucuucauuaucuugucauagcccaauaaauaaacuaaauuucagggguuaaauaauaaguuaucuggaauuucugggugucugcaauauuuucagagacuacccuauuaaauacagucauuaauaaauuagaaccuaggaaccugaagguguuacugauaaagauuacacucacugacauaauuuuauauguauuuuuguguugcuuuuagccauauuguauaaauuuuauauggagaaauauggaugguacagauaacuuauauuauguaauaggaaaacaauaccauggauuaaccugaagguggauuuuuuuaaguaauuuguuuugcucuagggaacgucacguauuuguucucugaaauaucuucuaaaagucauuuuuauuggagguaauauuuaagucauuuuauuucuuaucuguugcagacauuuaaccaagagcauaugaaacauuggguggaggguggucaaacagaagcauuacuauuuucuucuuuuuuuauuugccacugguauaacaucgguucccucuuucucuaaaauuacuucuggaauaaugacuagaacaauaguaacuaaaagauuguuagcccuucauuuuagcuuuuaguuuauuagcuuguuuuuauuacuucuuuaauaauuaacagcauguaucaguucauuuuaaagguuacacgauagaaguuuuaguuugugccuacuuuuagaugguuuuggcucaccugcuaaaagaucaauauaccuugagaaaaguaguuuaccuguuaguuugagucucauauguagggccccuauaaaggauuaguaaccuuuaacuuaugaccauuauaaaaauaucuaaccucaauuacagauuugaaaauuugaaagcuuggauaagcuacaauguggaauaaaaggcagaagguauaaaucuuaagaccuuaggaaaguugucauucuuguuuuuuuaacaagugcuacuaaaagcaggguaucuuuuuuaaaauaagugacccagauaaucuaaaaauccucugcaaucuauagauguacgucuuaaggggagagaaagccuaaauuucuaucaauugcuaguaaaauuguuagauucuguuauuucaugcagauaguggaaauuucaguggcagugcauuucacugaagaacaauugaaauauucuuauaccugcucuuuagcucaaacacagaaaaucaauuuaaauguacuguuuuaugaacuccaaauaaguugccuccuuucuuguuuguuuguuuguuuguuuguuuuugagacggaguuucacucuuguugcccaggcuggagugcaauggcacaaucucggcucacagcaaccuccgccucccggguucaagcaauucuccuaccucagccuccaaguagcugggauuacaggcaugcgccaccacgcccggcuauuuuuguauuuuuaguagagauggggguuucuccguguuggucaggcugcucuugaacucccuaccucaggugaccugcccaccucaaccucccaaaguacugggauuacaggcgugagccaccgcgcccagcuaguugccugcuuuugauucucgucuuuauuuuuuuuacaguaaggcaauauguaaauuauaaaaguuacugaaaauacugucucacaauaaccccaaaagcuuggaugaggcugggcacaguggcucacgccuguaaucccagcacuuuaggaggccgaggcggguggaucaccuuaggucgggaguucgagaccagccuggacaauguggugaaacccugugacuacuaaaaauacaaaaauuugccgggugugguggcacacaccuguaaccccagcuaccgggaagcugaggcaggagaaucgcuugaacccgggaggcagagguugcagggagccgagauugugccacugcacuccagccugggggacagagcgagacugucucaaaaacaaacaaacaaacaaacaaaacuugggugaaagagggucuuauaauuuaguaaauaaauucuuuguugggaaaacuuuaggaaguaaaaauucuucacccuccccuaaaauuuaagaaaaacaaaaagaauacuaaaagaccuucuggaugaaguaauuuuacuaauuuauuccaugcaaaauauuuuuguugaaccuuucuauauacaaauaguucaaauaacuauauaugacaauaauugugauaaaugcuauuaaagaaaaauaugaaagaaacaauucuaagaaagaauauaagaauauuucagcaaaggggaacagcauguucaaaguaccugagaaagacaggagcuuggcaaauacagaaauaaaccaggaugauaacaguuuugugaguucaggucaggagaugaggcuggagcuggaugaagaccagcucaugccugccuuguacauauguuuaguucuaagaacaguaagaaacccaugacagauuuaacaaagggagugaugugugaucacauauguguucuuaaaagauuguuaugcauguuucauguagaauagauuagggaagaucagggaagauacagggagacaauauacuccugcuguaguagucaagccagaaauccuguugccuggauccaggguuguggcaguagaaaaauagaucaaaaguagauaaaauuugcaguaguaauuaacuguauuggagcauuugaaaaaggaugauuuaaaaaaaaaaaaaaccuucgagaccagccugaccaacauggagaaaccccgacucuacuaaaaauagaaaauuagucuggcgugguggugcaugccuguagucccagcuaaucgggaggcugaggcaggagaauugcuugaaccugagaggcggagguaguagugagccgagauugugccauugcacuccagccugggcaacaagagcgaaacuccuucucaaccaaaaaaaaaaaaaaaaaaaaaaaaaaacaaaaaaaaaacgagauucucauacuucuacuaucauauacugaguagaagguggugccaguuacugagaugggauauacuaaggagaagcagguuuggaaaccaaacugaauauugcuauaaauuuuguuaaaauguaauucuguguucagcuuuggauuugaaaucaccaaguagacauguuuuucuguugauuuuuuuuaaacaaauauaaaaauguaaguuaaauauuuaaugaaugaugggggaaauguuauuacuuaguuuuaugaaacuuuugcaguguaggaggagaaucaaaugcaggucugauguguagacuuucaggugaccaaagcaggggcuaccaguucuucuauugaaauugagaauaaucugcauaguguuuauuuuagggaaucauuaaccucuuggccucguuuucuugaucuguaaacuuuggaagacaaaacugaaugauuuguaaagcugcuuuuagcuuuaaguuucuguaaguuacauuuuuuuuuucacauguauaugaaauuuccaauuagcacaggaaaauucuagagccauguuaugggugugugagcagggagguccuuuggggagugauaccauuaauuuguugcagcuaagagaacuaaauaagacccuagugaucuaaaggagcacauacagguacucccuagaguccuuauuuauuuuauauguuggagguuuuugguucacuuagauuuuuaugggaaaauuuaaaaauauauaauggcaguuuauagaauggguugaaauauccucuucuucuaaauuagcgauauaauuaauacuucucugccauagucccaucuacauacuaguauuagauucccauagaaguauuccuguuguuacuggcauugcauguucuuuagaauacuguuucuauggaguucagcaugauaacaaaguccugagccuaacuaaagaugucuguucuucugcuuccucuccacuuuauugaaugaggaaauaaaaacuaaaaugcuuuuauuauccacacauucacagagcaaacucuaauauaguaauacuaagcagaucaaaauacauuuaaguuccuucguuguguguaagcaaaaaaaaaaaaaaugcauuuaagaauagccacauguugauuauuguuaaaguugggugauggguacaucaaaauucauuacacuauucucuacauuaguguaugugugaaaacuucuguaauaaaaaguuaaacuacaaaaaucaucuuuuguuuuaaaacauuaauaaauauucuagcaucaagauugggguaauacugaauguauaguuuuuagggggugaaauuuagcuguauaaaucauaggcuguugacauuugugauuacuucauugcuaaguuuuacauauaagagucuucauacuuuguuucagggacagaaugaugcugcugaaauuggaacaagaaauuuuagauuucauugguaauaaugaguaaguccugacauucaacaagaaaagaaauugucaucaccauucuccuugacuuacuaaguugguuuuucuugugcuucuaggucuccacguaaaaaauuccccccaaugacaucuuaccauaggaugcuauuacacagaguagccgcuuacuuuggauuagaccacaauguugaucagagugggaagucugucauaguaaacaaaacuagcaauacaagaauguaagugucaagagauguaacuacauauuauauaucuaaauaauaauacuuuaucuuucuauauuaccuuucaucugagguuuuccacauguuuuaacagucuaauuaaguuuuaugauaaccuuaugugauaggacugaaaaacacauuuaguuuacugggaacaaaaugcaacagccuggacucaaauauggcauaugaaugaggacuggggcauaugguaaaaaaauaaaaauccagaggacauaguaucagugauguuugacaaccacucuuagggauuuuuaaaauuaauuuagacagcuguagccagccuuagucaaauuuaaaaaaaaaaaaaaaaacacaagagagagagcagacuuuguccgugacacccucacauuuaguuaaucuucugucaguuuaccguucuuuccaaaagccucugaauuuacuccuuuucucucacaauucuuaagaaagugggacuguugguuaaugcaauaucauuagugcugucuucuuccugggcuauguaugauucuccggaggagcuuuuuguuuuaagaauugauugcuuuauaguguuacggaaguagaucaucauugcuguuacuugggaacagaagacccaaugcagaggcacccaaguuauaaaacauacacagcacauccguuacaucuucugccuauuuuuaaggcuaauccuaaaacaacuagcugaguucagcugaaauuuauauuuugauggugauuugccuaucgaaaggaauuucaguuugauaugaggcagcaacaagucugugguaaugaguagcagucaacuucagauggcauaaauaauccuuuuugguccauuauuuuucuuucuuuccugaagccagauuucucccagguucuuaucuaugaaugauuuaauuugcaugguuauauuuaauucaucuaugccuuuucugauuuauggucuuuuguccuuauagcugccauaucacuugcuggaacuauugguuuucucccauuuuaaauagucuuuuuguaaacuaaguaaauacuuuaguauuuuuaaaugaucguuccuauaauuaaaaguaaauuagugaaaauagauguguuuagaaagggaucuuuucuucuuauagggauuaaauguuacuaaaaugugagucugauuuaguuuucauuaaaauuuaaauuuucauaucccuucgucuuuaauauucuuuucaguuagucuuuuuccagucaguuauaucaugacuaaaguaggauaguaaccauuaagcuaugagcugagcuagaggugaauagaacuguuaauucauuuaaccaguaccucucaacauuacucagagcugcuggauacacaagcacauauacauuagcaggcauuuugacuaacauuuugacuggugacucucuaagguuuucaauacaguguaaccucaguuauuugaauuauaugaaugaugucaaaaagcuuuagagcugucuuuaucaagauaaucaaaagcuaggcucagcagagaugcuuauaauauacuuaaagaaguaugggucaauaauauaauuauaaucagacaguucaaaucauucaaguuacacuguacuuuuuauauauauauaucuucugggauaugaagaagguuguaaaucagaaaaccuuagagaucugcuccauauugaauaaaaacaaacuuaccuuuuccucauagggagauuacccgcuccagccuugaaucagugguguuauggaugucaacaacccaguguccacuggggugucucaauggagcgggaaguuggcgauuacagggcaguaaauucaggcaucuauaaaagaaugagguaagacagucuuaagguuagcugaaaugccugccagugcuguuggugugggaauccagcugcucuuagaaaaguugccaggcccuugguuaaaccuuauaguucacuuuggaauagcagucucucguucaaauauaaacuccaugaauaagaaaaugugacuuugaacaguuacaaagauagaugacauaagucaauggggcaaucaugugacaaaaauaacauacugccauggucagaacuaaauaaaaaucuuucaaacccuugaagaaaauacucuuuuucuuauuauuuugaucacaaagcuguuuuucgucuuccuauuuuucuuuuacuucuuacauauauuuauguacaaaucuguucucuauuucacccaucuaaguauuuuacaauagaaauuucauuaacuugcuuagauaauucucacuuuuaaucuccuuuugcauaauuugacaggaggcuuuuacguacuuuauuagaaauucauagguuaaaauaaauguucaaaaguauuacuucgguucuagggccaggcgcaaugucucacgccuguaaucccagcacuuugggagacugaggcagguggaucacuugaggucgggagugugcaaccagccuggccaauaugaugaaaccccaucucuacuaaaaauacaaaaaaaauuagcugggcaugguggcacccuccuguaauuccaccuacucagaaggcugagacaggagaaucgcuugaacacagguggcagagguugcagugagccaagaucgugccauggcacuccagccugggugacagagugagacucugucucuaaaaaauuuuuuuaaaaagaaguguuacuuagguucuagauauaaggaaguuugcugaaaauaucauuacucagauuuauuuggauuagaaauuuacuuagguuauucacauauaucauuugauauuugaacuauaaaaacuaccuaggaguucaaugagauuuucucuaaagccauuuaauauauuguuauauuucauauuucaaaagaauaauuccaguuuuauaauagaaugauagucacaggaguauugauucaauuaauuuguugaagcugagaauguauuuugggaggugaaauuuuauauaauuguaauuuuccaagggccacaaccuuguguuuguccucuagaucacaguggaacuugcaacauuucuguggaagaaagaugaguccacuauaaaauguauugcuaagauuucauaaucguuacuuuaggucacaacuuugacuucuauaaaagaacaucucuuuucuaaccuguuccaguuaauguuagcaaaccugugcccuacuguaauuuaaaauuaauggaugcacuuugaaguagucuguaaguuuuuagcuaauugaaugacaaaauauuuuauuacuuucagguauaacaccaaacuagguaccauaggaguagcauaagauacggcacugcacuuuccuugucccagcauuuuuucguagguuuagacgaggcaguacaggcuuugggucuaacugaccugagcuccaacuauggcuuaaucauaugccugccuuugaccuugcauauuugcuuaagccauuugaaccucgguuuguucaauaauauuuauaucaguaacuaacuucugaguguuuacuguuuuauguguuacugacauuuucauuucaucuucagaacaacccuaagaaguagguacacuauauaauucccauuuuacaaauaaagaaaccgggaaagagaaagguuaaguaacuugugcaagucauaaagcagcuaaagugcuaaagcucaaccuuugaauccaagcggacugacuccagagccaacauuguauuugauauggccucucaaccauaacauggaauaguuaguauuuucucaugagauuauugugaggacuaaaugagacugcauaagcaucuauggauggcacuaaaaagugguaacuuauuuuauuucuuuucauaaaauguuauguuuaacuucuuugcuaauauuguucauuaucuuuuccuguuccuuuguuuuuguuuuuguuuuuuaagaccugaucagaaauuuaaugaacauauuaaggaugauaaaggugaagacuuucagaaacguuauauccucaagagagauaacucuagcuuugacaaagaugauaaccagguaaucuagaacaauuguaggauuuguauaggugcaagacauacuauaccaguaguucauuugccuaaaaauuauccucuuuucuguagaugagaauacguuugaaagaugacagaagaagcaaaucuauagaagaaagagaagaagaguaccagagagccagagaccgaauauuuucccaagauguacguacuaacuuacuuaggucuucauguuagaguauauucuaauuacguuguagggucucagucucccuuuuaucuauugaucacauuuauuuuuaaucacauuuguugcacauaaggucaucuuuuagaaauauugagaucaguuuugcuuguguuauuaauaguuuauaaaauacuacauugcaguaguuauauaaaauuuuacaaaaguuggaagcagguagacuacaggagucauuaaaagaauguucuccagucuauauaguuugugugauuuuuuuuccccagacuugugacagacuugagauuuuuauuaauagaaauugcuccacugucuacaaaaucauauacucuagaugcuacuuguuaguugacuuucuuugacaaauaauuuauuucuucuuuugaaauaaagcuaauugauuuuguagguuaauaucuguuuucuucuucauaagugauuauauaagauaggcuuucuaaauggcuaauuauuuuaugcauauaugccagaagagaaucaauuuguuuuuugucaacaucuacuaagcaucuguccuguaauauguguuaaucagcuacagauagaaauuuccucuguguuaaaaaaaaaaaaaaaagaagauuaaauaacacuaaaauccagauuguaagugaagaacuuauucauucaacaaauuuuauugagcaccuguaguaagugcuauccuaggcacuggagaacauauucauggacaguuaaaauaauuuauccccaaaacaacccuauaugguagauacuaucauuguuuuuauuuuacagauaaggaaccugagauuccaggaggcuaaaauagagaucacacagcuagaaaauggcagaguugggauuucaacccaggucugcugaacuccaagccuauacuaaauguccuucucucuaguuuauaagauagaugagguaucugcccuugaugaauagccaaguaaugacaacaggguaugugguuuauauagagacaugaagguguaauagaugacacagcagauaagcaccaaaaccagaacuggggaagggaugggagaguuagcuuccaagaaguaaccuuacaggagugaagaguuccaagucgagagucaguauguacagaggcccagagguaagggagaacuugacacacuuuaggaauuaaaagauuuaagaggaggccaggcacagugacucacaccuguaaucccaccacuaugggagcacugagguggguggaucacuugagcucaggaguucaagaccagccugagcaacauggcaaaaccccaucucuacaaaaaauuagccaggcaugauggugcacgucuguagucccagcuacucaggaggcugagacaggaggaucuccugaacucaggaaguacagguugcagugacccaagauggcacuacugcacuccagccugggugacagagugacucugucucaaaagauucagaguagccagauucuagccugagugauauaggaagugaggaaaguuuagguuggaaaaauaaucagaaaugagaugacuugguccugaagguuuaagaugauuggacuucugggguuuuuggugguguuuuuuuguuucguuuuuuacuuuuggcuuuuuucuuuuuuggucagcagacuuuuucuguaaaggucagauaauagcuguuuuaggcauugugagccacauagucuucauugcagauacucaaaucugacuuuuugcuacucaaacgugacagcagccacagacaauacauaagugaauggucauggcuguguuccaguaaaacuuuguuugcagaaacaggugucucgcuauaguuugcugacacuggugcuaaaacaucagggagccauucaagugggaagaguuaugaucaaauugacaucuuagagagauugcuccuguuauauaaaaugggcaaaaaaugguaacuggaaaacuaguuagaagacuguuguaaucauacaaacaaaaauggucauuccuaacccagauuaacagugcugaaggacuuuaagcaccauuaaggcauagcuacuuguucacugcucuagccacagauaaagcacaggugaucaaauauuuguuaagugaaugaaguggaauauguauccuauauauaccuugaauauauaaugaaaauggguucacuuauuuggaagauaauauuugaauuucaaauuaauuugagccacaaaaugaauaguuucaagauauguauauuauauauuuguuaaaaguaagcauaggaucuccaaaccagaaaaaaaauuccauuauuauuuauuuguguacccuuaucaccauuuuuaacuuacauuauuacacaugauuuuuguugucaucauugguuuacagauggcauuacguuauauuugacaaaagcucaacuuuuuguaucuauucuuuuuucuagucccuguguucccaagagaauuacauuauugacaaaaggugagggaauuuuuaacaucuguuuugguaauugucugacugaugcuaauaaaaauuaaaauguccuauuaaaaugccaacagacuccaagacgaggaugccaguaguacccagcagaggcgccagauauuuagguauuggaagcauguuuucaauacaguauugaaaaauuaaagcauuuuuuucuuuacuuuuuguuccccugcauuagcuuuucaagguuuuauuucuaaauuacagaguuaauaaagaugcuucagggagaucuacaaauagccaucaaagcagcacugagaaugaguugaaguacucggaaccacgacccuggagcagcacagauucagacagcucucuucgaaaccugaaaccugcuguaaccaaagccagcagcuucaguggaaucucaguccugacaagaggugauaguucuggaagcagcaaaagcauaggcaggcuuucaaaaacagguauaaauaucuacacaaaacugugcagucaagucauuaguuuuccuaauguugucucagguccuuauuuaucagauggcuucuaauuauccuaaaauauaaaaucacuaucaauaguaccuugaccaccuccggagcacuuaagggguaauauguuucuugacaugaggauucacucucuguccuggacacagauuuacaaccaucaauuaccauaaaaauucuucucuauugugacauaaacuuaauuagguagguucaaugaaacauuaucucuugauugaaugcccauagguaauuggaaauucuuuauuacuuauucguaguugguagaaggcaugguuucucaccuaggauuauuuaacacugauugcauuuucagcuaauacuaucaauuauugauugcauuuuuuaugauaaaguccuucauuuuccauuaaaaaaauuaaauugcugaggagauuuugaggaauuuaaaaaacaaaaacaaguaacuuacaaaugacugaaaauuucaauaaucuccucauucuacuaccugcuuccuuggaguucauuggcucauaacauuucuucuuuucauuuccucuaacuggcuucaauacuaaagaagcucauauguuuuuaggauccuugaagaucuuuauuuuuaucccaaaauaagcgugaaagucaaaaauggguguuucccuguccgggcgcaguggcucaugccuguaaucccaacacuuugggaugccgaggcaggcagaucaccugaggucaggaguucaagaccacccuggccaacauggcaaaaccccaucucuacuaaaaauauuuaaaaaucagcugggcguaauagcacgugucuguagucccagcuguuugggaggcugaggcaggagaaucgcuugaacccaggaggcagaggcugcagugagccgagaucauaccacugcacuccagccugggcaacagagcgagacuccgucucaaaaaaaaaaaaaaaaggaaaagaaaugacuguuucucccuaaccuauuugggugagccuaaacauaagguauuguacacguaagaauugaaggacauauuugaacugaagggcuguaaucagugcuuuaaauuauuaaggcuuaugaauugcaguugucaucuuuuuaauguauaauaugguuguauugaaaauaucuuaguaucuauguuaggauuuugcuaaaaauagguaaauuuuaucaguauaagaagucuacuuguguaccaaauaugcauuauuuggaaaauggccacuuggucaucauaacagaaaaagcuauuuauguaucaugagaaaauuauguagacacacugccaaauuaaaacauuuuaagaauguguacuauauguauucuguauucucuucagagaugaaaagaaauauuaauuggcccuuuuaauaggcaaaaaaugauuuuuguuuuuaauucuuaggguaaauugauacaguuuuuaugaagagucauuuuggcauaacuuaaaauagaagcuguccuucagaaggcaaucuguauaguguaucauaguuguuucauucauuaaagauuaauuauccaucccagagucaauucucuuauucaaaaccuaauuaacuauauacauaagaugcaaaucauuuucuuucuuugucucggccaccuuuuuuagccauuaugcuaaaaaucagugacauuuucagucccuguauaauagaaaauggaauaaauugcagggaugaaggcauuuaaaaaucaguuaucaaauuaguucaguaagaaauaaauuuuaaguuaacaccaguauaaguacuuggaauauauuucaugguaucucugucccuugauuagauaaaauauucaaaguugauuuuacauuuugggaaaaugcuaugcuaguaaaaugagaaauuagauucugcaauuaaauuugacaguuauuugucuuaauacagaauuuaucauuuauuucuuacacugaaucuuucuguguucuuauagauaagggguuucugguauuaaagauuuugggcauuuugcuguacuaaauucuuuuuccugggggaaaauuaucuauauauuccuagguguuaaucuaaaagguaaaauguacauaacuuuguccuuuugggaauguggguaaugugcuuuuuguggcugucuguggcugguguuguuauaaaugugcuuaaauugcaugcuuuggcagugauuucucugacaacuuacguaaucaguuugcuguauuaaacuuguucguuauggggaggguaagcaaacguggacaguaaauuaaaaagagccaaugcuuuuauguaguaacugcauguuaugcaauguaaauuuuauuguuguuuuaaaaaccuguguuuuuuauaugagguuuaaaaaauccauauuuuucauuacuccucuucuagguucugagucuucugguaguguagggucaucuacaggcucucuuucucacauccagcagccucuuccagguacagcucucagccagucuucucauggcgcaccugucgucuauccaacugucagcacucauaguucucuuuccuuugaugguggccuaaaugggcaagucgcaucuccuagcacuagcuucuuuuugcuucccuuggaagcggcaggcauaccaccuggcaguauucugaucaacccacaaacagguugguauccagaaaaagguguuucaggaauuaucugaaaauuuaaggauacuuauuaaauguauuuucugaauauguguagucagcuuuuuauuauucaugaauaauuaacauuuuccaagaacuuuauaacaaaaacacuuaaugcuagggaaguuucaaagacauuuauaucagaaagcauuuuuuuccccuuguacaucugugauaucaucuaugccaaauacuagcccaauuauaauuuuuaaaaaaguuuauuuccuagaaaugagacaacuacccacgaaagagcuuuguuugauauaacaauuuuuuuuaaccaacauugauuuuuuuggaugauacaacaauuuuauacuugggaaaaucggauacauuuuaugaaaaaggacugaauaagcagcuuuuuuucauuauauaauggaggggggaaaaauaauuaucuuucagaauguguugauuuucuacugaggaaaagguaaaggacaucuuauugguaguaaaaaaaaaauuggggggagucauguauuaauauugacaauacauauucuuugcaauuagcuaauaguaauuuacauuuuggagcauuuacuuuuaccauaugcucuguuaggugcuuuaaauauaaccuuguuagguaggugaaauccucauuuacagauaaagaaacugaaccucagagaggugaagaaacugcaguuauaguacauuucacuauguaaauugguaaaaaugauuuauauagaaaaaaugaucuuguaaaagaucacaagaagucuugaucucuucaagauagcauagcccagucauuuggcaagguaaugaaaacucuccuugaucuuuugauaacuuuaaaucucauagauuuagcugauguggucucaucauaauggcaguaguuuacaggcagauacgggugggaguauaaggucucuaaguguuccuggcccuuuccuuucauuuguaguagaaaaaucauggcuugggacucauuacuuucagguuuuauucacaucucuuuuuaagacgaaguaugcaaacauuuguuucucuuauaaguauuaaauuagcauaaauaacugauuuuucagaaauucaauuuuugcuuaguaauuaccuucuuauucuucagguuauuauguuacuaacauuccuguuuuuauccagcaagauguaagaugauuuaauauuuuacuuuuuccuauuauuuuucauucaaaacauaauaugguuuugguaacaugaaagauucauuugcuuaggaagggauagagugagaaacugauuggucugaaauugaauuguacuauuaauuuaaaugaaucaaaaagugaucucugguuuuugacaacaguauuacaauacauuuaacuuuuuuaagaugacccuuaaauuacauuugaccgccuucacccaaaucugcuccaccaauuuuuucuccaaauuauuuagcagucaacaaauacccaggacaacuuguuuuuaguuaucuauaacugucacacaaauuaucaguauacuaauugauuaaaauaauuuuacuuuagaguacuuuuucugcuugauagcuauagacuaguauagucuucucucccaaauauuauguuuugauaucauaaguuuccucaaaaaaaaaaaauggaaagggauuuacuauggaagaacagauguuuuuaagacaauuuaagaaacuguuuuucagucaaauuuuucuguuuguguauuuuucucacucguaaucauugcacaguuacuuuuuauguagucccuucuuguuucuuuuuuuaacaauccaauuuuaguaaagaaaaauacuaaucuuuuaaucuacuuauugaaaaaaugucuggaagacaguaucugaaauguuaacgauaugauuauggggaauuccacaauagcaaagacauggaaucaaccuaaaugcccaucagugauagacuggauaaagaaaaugugguacauauacaccauuaaauacuaugaagccauaaaaaagaauaagaucauguccuucacaggaacacagauggaauuggagaccauuauccuuagcaaacuaacgcaggaacagaaaaccaaauaucacacguucucacuuguaagugggagcuaaaugcugagaacaugugaacacauaagagggaaacaauacacacuggggcuuauuggaagguggagggugggaggaaggagaggaucaggaaaaauaacuaaugggugacaaaauaauuuauauaauaaaccaccauaacacaaguuuaccuguauaacaagccugcacaugugccccugaacuuaaaagugaaaucacacacacacagagauuauggugaauuuauuuucuuuuuugucucuauuuguuauuuucuuaaaacaaauguuacuuuuuguaauaagaaaaaguuguuuagaauguacguguagagaagccaggugcaguggcucacaccaguaaucccagcacuuuaggagaccaaggcggguggaucacgugaggucaggaguucgagaccagccuggccaacauggugaaaccccaucucuacuaaaaauguaaaaauuagccgggcgugguggcaggugccuauaaucccagccagucuggaggcugaggcaggagaauugcuugaacccgggggaggcugagguugcagucagcugagaucgcaccacugcacuccagccugggccgggcaacagagugagacugucucaaaaaaacagaaaagagguuguaaaauaaggacaguaccaucaaguuuacaauuugaaacaugagcuauuaauuauuuuaguuuuucauccaguucuaauuuuauuagugaaauauauguaauguggccuaaaaauuagauauuuccuaccuccuaauaaaaacuaaugaauaacuuuccaauauccugaagucaagcauuuucucuuugaacugaaauauagccuuauaggaccccaauccuguaacugaauuucuuaggcuaaauguguuucgcaauucagaguuuuucaggaaacacuacauauuaugaaauaaggcuaggauuacuuugggaggucaaggcggacggaucaccugaggucaggaguucaagaccagccuggccaaaguagggaaaccccaucucuacgaaaaauacaaauauuagccauguguaaugucacaugccuguaaucccagcuacucgggaggcugaggcaggagaaucauuugaacccaggagacagagguugcacugaggugagauugugccacuguacuccagccugagcaacagagugagacuccgucuaagaaaauaauaauuaauuaauuaauuaaauuaagcucacuagcggucugggccaguaccccauaauaagaaaugcaguaaaacauuugaauauuuaagugagggaaauaaagacuauuaauagccucaugucagagcaggcauuucccaaccuaaggaaaucuuuguuuucaaauauuaggguuuuuuuuuaauugugguuaaaggauuuuggacaugcuuuguaaauuguuaguaaaaggaccuauuuuccaccuguauucuaaguuauuuuuuucccucuuuuugaauuuuucaggucagcccuucauaaacccagaugggaguccaguuguguauaauccuccuaugacucaacaaccaguuagaucccaagugccuggaccuccacagccaccucugccagccccaccucaacaaccagcagcuaaucacauuuucucacaggugcacauauccaugauuacauaaugcuaaguugacuugccuuuacauauuugggacuaaauucgcuaauuauaauugagauagccuaaguaucucuuagaacuuuaauauucugccacuagugauauuccacucacuacucauaggaaaagagauaacuucaaagguuuuuccccugauaaauacugaaaauauguuggaaagaagggaauuguuuuaaucauaugagccugucuggugaguauuuuaucccuauuucacaacagcaagaaauggacaacaggagaaauaaaaacaaaacugugauuguucauuggcccaaugagcaaagugaguuguuuuaagauuccacagauuaagcaguuagaagaaacugagauaggcugcucagguucugcaagguacucuucauccauucuaccuacccuaugaaagacaaagcaguucugaguuagaauucccaaaaguacucucaguaauauuuugaguuuguaaaaauguuuagaauuuacacauucauuuucacauucagucuuuuuccccuacaguuguauuauccaucuuuggggaacuugacuauaccaguaugaacuccuauuuuuauucuaacuuuuuuuuuuuuuuuugagauggagucuugcucugucaccccggcuggagugcagugaagugaucuuggcuuacugcaagcuccgccuccuggguucacaccauucuccugccucagccucccaaguagcugggacuacaggcagccgccaccacgcccggcaaauuuuuuguauuuuuaguagagacuggguuucaccauguuagucaggauggucucgaucuccugaccucgugauccacccgccucggccucccaaagugcugggauuacaggcaugagccaccgcgcccggccuauucuaacuuguaaagauuguuuaacauuaucaaaguuccuguaguuaguuauaccucuuuuucccugcaagacucaguauuccauuggugaaaacaugcagagugauuuuguaugaaagaaguaugaugggccuggcgcguuggcucacaccuguaaucccagcacuuuaggaggccgaggcaggcagaucaccugaggucaggaguucgagcccagccuggcccaaauggugaaacccccgucucuacuaaaaauacaaaaauuagucggguguggugguaugcaccuauagucucagcuacucaggaggcugaggcaggagaaucacuugaacccgggagguugcagugagccgagaucaggccacuccacuccagccuggguaacagagugagacuccaucucaaaaaaaaaaaaaauuaaauaaauaagugaguaucccuuaaaaaaaaaaaaagaagaaguaugaugauaaacuugaacuggagaaauuucauuaauuuugcucacaaaugauaucauuuguauugcaggguugaagaacauacaaguuuaauuacauuauuuaauggugugaaagucauaaaaaauaauuguacuucuggcaauuaagacuccuaauacugggcaaggcaguuuuuuaaaaagaagaacuuacaaguuauggauauacuucuaagaccauagaaaucaguuaauguauguagaagagauugccuaaaacuauuuccacagacucccauauucccuucccaaucccauuugguuacauacaaugagcucgcauaaaacuucuucccuggcuuucucugccuuggcuucagucagcuuggucccaaagaguuuccucuuuauuaugcugucauguaguugucuuugcagugccauguauuuuaccaggagcuuuaaaacacuaauuuucauuugguuucauuuuuauuuaaauuucaguggaaauaauguuaaucuggcaacuuuuaaaaacucugggauuuaucugugauuauauauuucagauuauuaucucuuagaacuuugucugauuuagugauaagagacaguucuaaaugaagauguaggccaccuaguuuagaaacagaugcuuuaaugagcuauaauuggaauucuugggauauucaucaaauuucauaacuuauuuuucuagcauugcuccaaguucagguaaugcaucaucagauccagaaacagagacucaaaagugauucucaaugaauaccuuuugcacaaucugaaauaauuuaucaaugagauugcaaauaaccaaacaaaauaaugcuaugauuuccaaagccuucagaagggcuacuuuucuuagaccuaacguaaaaccaauuacuuuagguggauguuguuuugcagccaguugcaauucaaguaggaaaaggaugugcuaaggcucuuucuucccuaaauggugucagaauuucacuuucaucaaucaaucuucuagcccacaguuuuuuucauuacucucugaaauucgggaagacauuaauucauacccuuggugcucauaguacuuuccuuaaucccccagcugacuaaaacuuuuguuucaucugacacauaggagaucaagucaucugaaaguuaugucuuaaugguuaucugacuuaauaacacaucaaguagcuuguucuugagaguucuaaagcuauggcaccucauguaguauaauauguacuaucaucuguuaggaagcucacuuauuucuagccaugaguuuugugaggaaccagaggcuacuucauagaucuuucagcuuuuacugaaagauuuuuuuaaugcuuuaauuauagauuuuuuugcuuucuuuuaagcuuaucuaagcuuuuguuuuuuagaaaccguuguguugauuuugugguaaaagugcaacucaaaucauuauuaucuaucuaugaugucauagacaaacaaugucuaucuuaguugacauagaaguucucuauuuaaauuauugccugaacaaucuuaauuccauuaguuuaucuaacauuuuuaaaguauugucucugaagacaacaugcagagauauuguucagaaggagaugcaugaauauacauuuuaacuaagaguuuucaucaagugagauucccuggguuccucaucuacuugcuuauguggcugucuacaagucacuuaauuuaccuuagucuaacugccuucuguaaaguggguugcuauagucuuuaagccaauauguauauuaccguuuuuguaauaaacaguauaaauaugagaaaauuaaacagaugcaauuuuaguuuguggaugaccagcuguauucccaagauugaaaagugauuacaacuuuaaaaaaaaaaaaaaaaacaccuguguuugagugccccugggaaacauaaaacccuuuuuuuuccugaaacucaggaguauuucauuaauggccagagauuuuaaguaacuaguuucucagcuccuaacauguacuaucuuaauagaaauguguuaauuacaaagaaaguguuuaucuuccuuauauaaaagagguguuugugugugugugcaugugucuguauguauauauguguuuguuguuccuuaggcuauuauucuuaauaguucccaccauauauauauauuuggguuuuuuuuuuuuuuuuuagacggagucucccucuggcgcccaggcuggagugcaguggcgcgaccucggcucacugcaagcuccgccucuuggauucacgccauucuccugucucagccucccgaguagcugggcuacaggcgcccgccaccaugcccggcuaauuuuuuguauuuuuuaguagagacgggguuucaccauguuagccaggauggucucaaucuccugaccucgugauccgcccgccucggccucccaaagugcugggauauauuuuuuuacccagagcuuuuuucuuauaaaauugcuaaaaguuaggggcuuuggucccaaaagacugcuuaauuucaccuuaucaguaggguaauuggaauaguuauuguguaaguuauuacugucugauaguaagaaugaaguuuuucauuuauaauuuaguguuauacugcaaaauagggcaacccuuucauaaaaccaggaaauaaugagaaguaguuuugcuuuuacugacuuaacccgggggucuuuguuaaauaauaggauucaaaaugccuaagucaccuguucccguuaaucuauaauaaagaaauauuuuauugcaaaaaauuauucuccuaauuauguaauaaauucaggcguacauguuuuugaaaguuuuacuguauuagaguugcuucacuuuguauuguuuuuguuguuuccuauguuguuauauuuuaaaugacuuuauaaauguaguuaaagcuauugccaaaaaaguguaaauuuccguuuuaugcaauucuucuaacguuuuauucugacauuaacauuguuugccaaccuguuauucuuuagccuguucauccucugcaguccucuucacagccuguucaguacucuacagccccuuacccauccccguuccugccagucucacccacccagcaauacucugugguacuauaucucuauucaccuccugcguuguuucuguggguggaugugugaugaaugcucaagagugucauuaauguaauaugaucuuuugugauuuuuuuugggucagguuuacauauguaucuaaacaaaguauuucuaauucauacuagaaauaauuuauuccauaaaauauugguuauaguggcuuauuauggugauuguuuaaccuuuuccugcuuuuucauaacgaaagaauuuucagguugauuauucuaguccuaagauguuuuagcaacuuucucauugaggccacugcaggaucugugcugcccugggauggcagcuuucaucuggguuuaggcauucuauuuucuccccaacacuguagcuccaguagacccaguaccaguucuuagggugaguuguagcuuacagcuacagaggacuucuaaguauauuuucuaagaagauuucuggauauuuaaucugugacuguaaaguaaugauacuuucuucuauccaaaguaugccccaauuuuuauuggaauaagaaaaugacuuuuuuccaaggugacucugagagugguauacaauuaugguacuucuguuaacaauauuugaucauauaacauugaaauuacaguucauagguacauuuuuuuuccuuuugacaccauucacugaauuaggcuaauaguguuaaagugucaaagugacaguuggggaagagaaaaaccauauauuuucaaucauuaaaucaggcaucuccuuucaguccuuuaucuucuccauagccguaauuuacuuuggaaaauccagcagaucuagaaacugcagacaugucaacuuugauaugaugacucaauugccacaauuuuguaagucauuuuuuucaguguugaccuuuuaacaaaaugugguauauuuuauugccagucugugguuucuugggaacagggagcauuuuaacccuauauaaucauuucagugauauuuuucuggaacaauaagagcugguccuuauccuguugaauuagagaaauguuugucagauagcacauaaaucauaacccuugucuugguagggcaccauuuaguaaaagcauaggaaacugucauuugaauuacauuugucaaauuaucugacuuccagaacagauugaaaaacacaagggaagaauggaauguauggccaaauuauuuuugaaagauuagagaaaggacuguaguggauuuuauguauuuaauuucugcaaauaauuuucgugguuagggauacaaaaaugcauagaauuugcauuuugccuucuaggaagaggggagauaguuuaaagcaaauacuaauuaguaccuugcucauugcuuggucuuugaaguccuuucagaaaauauuaauuguauaauaugaacuuggccaauuucacuucuacauucuaauguugcuuucaucuucauuuaaauaaaugucuucauuuuuuaaugugaaauguuguacccuacucuuuucugcaugcugugcauucccacuagauauauuuuuuaaauaauuuauaauuuauaauauucaacaauagaguugucauuuuuuugaagcuuuacccuauuacauaauugcuguuguugauauauauaauuuccauaauguguacuauugcaucuuauuuaaaaauaggaaguauuuuucuuugauaaguuuggccuauguguagaaggcuuacuaauuuuugacuucuuccuuuuuuagcaggauaaccuagggucucaguuuagccacaugagucuugcucgccagccaucugcugaugguucugacccucaugccgccauguuccaguccacugugguucuucagucuccacagcagucugguuauaucaugacagcagccccuccaccacauccuccuccaccgccaccaccaccaccuccuccuccuccccuaccaccugggcagccagucccuacugcuggauauccugccucuggucauccugucagccagccugugcuccagcagcagggauauauucagcagccaucaccacagguauauugcuuuuuaaccuuuucuuucuuguggaaaccucucacuuaagaucaguuuuaacuucaaagaacuuauuuuuaaauucucaugaagagaauuugugagaguauauaaacaaagcauauacucaucuuuccgccucuggagauuuucacgcacaugcuaagcaaccauaugacagguaaaugcuccaguugguugguaaaguaugugagcuuugagggguuuuuuuucugagagguauggguuucuaaaaaacuaaccuaagggaaacacaauaaaguguaaauccacuguaaaaguaaaaugguaagacugggcacaguggcucacgccuguaaucccagcacuuugugaggcugaggcugacucacaaggcugggcuugagccuaggaguuggagaccagccugggcaauguagcgaaacuuuugaauauuuaacuaacuuuuaauuucugaaacagaccccacuugguuaugauguaguauccuucuuauauauugugggauucaguuugcuaauauuuguuaaagauuuuugcaucuauguucaugaaggauauuggucugcaguuugcuuguaauauuuuugguuguacuauccggaugguaguagccuuaaaaugaguugggcauuguucccuccuccuuuauuuucugaugguguuuauguaggauugauguuauuucuucucgcauguuugccagaauucaccaaugaauucaucuaaagcuguagauuuuuugcagggaagguuuuuaaauuacaaauuuaauuucuuaguagauauaaaaugauuccaguucucuuuuucucuuuggacuaaauuucauacuuuguuuccguuucauguuucaaauuuguugucauaaaauuguucuuaauauccccuuaugcuuuuaauguuuuuaggaucuuagugguauccccuuuuuauuucuugguauugguaauuuugcucucucuuuuuuguuuuuuauuaauuuagccaguugauuuaucaagucuuuugauguucuuaaaaaaaaaaaaaaacacgggccaaacaugguggcuuacacuugcauucccagcccuuugggaggcugaggcaggcgaaucacuugaggucaggaguucgugaccagccuggccaacaugaugaaaccccuucucuacugaaaauacaaaaauuagcugggcgugguggugcacgccuguaaucccaacuacuggagaggcugaggcaggagaaucacuugaaccuggcacaugcagcuugcagugagcugagauugagccacugcacuccagucugggcaacagagcaagacuccaucucaaaaaagaacaaagguuucauuaauuuuuaugauuuuauuuucagugauuuuagauuuuucuucuaauagaaguuuuuaaugcuauaaauuucuuuuuuucuuuuuuuuuaaugcugcaaauuucuaagcaccauuuuggugcuauccacaaauuuggauauguaguauguuaguuauuauuuaguuuaaaauguuuucucuuuugagaggauuuuuuaugacccaugacuuacuuagaaguauguuauuuaauuuccaaauacguaggggcuuucuaaauaccuuuuguuauugauuucuguuuuaauuacauguggucagagagcuuacucuuuuaagauuucaguguuuugggccggacacaguggcuuaugccuguaaucccaaauggugaaaccccaucucuaauaaaaauacaaaaauuagcugggugugguggugcgcacauguaauccuagcuacucgguagcgugaggcaggagaauuauuugaacccaguaggcggagguugcagugagccgagaauuuguguucuaauauuuuagcguuaugugguuuuuuguucaggguucuuuuguggggcagggcauuuugauuuuuuuauugaaauucacauaauauaaaauuaaucauuuaaccauuuuuaugugaacauuuuaguugcauuuaguacauauucacaguguuguacaaccaccacuucuguuugguuccaaaacauuuucaucacucuaaaaggaaaccccauaucuguuaggcaguugcuacuuguuccuccauuucccagccccuggcaaccaccaaucugcuucugucuccuaugguuuuaccuauucugaauacuucauauuaauggaaucaggcaacauguuaccuuuugugucugacuucauucauuuaacauaauauuuucaaaguugauccacaucguagcauaggcacacacacacacaaacacacacacacaguggcacacuauucauacuuaaaauguauucacacuuaaaaaucuguucacacuauucauucuuucccuuuuuauccauuaauugaaauuuggaauguuuucuuuuguuguuguuguuguuguuguuguuguuguuguuguuguugagacagagucucuuuguugcccaggcuggaaugcaguggugcaaucucagcucacugcaaccuccgccugccauguucaagcaauucuccugccucagccccccgaguagcugggauuacaggcgugagccaccaugcccaacuaauuuuuguauuuuuaguagagacgggguuucaccauguuggccaggcuggucucaaacuccugaccgcaagugauccucccgccucggccucccaaagugcugggauuacaggcaugagccaccgcaccuggccaaaauuuggaauguuuucaucuuuuguuucuguaaauagugcuguuuugaauauguagguacauguauuuuuuuaauaucucuuuucaguuuuuuggaguauguguguauauaaaguguguguguguguguguguguguguguguguguguguguuugucuuuuuguuauugagcuaagaguucuuuauguauucuggauacuagacccuugucagauaagugauaugcaauuauuuucacucauucuguaaaauugucuuuuuaguuucuuaauaauguucuuugauggacaaaaguuuuuuaauuuugguaaaguucacuuuauccauuuuuucuuuuauugcuugugcuuuuggugucauaucuaagaauugguuguccugucuuuuaagugcuuuauguuuuuagcuccuaggucauuuauccauuuugaguuaauuuuugaauauuggcgugaggcaagaguucaucuucauucuuuuucaaguauauaucuaguaauucuagcauuauuuguugaagauacuuuucuuuccccauuaaauaaccuuggaauccuugucgaauauccuuugaccauaaauguaaggguuuuuuccugggcucucaccuuaccccauuauguauuucuguccuuuugccaguacuacauuguuuugauugcuguggcuuuguaguaacuuuuaaaaaugggaagagugaguacuccuacucuguucuuuuucuuuuucuuuuuuuuguuuuuguuguuguuguuguuguuguuguuguuuuugagauggagucuugcucugucacccaggcuggagugcaguggcgcgaucucggcucacugcaagcuccgccucccagguucacgccauucuccugccucagccucccgaguagcugggacuacaggugcccgccaccacgcccggcuaauuuuuuguauuuuuaguagagacgggguuucacgguagucucgaucuccugaccucgugauccgcccgccucggccucccaaagugcugggauuacagaugugagccaccgcaccuggccuacucuguucuuuuucaaaauuguuuuuaguauuuaggcuccuugcaauuccauaugauuugagaaugggcuuuucuguuucugcaaaaaaagaccuuuggaguguugauagguauugcguggaauauguaggucucuuugauauuauugccauguuaacaauacuaaguuuuccagucuuaaaugagcaugggauguuuuuucguuuacucuggucaucauugauuucauauucuauuguuuugggauuuguccaucucccuuuuaaguucuaucaguuuuuuauaguauuugaagcuauauuaaacaauuuauauuuaucaugucuuccugauauauugacucauacauacauuuuucucugucucuaauaguauuucuugaaaccuauuuuaucugacauuauagugucauucuuuugaguaacauuuaaaugguagaucuuuuucuaucuuacuugcaaccccuauauuuaaagugucuuucauuuaugguuauuaguuggguucugccucuuuauacagugauuggagugucauuagacccuuuaaauuuaauauauuuuugacaugguaugccaugucauaccagauucagguaugccacauugcuauuuuuuuauuugcccuaucuguauuuuauucuacuuuccugcauuuuauauuauuugaacuuuuuuuuuuuauaauauugaaugcuuuacgaauuuccgugucauccuugugcaggggccaugcuaaucuucucuguauuguuccaauuuugucuuuuuagguacauccccuugaauuuucugaauauguguguuuuucuagggaauguguuacguaccuuuaccuuaucaaaaucuacuucaaguuaauauugaaauuucaaguaaaauguagcagccuuauaacaguauaauuccauuuacauucucuccguccuuuugcuguuguugccauauacauugcaucucuauauauuauauaccaaaaauaguguuaauaauuuuugccuuaaaagagauauuggcagccgggcacaguggcucacgccuguaaucccagcacuuugggaggccgaggcacgcagaucacuugaggucaggaguucaagaccagccuggccaacguggcgaaaccccaucucuacuaaaaauacaaaaaaaaaauuagccggaccugguggugggugccuauaaucccagcugccuugggaggcugaggcacaagaauugcuugaacccgggcagcagagguugcagugagcugagaucgugccacugcacuucugggccacagagcaagauuccaucucaauuaaaaaaagagagagagauauuggcuaggcacaguggcucaagcuuguaauccuagcacuuugggaggcugagauguacggaucacuugaggucaggaguucgaaaccagccuggccaacauggugaaaucccaucucuacuaaaaauaccaaaaaaaaaaaauuagccaggugugguggcgggcaccuguaaucccagcuacucgggagacugaggcaggauaauugcuugaaccuggaagguggagguugcaguaagcugagauugcgccacuucacuccagccugggagacagagcaauacucugucucaaaaaaaaaaaaaaaagauacguuuuuuaauuaaaggaaaauaccuaaacucaggauuuagauuacuuucugauaccuccaggaacaguuaagggaucccauauguauugugucuauguuaaugcuucaaagacaggagaucuacgguaaacuugagugauucuuggcuaaaaacuaaccuaggaauauuaugccuggcugguuuucagaugagaugagcacucuuuaaaaucuccacagaucucuguucuuuuuacagauaacccaaucagaagagcagaaugugagugagcccaugacacuguuaaaguuaacuuacccacauacuucuguaauacuggauuagguauuuauucuucaccccaaacuaggucagauuaagagaacuucauuacuaauacuaauagcucuggaaggaaaaauaaaucaagauggucuugauggcauuuuaauuugcauuagaaauauggucaugcaucauuuaaugauagagauacauucugagaaauuuaucucuaguggguuuugucauugugugaaugucacaaaguguauuuacacacaccuugaugguguagcccucuacacaccuagguuauaugguauagccuacaagcuacaaaccuaugcaacauguuacuguacuaaauacuguaggcaauuauaucacaaugguaaguauuugugcaucuaaauauauguaaacauagaaaagguacaguaaaaauaugauauaaaaguuuugugguuuuuuguuuuguuuuuuucuuuuuugagacggagucucgcucugccgccaggcuggaguucagugguaugaucucagcucaccacaacuuccgccucccugguucaagugauucuucugccucagccccccgaguaccugagacuacaaggcgcgugccaccaugcccggcuaauuuuuuguaucuuuaguagagacaggguuucacuuugcuggccaggcugaucucaaacuccugaccucgugaucugcccgccucagccuucagaagugcuggaauuaacaggugugagcaacugugcccggccaaaagauuuuuuuaaauggaacaccgauauagugcacuuaaccauguaugcagcuugcaggacuguaaguuguucuaggugaaucagugaaugugaaggccugggacauuuuacuacuguagacuucauaaacacucuuaaauuaggcuacaccuaauuuauuucauacauuuuucuuucuucaguaauuaaccuuagcuuacaguaacuuuauaaacuuuuuaauucuuuucacuuuuuuauucuuauguaauaaaacagcuuaaaacacaaauacaccauacagcucuacaaaaauauuuucuuuauauccuuauucuaaagucuucuuuuaugaauuuuuaaauuuucuuucuuuuuaauuuuuuuuaauuaaaaacuaaggugcaaacaugcauauuagccuaggccuacgcauuucaggaucaucagcaucauugucuuccaccuccacaucuugucccucuagaaggucuucagaggcaguaacacacguggagcugucgucuccuauguggagcugucaucuccuaugauaacaaugccuucuucugaaauaccuccugaaagaccuaccugagucuguguguguguguguguguguguguguguguguguguguuugguuuggaguuguucuuuguuuuuugagacagagucucacuuugucacccaggcuggaaugcaauggcacgaucuuggcucacugaagccucgaccucccagauucaagcaauucucccaccucagccccccaaguagcugggacuacagacacgcacaucacaccuggcuaauuuuuguauuuuuuguagagauaggguuucaccaugucgcccaggcuggucuugaacuccugagcucaagugauccacccaccugagccuccccagagugcuaggaucacaggugugagccccugccccuggcccugaaucuguuuugcaguuuuuaauaaguagcaggacuacauucuuuuuuuuuuuuuaagacaggcucuugccucugucacucaggcuggagugcaguggugcaaucacugcucacugcagcugugaccuccuggguucaaguaauccccaaucucagccccugaguauacaggacuacaggcgugugcaccuccacaccuagcuaauuuuuuaauuuucaguagugauagggucucacuauguggcccagucagaucucaaacuccugggcucaagcgauccucccgccucagccucccaaagugcugggaguacaggcgucagcugccauacccagcccagaaggacuacauucugaaauaauaguuaaaaauauuguaaauacauaaaccaauaacagccauuuauuaucauuaccaagucuuauuuauauacugucugcuauacuuuuaaacaacugcuagcacaguaggacuacagacaugugagugauguauugugcuaugacaucacugggugauaggaauuuuucaacuccuuuauaaucuuagggggccaccaucauauaugcaaucuaucauugaccaaaaugucacuuugugauacaugacuguaugagaaaaauuaaagaauggaaccaguauaacugugcauuaaugugggaguggauaaaguaguuuauacaaugaauguuguuuagcaguuaaauugaaugagcuagcuguauauguuucaauaaagaaagaugucucaaaaacaacaugaauugcaaaaugaauuucaugaaguuauauguaguugaguuucccguauuugaaaagccugggaccagaaguuucaguuuuuugguuuuuuuugggggggauuuuggaauauuugcauauauacaaugagauaucuugggauagggcccaaagucuaaaaccaaguucacuucuguuucauauacaucuuauacacauagccuuaagguaauauaagccauauuuuaaauaauuucaugcaugauguaaaguuuugacuguaaccugucacaugaggucagguguggaguuucuuuuugaguacugacaugacaugaugcuuuuggcaucauguugguacucagaaaguuaaagauuuuggagcauuucagauuuuggacauuuggauuuuuaaaauacucgcccaggcucaguggcucaugccuguaaucccagcacuuugggaggcugaagugggcggaucaguugaggucaggaguuugagaccagccuggccaacguggugaaaccccaucucuacugaaaauacaaaaauuagcugggcaugguggcacaugccuguaaucucagcuacuugggaggcugaggcaggagaaucauuugaaccugggaggcagagguugcagugagccaagauggcagcacuacacuccaaccugggcgacagaaugagacuccaccucaaaaaaaaaaaaaaccuaaaaauaaauaaaauaauacauguauggauaauagauauauaguaaauagauauauacuguauaguaaaaucaccaacuacagaauaauggcuucuauggaaguuagaguaaaggaaauagggugagucuuuagcuaauucaguaguguuugguuuuguaagagagagagcugaagcaaauauggcaaaaaaauuaaaaucuaaauaugauugaugacacauuaguuauauuuuuaugcauacuuuguuugaauuuuuuuuaaauuucaguuaaauuuaagaaaaaucaguuuuccaaugauuagugcuaaaaagaauuauuacucauuaaacucugaucuuccucacagaaaaacauauguaaugcaaguaaaauugauuuuuucccgcaauauuuaugauccuagaugccagccuguuauugcgcuccaggccacuaucacuccagccaaccucaguaucgcccagucccuucuguucauuacaauucacaucuaaaccaaccacugccacaaccugcgcagcagacaggugaguuguguuucuuaugucauaacuucugagccacacuuuuuuccaucuucuauuucaguguugcucuuaagauaguaccuacucagucucucaggaucucgaauauguucauacauaugaguuugcaaaccaaugagauuaaaagagugagcaaaucuuagcauccucuggaaaauaccacagugucacgucuacaugcuaaaggguugggagcuguacugggaauaucuuaagcaguuuguuaaguggcugccaucucuuacugccauugagauugaaacugucuuugcagccugauaaaucaccuaugguaacagcaaaagagaggcaaggcgaggcaaggugacuuaugaauggcuaaccagaagcaaagaucaaaaccaccuaacuuggauugagaacccuagucuagggaugauauuuugaucucuuaguaggcaugccuuuaaaagaaaugauguacuuagcauauuuucuguguuuugcuuuucaguuuauugauugauagugaaaaguauuuuuaaaccaaauacaaucuaaggccacuuaaaugaaauuuauuaaaacucagcauuguuuuuguuuuagcacuuugcagauuuucuucaagcauucagugaaaacaauuuugaucucaguguauaaaacuaucuuauugauuuuuuaaugaacucauuucucuguaugcuucucaccuagauguguacuucccagauguuuaauaagguauuuauucagccuuuuauaacucuaggaguugaaguggaauuuuaucauugguuucuuuagagcuuucuuaacugcuuaucacuauuggaggcucccugacuaugugagugugacucacugaggaacccauaaccuccaccuccacugaggcuguuuacugcucuugauauugugugaaacucgucaggguuaccaccaguuuaggagaagcaucucugcacuggcccaucugaugaauaguagucauacuucucuuuauuguugcagucuucagugaucaugauucacuaacuuucugugcuagauauaguucaugcuuagcauagccaugcaggauaacuuccagguccuuaaucuguuacccuuaggaguugucucguuguuaguuuacagguucuccccuuuuuaguauguuacuagccuuguauuguacaugugacaaauguucuuccaaagaacauugaauacaaacauuggucauuuuagccaaguuagaauuuuaguuccaagcuaccuaaaauuuaauaacacaguccacgucaaauaauguaaacuaguauaugauauaauuucaaaagguaucaaaaguuauucucuauucgugggaacauugguugugguacugcucauuagcuuuauauacacugguguuuuauucagaaacaauuuucugaauuuuucuggaccucaaguaauagaauuuucauauuguuuuuucuugauuuuuuucuuccaaaauuauaacacagacuguagcugaugccauaauaaagaaauguaccuucaugcuacucauuuaaauauccuugcgugugacuaauuaacuuaauucauuaguacacucuauuaauaaggcaagcaaaaauccuuuguucuguguuuguguuagcuuacuaauuuuguucuucaacauggcaaaauuuuuaucccuguccauggucaaacugccuauaaaaucacuuucaaucacagguugggacuagugugcuaguauauaugccucucugccaaaaaaaaaaaaaaaaaaaaauaugacacuuaauagaauucaacuaaauaugccugauuggaggugaaaacaucuaugugacagauagcauguguuuaucauuggucauauuuuuaacuaugggguuuucucugaugcuaguuaugaugagaaggaggaaacaauaaaucagguugcaucuggauagugcuacaggcacaaaaaagagaaucaugucuuugaaaaauguuugacauuguguuugacucuuaugagucagucauaauauaacacuuuauaaaagcuagacuuguccuuucagcuguuuuauauaguauccucuuaacuuacagcuuaaguuaguugacucauucaguuugaagaauaaaaggaauaaauccucaaagcauucuuaucuaaaagagaaaggaauuuuguuaugcuaauaaguaucauagaaaauuuuccuuuaaagaaaaguucagcagggccagugccaacuguuguguugguaauuguauugaaccuuuucauagaauuaguggggauuugaacucuuuuuuaaaaguuauaaucuaaagacuuuuuuauaguuagcucaucauuaauuuuuaugucaaaacuugcagaaggccaggcacgguggcucacaccuguaaucccaccacucugggaggccaaggcggguggaucaccugaggucaggaauuucagaccagccuggccaacauugugaaacccugugucuacuuuaaaaauacacaaaaaaaauuagccgggcaugguggcgcacaccuguaauaccagcuacucgggaggcugaggcaggagaaucguuugaaccuaggaggcggagguuccagugagcugagauggcgccacugcacuccagccugggcaacagagugagacugucucaaaaaaaaaaaaaaaaaacuuaacagaaaagugugcauuuauguuuguaugugcccuaguguagaaaaguaaaauguacugggaaauuaacaugauaguuuauuguuuuugaguuuuuuuacagguauauagcaauuacugucucauaauuuacauuuuuauauggaaacauacuucuggguuuccuuuugguuuuuauuuucuuaccucucuacauucuacuaucccaaucugauuaaaaaugagaaauacuuuuucauaucucuuauauuuguauuucuugucaaacaacacuugcuuaccccacagugucaagaagcauguuuuuuuuuaauuacauaaaagggugaaacuaauuauucaaccaaauaaugaaaacacuaguagacuuggagcaauuuuuuuucacuguggcacaaguaauguuuaaaaguuuguauuugaacuuaaagaaauuuugcccuaaauuaacaagcccaacugagcaaaguauuuuuagaccagauaggguaugggcaguagaaauacaggaucuuucauuauuuuuccuuugguggauagggaggaggauggggaaauaucucaaggauaaaaugcucuaggucuuuuauccaugugucccaguggaccacaacugaaaucaggacuaacauuacugcuggggaaaugaauguacuagucuuuuguuaugaaugugaaacuacugaacuguucauucaaaacaagguugaguaaaccccugucaacagaaacagaagaaacccuggcuacacacauaagacuuucugaacaaugcacuguauaaugggaaagaacaacaaaauaaaagucagaauccugauggcccuuagucauuuguaacugguguuaggcauaucacuuaaagccacugaguuucaguuggacucauuugcaaaguauggaauuuuuacuguguugucuguugaagccucuguguacuguaaaacuccauaauucuuugugucucaugugagucauuucuaguucuaaaagguagaauaauagagaauugguuuguaacagcuuggcaaccaacugucaauaacuggagucaaugaaagcaacuauuucaaaagaucagauuacuuaccaguuucacuaauaaagauuuauuacuuuaaaccuuuaucauaaaauguaugcuuugaauacugugaaguacacugcauauaaggagugugguauaguauaaagaaacuuucugcagguaguaauuauagugaagauuuuagguuuacaaagcccuagcuguuuucuguguagcuuuuauuauucuuaugacucuugacaaguuuguagcuucaccauauacauuuaauauuuugcaauaauuggccuuguuccugagcuguuggauucggggccguagcacugucugagagguuuacauuucucacagugaaccggucucuuuuucagcugcuuccuggcuucuuuuuacucagguuuccacugcuuuuuugcuuuuuuuaaugcuguaugaagguguuaacauuuguuuauauuuuucauuaauuguaauaccuuuaaaucaugcaucauacucagaaauagggauuagaauuuaagugacaucuuuggccuaauauaauuuaccuguuaaaaauuugugaaagcuauugcuuauuucuuuuccaaaguagauuuggaugacaaauucaguuugguuuugagcuuaucuaaaaagcuuaauguuuuaagcauaccaaacucauuagcagaagucaaauaugucucucccuauugcuacacaacuuuuuagggauauuguuauauaugaaagcaugacaucaaacggaccuaauacaccuaaaugcauuugaagcuacuuggucucgguucuuaccaacgauauaauuuaauuuuuuuuuccaaacgaugauguuguugcauaccuguggaaagcaaaaugauucugugaaacuauacuuuuaguuuugcaaccauuugauaacuucaaagauuaucaauguauuauaucuuuagucuuagcuuuccagauaacccagaaucauaugguuccaaguugauuaagcuuuguuaccagcagacuaugguaggauccugaugaacgacacuauggaagaaacuuguuaggauaaacagucuucaaugugugcauauuguugacagaauuugaaggcacaaauuuaagaguaacuaggguguaaaaggcgagcaaagaaaagucagcacuacuggguaagcaggugagggggcuuauugauaggagagucggcuaugucaaauagggacucaaggcacaaagucaauuucuuuacugacaacuuucaauccaaguaauaggaauuuuguauuuguaaauuacuagguaguggcucuggcuauucuuguuuuuucauugauuucugugagcauuucuuaguauguauugugugauucagcauagauucagacauuguauaauaccuacaaauccaccuauuucccuuuucccuucuccauuaaccugccgccacugaaaucuggagccaaauauaucugguaaguacccacagauuuccuugaguuguauagacucuuccauggaauaguucuuuaaauagcugugagcaauaaacucugugugacuguuuuuguuagaauugguuuuuguauauguauauguuuauuucaggcacaggagugagagaagaggggaugagagaugagaagggauaaucaagugugauggcaauugcaucuccuuccaaauacacccauggggcuggcuuuaguugaacuugcccaccuacuaaaauagugccacagacagaagcccaagauuauaagcuugagguuuuaacaauuuggucuuguagaugccuaguuacaaauaaauuuggcuuuaguaaaauggcucaucuuuaaaaaaaaaaaaaaagaaaacuaccuucacagugcuucuauuguacaagcacagucuggaaaaaaaauuaauagguacuauuaagugaaauaaccuuagauucauggguauucuaagcauuucuuuaauacuuuuuguaauuuuucugauuauuucuguguuauuaagaaugcuuuccuuuagaacaaaugcuaguucagaucaccuauauaaaauaaaaucagccuguuaaugccuguucaauacuuuugugcugagcacugcauuuccuuccugcucucuucuugguuaaagugagaguuaaaaauagaacauucuguggagcccuccagggaaguuccugaaccaucaguuuauauuguccuaguucucuuagcuugcagaauugauugugcuuuccucugaaagugcugaaagaaaugggauaauauugcaacagugcaguccuuuaacaaaacagaaugguaguguuuuaaaaaaaaaaaucuauguugagaucuggauauuuauuuuguuguuugguaucacuuacuauuggcauuucuuacuuuacaaaauagaggcuuucccacaauauugacguaaauuccuauaaaagauauaguguuuuccucuacuuuccagauuaaauucagauguaucacaggaagaauuuuuuuuaauucuaauauacuaaaauauacuuuuuagugaagaaagaauaauuuaugugguagccaaguuggagucgggauacuggaaauacucuucuuguagcauuuuugaaaccuguugauacuuuucauucucuagaaaucuacuucuccuuccuaauccucagccuucucccucuuuuccagaucauuggauuuuucuuucucaaacuuggcagucuucaaacuauacuuuugacacuaugagaacucuguacccacucuugcuuuugucugaauaauuagacaaggaaccuaaccuacaaugccacuucucuaggugucacucuguaacgguucaugcccagcagucugaaauuucuuuguuuaaacaaaaguucagaggaauucaugagcaacuugaacaguucaagauguaaauuuuauuaagcaaauguacauaaugugaggcauaccuguaauuaaaugauccuuuauuuuauguuaacaauuauuuuauuaaugauuuugucuuacauaggcaagaguaagguucuuaucuuugauuggauuaggagaaugaugugggcuuuuuuguuuuuagugcuuuccagcugaguauuucuaguuuugcuugugauuauaguaauuuuaaccaacauagaucccaguuuuauuuucuuuuucauuggaacaaauguuagccuguuaaugccuguugaguacuuuucugcuaagcacugcauuagaaaaagaccaauaaucuuuuaguaaucuuuaauguucugcucuuuagagaauauaauucaaaauuauauacuuuuuagccaguugcuguguuguauguuauaauuauuagaaugagugauaaaacauuucaucaugauuucuggaaaaaacauucauauuccuguccuaaugccagucgaauuucccuucugggguaccgaucauucugagcaucaaauguuaaaugacaauuuuaguuguguuaguuuagaacaguucuucagacccugauggcuuucuacccaguguaguuuaaaccuggugaauuuuccugccuuggauguaaaaaugaaugaaaugcuacucaguggauggaaaaaagucauugcuucacagaacuucaagacuucgcccauaaaacguagcagcucuccuugcacaaaauguguccagguuaaagcuggcacugcccugcugaguaaagucugacuucuuggcaaagcagccugacuuuguggagaagacagccaguaucuaugaaaacucugcuagacuaaucuuguauagacucaucuggaauguggcaacagacuuuuugagcaaaagcagccuccgaggcaaaacagcaaaacuaaagcccaaagggaacauuggagauucacuuggaaauacucaggcugagagacagaacugugggauguggaaccugaaauagugucacuauuugagccaguucuucuccuucccaauugucuuuuguuauguuuuaauauuuuuagagauggagucucacuguuuugccuagacuggagugcaguggcccuuccuaauuguuuaauacaauuuaugcguauaaucuaauuauaguaaggcaaggaaguguaacuuugaaauacaucaguaguaaaccacgcaucuugcggguaguggacaaaccaagggaaggacuguuccucccacagagaggacauugugggcuaaucauaugcuuauuuacaccugcucuuuuuuaaagcccccaaguucauguggcuaccaucugaacuaacuacccaaaaauuuucacucugauuccuauuuugaauaacaugcuuauacucaccaauaaaucuuuaguucaaaugaacgaaaaguuuccuuguugauugacauuauuuccaguaauuaucuguuuuccuguaauuaaguuuaucuugagacuuagguauguuaagcuacaguaaagucuucauuaaccaaaauuaucagaaaaugaagcaaggccagguucugcuuauuugaacaauauuacuguaauacuuuuucuucuucaacauguguuccucaaaaaaguaaauuuuagaaucagacagcugugugcagcucucagcuacacauuugauagcuguugaucauagagaagguaugaaccucucugugccuuuuguuuccucagcugaaaaacagggauaauaauuguaucuauuucauaagauugugaacacuaaaugaguuaacauauguaaaguacucagaacagugccugaaacuuaauaaauaucauuugaggcuuagguauuaagauuagcuugugugacugggcgcaguggcucaccccuguaaucccagcacuucgggagacugaggugguccaaucaccuggugucaggaguucaagaccagccuggccaacauggugaaaccccaucucuauuaaauauacaaauauuagcuggguaugcuggcacgcaccuguaaucccagcuccuugggcaagagaagcacuugaacccaggggguugagguggccauaagccgagauugcaccgcugcacuccagccugggcgacagagcagacagagcaagacucagucucaaaaaaaaaaaaaaaaaaaaccaacaaaaaagauuagcuugugguaucauugaagcaaagauaauuauauuuuaaaugaaaauuuaaauuuaaaaugaaaauauaauuuuaaauuauauuuuaagugaaaagacagggauuuggggccaaauucuagagcagacacaggaagcugacagaguuugcucuaaaauguuuauauuuuuuguccuuuuagcuacucaacacaugccuucauccugaaaguacaguaaagaucaguugaguuguuugauguuaaacuugaggucuaaauauguuuugaagaaaauuacuuaaauacuuucuucccauacauuguacaauuucuauugauaagauguggaagcauuauaugaaaaaagauuuugaaauagucugugucauauaaccccauuucuauaaauaaugaaaaugaauauauauguugcccucugcauggaaaauuaggcuagccacauauaaaaauguaaauggggaguaucuauaagugauuauuuucccauauagacuuuuucuauguuuguauuuuuuuccaaauuuucuacuauaaaagucuuuuuuaugcucuauaagguuuuuauaaaagauauuaagucuacauuuuuaaaaauauucaggccaggugccguggcacaccccuauaaucucagcacuuugggaggccaacaggggcgguucacucugagcucaggaguucaagaccagccugggcaacauggcgaaacccugaaucuacuaaaaauacaaaaauuagcuaggugagguggcgcgcaccugcaauuccaguuacucaggaggcuaaaacaggagagucguuugacccaggaggcagaguuugcagugaggugagauugcgccacugcauucuguccugggcgauaggguaggacucugucucaaaaaauaauaguaaguaaauaaauuaaaaguaaaaauauucaaauaauaccuucauuacaaacuuuacauacuagauauaaaguuaaacaguuuguauucuuucuuugaguucuuccuaagcacuuugaggcuaacuauauggaaucugugauuuagcugcuguacaguuuucuaggagagacuuaaugagugaucuagaaauuccagucugaugugauuuguauucgugggagugucauuuuaaugaaaaggugauuaaauguguuuaaucuuguaaaccaguguuacguuaaaauuuauuuuuuuaauuuuaauuuuaauuuuuuuaagauggaguuucgcucuugucgcccaggcuggagugcaauggcgcgaucucagcucacugcaaccucugccuccuagguucaagugauucuccugccucagccucccaaguagcugggauuacagguaugcgccaccacgccuggcuaauuuuguauuuguaguggagaugggguuucacuauguuggucaggcuggucuugaacuccugacgucaggugaucuacccaccucggccucccaaagugcugggauuacaggugugaaccaccgcgcuggcccaauguuaccuaaaaauuuaaauucagguugggcgccauggcucaugccuauaaucgcagcacuuuaggaggccgaggcgggcagaucaccugaagucaggaguuugagaccagccuggccaacauggugaaacccugucuauacuaaaaauacaaaaauuagccaggcaugguggcacacgccuguaauuccagcuacucggcaggcugagguaugagaauuacuuaaacccaggagguggagguugcggugagccaagauggugccacugcacuccaaccuggccgauagagugagacucugucucaaaaaaaaaaaaggcauacgcaaaccaugagagaacaacuaaccagaaauguuuauguuaccuguagaguuuuaugagauguggcauaagagaauggacaaaaucguaaagggauuaauaauuaagauagauucuuagcgaaggcauuuuuuuaagugcuuggcaucauuauuuuuaauagcuccacuguguucaaaaacucaauccuagcuuauuuaugcuacuucugaaugaaguccuaagauauuaguguuuuuucuccuuucacagucuuuaaaaucuagaacuuccugguaguucuuaucacucuucuauguguaaaaccuuugcuucuucaccaguauucuguuguaccuucaucuuccacuuaucacuucacauaccauauucauucauucaugacuauuccccauuaaaacauauuaacugucuuacuuuuuccaaaccuuuuauuuuugcuggaaugagcuuuuccuuuaaguccaagcccaaaugucacuaccuuuauaaauaucagucaggacuaauuucuuccucuuuuuuucauaagacucuauuuauacugcuauccucauacgguaugguggcuaaaacugccuaauuucaaagauagggaccaugucauaucuaucuuuaucuaacccagaugguguccuuuuuacuacuauuuguaacaaaugacuagaugcugagaucaacuguuuuauauuucaugucaaauuuucaaaauguacgugguguuuguaagagagugcguguguuugugugugugcuuguguguguguguguggcaauuagugggcauggauauuaauggagauuaggcugcuuuaaagaauaagauaccaggccagccacgguagcucucgccuguaaucccagcacuuugggaggcugaggugggcggaucaccugaagucuggaguucaggaccagccuguccaacauggugaaacccccaucucuacuaaaaauacaaaaauuagccagacauggcagugcgcgccuguagccccagcuacuggggaggcugaggcaagagaaucgcuugaacccaguagguggugguugcagugagccaagauugcaccacugcacuccagccugagcgauagagacugcaucugaaaacaaacaaacaaaaagaauaagauaccauuggaaauuuacucaugcagcuuucaugauguaaccaggcaugguggugcacacccguaguccuagcuccucaggaggcuaagguggggaggauucauugagaugaggagcucgaggguacagugaaacaaaaauucugccaagucugucauaagaaguuauuauuccagucuauacagaacccaaauucugaugcugcaauagacguguauguguugagguggcauuuccaacacaaaaaaaggucucauguucacauuucauuuccauuccuguguuauuuuuuaaggguggaaauuugucauuguauguuuuaaugguguuuggaauuugggguauaaauuugaaauacuugucauuugaugaacugaaaauaguguuaaauguuaauuguuagauuaaaaaggaagaaguuuauucuguucucugccuuuaccugccuguaaguuuaaguaguauaggaaauucacaaggaauaaagguuuagaaaacagcauauuaucaaucacuuuauuacagaugagaacuagaauacacaguauucuguuuuuacaaaguuagacuggugagaaggaagucauuggaaacauggccauaaaguaguuuugccauagaaauaacaucauuuuacaaaaacccuucacuguuaagggauucacuauaacugaauuuuuacuuugguuuugguuuuuuucuguguuuuugguuuuuuguuugguugguugguugguuuuguuuguuuguuuuuugagacaagggucuugcgcugucgcuuaggcuggagugcaguggcacuaucuuguauuuuuuuguggagacaagauuuggccauguugcccaggcuggucucaaacuccugagcuuacccacuuccauccacccaauccauccaucucccaaagugcugggaucauagguguaagccaccacaccuggccaagauuuuuaguuucuuaauuuuaauguguugcuuuguuacuggauauaccuugugguuauauuuuuaaagaagauagaugcuagauuuuauucaauuauuuagucccugagcagaauuauuaaggcuaccagacaacuacagugaugcugcugucuauaaucaauacuugaaauugccaugucuguugcuuuaggaauuagugaggauauaaaugaaaacugauaacaaaauguauuuaugguauuaucagggaaacaauuucauugcccuuuagcuguuaaagucuguauaggugguauucuaguucaguucaucuuuguaaaaacuuuucaguacucugaagcuagaugauuauuuuuaucuaguucuuuaaaaaauaaaaaacuuuguggguagcaucuaguaauuuacaugagucuuuagcuaauuaguauaccuaaaagaauccucuuaggaucaggagacaaaauacaauucguauucucuacuuagagcuuaucauuguagauucuuguuaaguaaauaaguuuacuugauaaaaguaaauuugugcacuuaacuuaccacuuaaauuaccaacauucaguuuagguguuugcuuugugaccuugagcagauuacuugaguuguuuaaugauuugucaagugaccuuaaucauacaaugaagaaauaaucuaaaaaauuacaguauaacuccauuugccugugucuuugacacauucaaaaguggcucucuccccugccuuuuuuuuuuaauccccagcagggacaguuucaugggaauggaaccucugcagaugcauagagccccaugcuuguguuaauauucuguuguuaccaacuugaaauucuuaauaguuguuguuuuuuuuuuuuuuuaacaaagggcccuacauauuuuccauuuacucugggcucauguuauguagcaacuccugguccugagaaacuaguuaucauaaucgauuguaauaugcccugaauaguaauuguccuauguuaucuaagugugugacccuauaaucuuugcaauuguagaagaaaucuuuguaggcagauuuuauuucaauauauuuuagugagggaauguagguaacuugggcuaaaauguuauuucauaauagaugguuuuaggggcuuaccauuuaaucaaaauuuuaucauuuuagagcauaaaaguacucgcuuaaauuuuuuuuuaaaucuuacuagaugaaaugaauucagagcaggauuuaacucauuguaccauuacagguuaucaaguuauacccaaccagcagcaaaacuaccaaggaauaguuggaguucagcaaccccagagucagagccuagucaguggccaacccaacagcauuggaaaucagauucaaggaguggucauccccuauacuucagugccaacauaucagguauauugucucuuuuauguacuuuggguagagaugauuucgaauaaauuaagugcacaacuacaauacaucuucuaugcucuccuuuuaauacaggaaaaacauuucuguaauauacaaccuuuuaauacaggaaaaacacuucuguaauauacaacuuuauagucaagaguuuuauuagucguagaagcuugguuuuauccucauuuuauugcauuauucauuuauuaauguuuaggaucugaaacacauugauauuggcaaguuaauauugucuagcauugucuuauguuuccagcaauauagguagaugagcaaaugucuuauucuauuccucagcucuuuagaaaguccucauugcugggagagaggaauaggagggaaaauagagguuagugguagauauuugaaauagugagauacaguauagaccaugaauccguaguuguagaauagggaaguaugugcaguuuccugugcugugacugauuuuuuuccuuccucuccaucccaaaaagcgaugauaugucucauauuuuaaauuguuguagauauuaggccaggcacaguggcucacaccuguaaugucagcauuucaagaggccuaggcaggcagauuacuugagaucaagaguuccaggucagccuggccaacauugugaaacccuguuucuacuaaaaacacaaaaaauagcuaggcaagguggcggggccuauaauuccagcuacucgggaagcugaggcaggagaauugcuuaaacccaggaaguggaaguugcagugagucaccacugcacuccagccugggcaacaggcagacuccaucucaaaaauaaaaacaaaauguuacagauuuuaauuuauaguucuaaagcagaaauaccuauuauuugaugaauaagcacgugucuucaauauaauaugacacauuuuucaaaaauuuguuuuaccuuuauauuuauggaguaacuugcaagaggguuuauuuuauuagccucauuguuuuucauagcugagucugauuuuaagaacuccaggccagggccaggugcaguggcucgugccuguaauccuaacacuuugagaggccaagguggguggaucacuugaggucaagaguucgagaccauccuggccaacauagugaaaccccauuucuuugaaaaauacaaaaauuagccaggcauguuggaaggcaccuguaaugucagcuacucagaaggcugaggcaggagaaucacuugaacccgggaggcgaagguugcagugagcugagauuacgccacugcauuccgggcuaggugacaaagagagacucagucacaaaaaaagagagaacuccaaagaccacuuucauucaucucaacaaggagagaauagccuaguugggaagauagggaauagccuaguugggaagauaaaauacacguauuuuguguauuuuaucugaacacauguaaacaaauuggugauaguguacagacuaguaacugagaggaucaugaaauacagcaaugaacagguuaaggacuugauuugaagccuucugggaaguuagaaaccuuuagcucuucaaagaaaaugaugggcguaaauugguuaagaugacauucugagaaugaagaaggauauaagcaaaggugcaagcauauuccauauaauuucagaaaauugaaauuaaagugugaaaugugagguugucaaauguuguugagcaccaaguguauguccacuuuugagaacccuuuaccauagaacacaucuacaaaagaaagaaaagauacuucaugaaaacugggcuuuccaucuucauuuucucucacaucccccaugcuucugaccccuucuccuccauccuugagccuaggcacaugagccugcccuucgucuguuuccccauaguuaagcauuaaacaggauugacaccaagccugaagccuuccuuucucaaagacucugguucuacuaucuaauccaauacagaguucagcauguaagaucugcccuuaaucuuugggggcuuacaucuaguaagagaaaugucauuuuuaaacaaauuacagccuaauuaguauaguuuuuuuuuaauuagcuggauauugaaaauauuccagagcuaagguaguggucauaauuuuuacaccauacauuuuuacauuuuaacauuauuuucucauuguauuuaauguaauucucacauuggcugaauauuguaggaaguauugcucuggccagcaaucaauaauagucaucugcuuuaaaguguggcuccuacuacauuugauaaacaagcuagguagugauaaacuguuaucuaaaaaauaagccagaaaagucaucuguccuacaccuccugagucagagggcauggguuugaauucugacuuucccuccaguguauucuaugccuguacacucucuaguaguggucggucgcuugcucucucucgcucgcucucucucccccucccucccuccuuccuucucuuuguuuuugagacagagucuugcucugucacccaagccggagugcaguggugugaucuuggcucacuacaaccucugcaucccaggcucaagugauucucaugcuucagccucccuaguagcugggauuacaggcgcaugccaccacgccuggcuaauuuuuguauuuuuaguagagacgguguuucaccauguuggccaggcuggcuggaacuccugaccucaagugaucuacccuccuuggccucccaaagugcugggauuacaggcaugagccacugcacccagucagucauuaccuuuuaaaucauagagccagguauagagaacagugaagugauucuagaacugaguuucuggagccacaggguuugaauucugacuuuccuacuuacuaaucuaaggucuuauagcuaguaagugggaaagucagaauucaaauuccugcccuguauuuacccaucuauaaaauagaugauaaaaguaccuucaggccuggcgcaguggcucaugccuguaaccccagcacuguaggaggccaagguagguggaucaccugaggucagaaguuugagaccagccuggccaacauggugaaaccccaucucuccugaaaaauaccuucuuagguuguucagaagccuuaaugagauaauacacauaaagcacuuagaacagaacuuaaaacauggcaauaaguacccaauaauguuaacccucccuaucauuacuauuauuaacgucaucaucaucaucagugguuauagugguuauacuggcuugcuuuuuuuuuuuuuuuuuuuuggagacagagucucacucugucacccaggcuagagugcaguggcucauucucaacucacugcaaccuccaccuucugguucaagcaauucuugugccucagccuccugaguaacugggacuacaggcacgcgccacuacucccggcuaauuucuguauuuuagcagagacgggguuucaccauguuguccaggcuggucucgaacuccagagcucaggcaaucugcccaccucagccucccaaagugcugggauuauaggugugagccacugugcccagcccggcuuucuuuuuuuuuuuuuuuuuuuuuuuuuuuuuaaauaaagauccuucaggccauugaauauacauuggcuuuauuuaacaaaaucacuguaauccaacucuaauauugagguacauuuguaaauuaagaacccuuuaugccuguguuguuucuaucuuagaaacuguagagugguaguacagaauuguguucgugugauuucauuuagaugauauagaaaacagaacugaaagauacacuguuuacugaaugccuacuauaacuagauacuuuaguugugcuaucucauaauggaaauaauaccuccuuuguaauggaggugguguuuccauuucuucugauaagaagcuaaggagccucagaauagucacuugcccaauaucacuuagauagauggcugauaucacauguagguauuuuaagcuccaaagcucucacuuuuuaugacccacugcgucucacugccauccugccugauuuuuacuuaguucuaccugagguaaacuguguuacucuuucuauaucaaauggccauccuuauguggaaaguuucuuuuucauaauuuaaccuuuucauaauuuaaugcaucagccuacaguacauacauuuacaaaugcuagccagaagcaauagcugacauagaaauaaagugguagugcuguggcuaacaggaaagccuguuggcaguguuagcuuauuucugacugcucaugcuuuaaaaguuuaugguggcugcuggguaugguggcucacuccuguaaucccagcacuuugggaagccaaggugggcggaucacuugaggucaggaguuugagaucagccugaccaacauggugaaaccccaucucuacuaaaaauacaaaaauuagccaggcaugguagcgcaugccuguagucccagcuacucaggaggcugaggcaggagaauugcuucaacccaggaggcagggguugcagugagccaagauugcaccacuacacuccagccugggcaacagagcaagaauucaucucgaaaaaaauaaaguuuauggagguugaaaacauaaacauuuacaaggccuugaaaaaaaccuuuuucucuugaaauugucuuucaaauuuuagguuucacugccucaagguucucaaggaauuccccaucagacuuaucaacagccuguuauguucccuaaucagucuaaucaaggaucuaugcccacaacaggaaugccuguuuacuauagugucauuccaccuggucaacaaaacaauuuaaggugaguaugacugaguaaccuaaucuuccagcuucucauuguuuaccaggauuauggucuguugcuaguuuuaaaguugacuaaggggcauuacuugagaacauucucuaauguagaauagaaaaaaacuauaauacaguauacuuuuuaacauauuucuuucggcuagguacgguggcucacgccuauaaucccagcacuuugggaggccaaggcugguggaucaccugaggucaggcauucaaaaccagccuggccaacauggugaaaccccgucucuacuaauaauacagaaguuagcugggcaagguggcguacgccugugaucgcaacugcucgggaggcugaggcagcagaaucuuuugaacccgggaggcagagguuguagugaaccaagauugcgccguugcacuccagccugggcaacaagagugaacuucugucuccaaaaaaauauauauguauauuucuuucaguaaaaucaguacaaggaaagcaguccauauaaaagcuaaaggcaagucagaucucucuugugccuaaaaauuaggccaaucuucuguuacucacacaaauggaguaacaguuggaguguaauauuuaagguuuuuauaggggucuggaaaaauuguauuuccuguguauaacuuuagcagugaaauaucuugcuggaauauuucaggcuuugggaagcucauuuuucaucaguaagggagggaaggcauguaagagaaguaaaugauaguaguucuacauuaaagcaagucaugaaguauuccaucaacagaaaugucucugacaagccauguguugaaaauacuaaucuuucauugaauugggucccuuuaguucauuguucagaauguauuaccaaaccauucauuuauucucauggcaucccuguguuaccaagcaaguccauucugccugcguauagcaagccaaucacugugacaacggguuuugcaaaagagaaaauauuuuauucacaaggcugcuugugaaaggagaugggaaaacaaaucucaaauccgccucugaaaauagggcuuguggguacuuaauuuuaacauuauuuucucauuguauuuaauguaauucucacauuggcugaaugauuguaggaaguauuuaucuggccagcaaucaauaauagucaucugcuuuaaaguauuuaaaguaggguggucuaaagcgugagaaaaugugauugaugggugggaaaguugauuggcagguuggaaaaaugagguaauugggguuucugcacaagcauaaucaagcuacaugguucuucauaggacgugugugcagaaaauggcguuagcaugaucugaagauggaguaguuuuaggcccucugacgccaaaaggucacucucugggcaccugugcaggccuaguuaaaggguucaugaucucaaccagcuuggacuggacaugagcugcccccuggauccugaaaaacagcuuuaaauaccuguuauauaguuacccacagucagaaauguuaucuauaaggaaaacagugggaguuuaguuauauacuucuuggccacaugacuugcuagugggaguuuuaagauuagcuaaucccagccccuuugaugcaaaacugcuacaaaaugaaaauagaaauauguacuugguuaaauuucgcauuuguugugugaguuuaaauuuuauaaauaaggaaaaaauacuccgaaucugaguuuuuuacccugauaaaucuaaguuugggaucuagaaugccaguucaguuuccaaacugucaguuagaggcagaaaucugugcuaaaguagggugaaaugaggagugagaaaauugaugauuuaucuacuuuuugaaccaaaguuuaauuuuuuauuuaccagagaauauugccaaagucaucauuucuauguggggcagaggcugagagauggguauuaaguuaccuuuguaggccugccuacugggaagaggggcuuucauaagggaaggauaucaagccuauaagaaccuauguaagauggcuuaggcuuucacaauuuuucacguuuguuguacuugucagucccuugaaacaaaaaagauuuugugugcuugacuugugagagagcuugccauaagaguguggauacaggugagagagcauaauuauguuccugccccuauagugagccuuauuuuaagcauaagagcagaauccaaaagcugucaagcgagugcugaugacuacacuuuggaaagauccuugguuuuagucccugggcaugcuucacaaagaaaauaaaaaauuuuuaagagcuagcuuuggccugagggauagccugcagcacagaaauuaaaagauagaugagauucuccaacaaccuccaaugugaaucuugauuaaaaguuuuugguguugggcaugguggcucacgccuguaaucccagcacuuugggaagcugaggcggguggaucacuugaggucaggaguucaagaccagccuggccaacauggugaaaccucaacucuacuaaaaauacaaaaauuagccaggcgugguggcgagcaccuguaaucccagcuacucgggaggcugaggcaggauaauugcuugaaccugggaggcagagguugcagugagcucagauugcaccacagcacuucagccugggcaacagagggagacucugccucaaaaaaauaaaauaaaaaaagucuuuggaauuacccgcagcuuggacccaaaugaggcagauaaacuugaaauaagguagauguaagcugacaguagugauuggucaccaugugacaaacuagcauugaucuguuccaaguauagaguaccaaugugagaaauugaaugaguuguacgugaagcagggaauguguauucugucagacucaucuugguacauuuuggacuaguuacuugguaggaagucaagucauguacagaauuaaaguucucugacuggcugcaguggcucacgccuguaaucccagcacuuugggaggccaaggcaggcagaucacuugaggucaggaguuugagaccagccuagccaacauguugaaacccugucuccacuaaaaauacaaaaauuagccgggcgcgguggugggugccuguaaucccagcuacucgggaggcugaggcaggagaaucgcuugaaccugggagguugggguuguagugagccgagaucaugccacugcacuccagccugggcagcagaguaagaaccuaucucaaaaaaaaaaaaaaaaaaauucauuaaagaucucuuugggugaaaaaaaauucauaauuaacugauuaauuuuuuaaaacauagcagcauucuuuacagaaaaugucauuucugcuucugggcaauauuuaguagacaaaucaccauaauauuucaaguuuacuuggaaccaucacuuaagaagucaacuauugguaauuuuuauuaaucagauaguugaauuaccaucuaagggcuaaugaauagaggcaauucagaaaucuagacuuaguggcuuauauaaauuauauuuuauccuacauauuucaguauauuuacaugaaaagcagggguugaucuaauuacugaagcaccagcugggcaugguggccagguaacagagugauacucugucucauaaauacauacauacauacauacauacauacauacauacauacauacauacucaagcaccuggaacagggccuagcauagagucagagcuugguaaaucuauacugaaugaacauauuucuuuuguuuuguuuuguuuuguuuuuguuuuuuguuguugagacagagucucacucugucgcccaggcuggagugcaguggcacgaacucagcucacugcaagcuucaccucccagguucacgccauucuccugucucagccucccgaguagcugggacuauaggcgcccgccacuacgcccggcuaauuuuuguauuuuuaguagagaugagguuucaccauguuagccaggauggucucaaucuccugaccucgugauccgcccaccguggccucccaaagugcugggauuacaggcgugagccaccgcucccagccgaacauauuucuuaaaugucaaaggccagcuugcacauguguauauguacauagacaucauuaacuguuggacucaauuuuauuuuguuucuauaaccucucuaugcuuuuuaaauuuuucaucaauuuuuaaaauuacaaaacaaauaaugcuguuaauauaagugaagcaauacagagauguguaaagggaaagguaaucaucaugcccugcuccaccccccauccccagguaaccagcauucacaggcuaggguguguucugucacauuggccuccuggcuacacaaacaauacacgcauaaauacucauaugaggaauuggguggugaguuuuagugaaauacacauucucuugcguuuuuuuuuucuuuuccauuuuauucuuuguuuuugaggugucucacucuguuacccaggcuggagggcaguggcaugaucauggcuuacugcaaccuucuccuaccaggcucaagcaauccuuccacuucagccuccuaaguagcugggaccacaggcacgcaccaccacacucagcuaauuguuuauauuuuugguagagauggggucucacuauguugcccaagcuggucucgaacuccaaggcucaagcaguccucucaccucuacccccaaagugcuaggguaacaagcaugagcaacugcucccagccugcauuuuuuucauaauaauguaucaugaacaucagauuaguaaauacuaguauaaaacauccuguuuuguuuuucuaauuucuugacaaacauaauuuuauauaaguaauauuaugucauccuggcaguuuuuuauuguccuaaccuucucucucccuacccuaccacuggaccauuucccacacacacacaugcuaguuaacccguguuucucuccugguuucuguccuuccuuccucacuuuccuucuugugcuuauucauauacuaacacagauaugguacggcaacaugaacaaaauagcacacauacacacacucaaauugaguuuauaaauaguuuugaauauaaaaugucuacaacuugguuuugguuucuuguaggagcauaucaugucugacaugugaugggagaauccauucacauuuaauauuacaacugauauaccgaacuuuuuuccaccagccuguauuuguuuguguauuucaccacacuguacuuguaacugaugacuaauugguuagucuucugcuguuuucucagauauuuaucugagaaauuucucuaaauacaugcuauauucauugagacucuucaucauggaaucccacugaucugauaccagggaauaugcugguccaauaagcuaauuuuucagauaacuaaaacucaugccuuuaaauauuaguuauuagguggcaugauaugguuagaaaaaugggcuuuggaaucauaaaaaccugucuucaagccagugugaccuuggacaaguuauuuauuuguacuuuuguuuucucauuuguaagacagaaauaccuuccaggacugguggaaggaauuacaugucuagaacuuuguauauggaaacugcaaauuugccagcuguauaucugauauccaaaauauuaaggaaauccuguaauucagaaaaaaaaaggguuaaagaguugaauagaaauuuauccagagaagacauacaaauggcaaacaggccagagaaaggaugcuugauaucacuaaucauuagaggaaugcaaaucacaaccguaaugagauaucaccucacaccuguuaaaauggcuguuaucaaaaaaaucaaaagcuauuaaguauugauaaggauguggaaaaaagggaacccuuguaacacuguuguugggaauguaaaaugguguagcugcuauagaaaacaguacagaaguuccuaaaaaaaauaaaaauagaacuaucauuugauccagcaauuccaaauacuucuagauauuuaugcagaagaauugaaaucaguaucucgaagagagauuuacaucuccauauucauugcagcauuauucacaauagccaagauguggaaacaaccuaaaugucaauugguggaugaguggauaaagaaaaugugguauggcucauuccugugaucccaacacuuuuugaggccaaggcaugaggauggcucgagcccaggaguuugagaccagccugagcaacacagggagaccccauuucuacaaaaaauuuaaaaaguagcuggguauagugacaaauaccugugaagcuagucuacucaggaaacugaguugugggaagauaacuugaaccugggaggucaaggcuauagugagccaugauuacgccacuguauuccagcuuaggcgacagagccagacccucucugaaagaaaaaaagguuauauauguacuguaauggaacauuauuuagccuuuaaagauggaaauccugccauauguaacaauguugaugaaccuugaggacauuauguugaguaaaauaagccagucacaggacaaauacugccuuauuccacaguaugaccucuaaaauagucaaacuuggcugggcgcaguggcucauaccuguaaucccagcacuuugggaggccaaggcagguggaucaccugaggucaggaguguacaccagccuggccaacauggugaaacuucaucucuacugaaaauacaaaaaacuagccgggcaugguggugccgguagucucagcuacucaggaggcugaggcacaagaagcacuugaaccugggaggcagagguugcagugagccgagauagugccacugcauucuagccuaggcaacagggcaaaauucugucucaaaaauacagaaaauaaaauagucaaacuuguagaagcagagaguagaauggucauugccaggggcugcagggagggggaaguggagaguuacucuucaguggauauaacauuucuuuuaugcaagaugaaugaacucuggaaaucugcuauacuacauuuugccuauagucauauuguguuguacacuugaaauuuuauuaaaaggguagcucucguguuuaaaacaaacaaaaaaagaaaaacaguuauggugucuuugaaggauuugugacauccauuuuaauaguucacaugucuuuagcacuuaaccuguuucugagcucuguuccagaucauuguaaugagugaauacuucuccaaaaagcaaguaugaaagcuugaagaaaucauagagaaucauuaguuuauccuuaaagcaacaaauauuuuuauuuuggcucuuacucccaauuagacuaaauguaguaagaugugaauuuuuuuagugugacuuuuuuccugauuaauauguuuucuguguaacaugaaucuacgucauuguucuuuucuggcucgucaaaccaauaccuuuucaaugacacuaccuuuuuggguuuaagaaaaguuaucuuuuuguuuaccucacugaauuugaagucuacauuuuuacaagaacacucagcugagaaaugaaaaauaaaucacauuaauuuucagaguuacauaaagaaaaauauguguagcagauucucaguauuuguagacuuuguauuugcaaaucugccuauuugcugaaauuauuuguaaccccuaaauugauacuuauuguacuuucuuuuucauucguggacacguucaguguggcaaaaaaguuugaaucaucaggcaagcacauucccaucugaggucaaacaaggcacaugcugccucccuguuucaguucuucuauuauaaacaauuguccuuuucagucuauuuagugccacguuguucacacuuuuuggguuuuuguuugaaauggcucccaaacaaugcugauuuucugucuuguguuacuaagcacaagaaagcucugcuguguguucaagcaugaguugguacuggccaucaguucaguguuaacgaaucaacaauacaguacauccagaaaaagaggaaauucacagauguguaugugaggccacucuagaaaguccuaaaauaacauccgaaauagaugacaaaguuaugaaaaagauggaaaggcagcuggauugguggauucauaagaugaugaaugaguuuaucuuccuguuuugggggauuuuuuuuuuccuuucucuuggcuucucaauaugauaaccaaguuuuuaaaaaaccauaguggacagcauuguugugaaacugaaagccaaagaaauucaugaucauguuacccagggucaggaaaaugguaaacacuccucaaauaguguuuuguuaucaagaaauacugcgaagggccaaggacgguggcucauggcugugaucccagcacuuugggaggccgaggcgggugaucacuugagaccaagaguuggggaccagccuggccaacauggugaaacaccaucucuacuaaaaauacaaaaauuagccaggugugguggcgggcaccuguaaucccagcuacucaagaggcugagguaggagaaacacuugaacccaggaggcagagguugcugugagccgagauggcaccacugcgcuccauccuggaugacagagcgagacuccuucucaaaaagaaauacugcagaguuuuuacauuucuagaaucucauuugucuucacaguguccuucuaaaaaggauaagaauauguauuuguuuuuauuuuacauguagacacuaugaaauuucaacccuauauaucuucauuuaauuggucuggcccugaucuuaagccugagcaacauuauuuuuugaugcccuccaggugauucuagugggagccaagaauugaaacccucuggccuacacuaaccagcccuuuagucugguuuuuauucaugccuucagcuguccacaaguagcuauagcccaguaaaacuuuacacauuagcagagaagucaugaugucuaucacuguuuauuaguagauuuucaucugaaauccaguauccugacauaaaacuauaaauuacuacauaucaacaaguuuauaaauuucuagaucuuagauggaaaguguaucuuaaacucuagguuacagggucuugauccauacagucuuacuauguuuuagaugcuaaauggacucuaguagccuucauuuuauuacaagauuauaaggaauaagauuccuauaagaacacaaagugagucuuuguuuugaaaaaugucuuacuuagcuuggguugcuuagcaaaauuguuuucuuacagagguuccuuguguagaaagguagaauuugaauuauuaugucuacuuucagcucauccuuucaguucacugaggcaacuuuguguuuggauuggauuguguuguuacuuaucauuaugaagauugagcacagccugauacaagucaacauauacugucacuuuaagcgagcaaaguacuagucagggacacuaauuuuacaacaacucaugagauuuuucucaguccuuaguguggagagaaaauuaguuugauaccagcagccuucaaaagugggcaagugaguuggauaucuucaaaaugcucucauuuuuaccgguucuucuccuauuuucccuuucauuuucacuauuuuuaucuugaaauucaaaacgauaauaccuuugucuuugaucuauauucucaaagggguagcauacagacaggaacuugaaaagacuauagccuuuuuuuaagaaccuuuaaaaaauguuucacagaaucuuuaugaaauuaugaaaaagaaaaccuacuuuuaagucuuuuucccuuuuuucuguccacagucuguuuuuccucauuuuuguauccuaguauuucucuagugucccuuuuguccuacuugugauaccucucuuguauucauuuuauuucuccuaagcuucuaguuugacauuuucaguuuuuuguuugccucagcuauccuuugaaauaauuguugauaauaagucugucgaucugaacuauaucuuuugguaaaguuuuacuucucucguuauuaaaaaugaaguuacuaacagcuuagagaaauaaaauguaauaaauaaaauuuugauuuugcaagauaaguucaagagaugugcuguacaagacuuugucuacagauaaauauuguauuauacacuuaaaacucugugaggauagaucuuguguuaaguguuuuuacaccaauaagaauauguuuuaaacugagcaaaccaauauacccuacagcauaucugcacugauaaccuauguaugauuuuguagcacuaacagaauagaugaagaaagauacuguugaaggaauaaaauguaaaagaaaaaaaguuacuuucacugcuaaaacauugccuuuucagaacauucauuucuucuuuaguggauauaaaagagguuuuuuuuguuuguuuguuucuuuuuuucuuuuuuaccauuuuugugggcauguguuuauuagcaaaauuuauuaguaaauuguuuuauucaccaaaaaauguuaaaggagaagggaagagggugcuuuagcuauuucauuuuugugaacucaccaaaaugagugauaaugguaauacuuuggauuuaaauuauuuagguaccuuuaaggaauaggagaggcaacauuucaugaaaaaaccucuuuauccauaauugaucacaccgaguauuuguggugcuuccucagccucucaaugaguuucuguuuuugaaaaauacuucucuuauaucuguauuuugucuauuaaaacagucuuuccucuauguaccuuguuuaggucuuucugguuaaacauacauagucauuguagaaaauuugaaaauauuugaaauuucaaguguuugaugacaaaucaaccacagccuuagcacccagaaauaaucacugauaaauuuugauguaccucaccaaagucauuuuucagugugcauacauauauaugaacuauguuagcaaucaaauuuuuuaacauuuuauuuuauacuuuguaaaaacuccauuauuaauuuuucuuuuaggcugggcaugguggcucaugccuguaaucccagcacuuugggaggccaaggugaguggaucgcuugagcucaggaguucaagaccagccugggcaacauagcaaaaccccaucucugcaaaaaauacaaaaauuagcugggcgugguagcucauaccuguggucacagcuauucaggaggcugaggugggaugagcccaggaaguugaggcugcagugagcugagaucaaaccacuucacuccaacagagagaaccccugucuccaaaaaaaaaacagaaguaaagagauuuucuuuuuaaauuaaauauauaagcuggauuugguggugggccccuguaauucuagcuacgugggaggcuaaagcaggagaauagcuugaaccugggaggcagaggcugcaaugagucgagauugugccacugcacuccagccugggcaacaaaacaagacucugucucaaaaauaaauaaauaaaacauauauaaauaucuggaguuaaauaguaaaauucuaccuccauugcccuuucuggaaagcagucacuauacaccaauauaaucacuagaguuuuuguuuguuucuuuuuuuuuuauuuugagauagagucucacucuagcccaggcuggagggcaguggugagaucucagcucacugagcaaccucugcccuccagguucaagcaauucuccugccucagacucccaaguagcugagauuacaggcugccgccaccacaccuggcuaauuuuuguguuuuuaguguaggcgggguucaccauguuguccaggcaggucucgaacugaaccucaagugauccgcccaccucagccucccaaagugcugggauuaccggcaagagccaccacgcccagccauuuuuuuuuuucuaaggugaagaucaguguuguuuuuguuugugucauguggagucuuuaugaaucuuuuauucugcaauucgcuugucuuauuaaacauuaugcuuggccgggcacaguggcucacgucuguaaucccagcacuuugggaggccaaggcggguggaucaccugaggucaggaguucuagaccacccuggccaacagggcaaaacccuaaaaaauacaaacauuagcugggcgugguggcacaugccuguauucucagcuacucaggaggcugaagcaggagaaucgcuugaacccaggaggcagagguugcagugagccaagaucacgccauugcacuccagccugggccaaagagcaagacucggucucaaaaaaaauaaauaaacauuaugcuuaaacuuuuuuccauagagcaucugaauuuuagguuaggauagaaaaaaauuaguuugagacucuuuaaaaaaaaaggccaaaaauuaguccaguagcggucuuugaagugaacuugaagugggaagaacccccaggcagaaggauaucguauuaugugcaucaggugguggcacccucagcugugguaguggcaguaggagggggauuaaucuggggugcacuuugaaagaagaaacaaauauuuuauguuaagugaggauuaaggaaagauuugagauaucuuaauggguaaugccccacuagcagcaauacauguugggauugaaaaucaguguaacuguuauuuggguaucauuuacuuuaacauaccuacuagaucuaaggucggcagacuuuuucugaaacacgccaaauaggaaauauuugaggcuuuguaagccaaaauacagaauuguggauucuauuuagguauuuauauaacaaggggaaaaauaaguuuccauaaauuuuuauugcuaaaauucaaaauauaauaaugagcacaauggauuuauuuuggguggcagauaacauuuuacuuaauugggguucaaaguuaguguucuuugucaucaaguugauuucagauguucaucuguaaaaaccauucuuagcuuggaggcaauacagaagcaagcaguggucuggguuuugccuauaggccauaguuugccaacuccuguacuagaugguugauagccagcaaaaaaaaaagacaaagaggcaguggucacaaaugaagaccaacaacuuaggaaaaaggaguguggaagccaacauacaaggagauuucaaagauuaauagucagauguuguagggggugaggaaggaagagaguugaagaccauuaaagggaauaaaaaacacuggcugugaccagaagaggucauuuguaaccuugagauaguaugugguaaaguaaaaaggacucuuaagaaaaaaauaacaaguucagaugguucaugaaguauuauggacaaaaggucauaguauuuauucaaaaagaggaaagauguaacuacuuugaaaacuagaagagaaagaacuaaaggagaaaagaauucuuaggccaggugcagugacugacaccuguaaucccagcacucugggaggcugaggcauguggaucaucugaggucaggaguucaagaccagccuggccaacauagcaaaaccacaucuccuaaaaauacagaauuagccgggcuugguggcacccgccugugaucccagccacuugggaggcugagacaggagaauagcuugaacccggaggcagagguugcagugagccaagaucacgccauugcacuccagccuggggaacaagagcgaaacugccucaaaaaaaaaagaaaauaauuaauuuaacaugagacaaaaaggaaugauucucuaaaucuucccuaccuacuuuugaauuauucuucaguuuagauuuuuacagcuuuuauuccucaaguaacuucuaaacuuuucccaauuguuuuuaaaaauccacagugacuauuuuuacugccuaagguuuugaauggcuauugccaaacuugcuguuuuagauauuucuugaggccacaagcaaccuauauaacaagcaguccccugagauaggccaacccaguuuacaagguagaagagguauguguuggaagugucccucuagcauauccuguguauuuuauuuuuugaauaauuuccaggucuugggagugugcugacuuuggcaucuuacgugguaucagggacaauaugagggauauugaagaaaggaucuuuaaaacuugcauccuccugacuucuguuuuuagccaaaauggaguaauauagacuggauuuaacuccuaccuuaaccaaaaagccagaaauuaugugaaacaguaguuucuagauauuggacaugggacauugaagaacaguaaacccugagagggagaaacaaaagaagugagucuuaggauugccccagcuuagugccacaagaauguuucccagacacagcucagggagggggaacccaaccagagucucugaguuaggagauggaguugggacuuaaggaagccaagguagcuagaguuuacagggcagaauacugaagagaagagagcucuagagaucucuggagggaccuccuugagucuuaguugaagagauuggugcauauguuugcaaacacuacuugaggccaggaaaagaaccacucaaaaggagcagacacaaacaaucccuggaacucacccaaggacaguaaucauuuguaguccuaccagccacuggcaaaacuucauaauacaggaagcaacaaguagaggacuuaaaaggacacuaucucaauauggaggaaaauugguccuagauuaaaggcugcucuguuuggcucuaagcuuccuguugcccgccccccaaaagcauuuaaaaacaaaaggcugcugucguccugccugaaaaaucauaaaagcaaaacccaaaagaauuaaauuauuuccagacaaguuaacuaugguccagaacaaagcucaaaaauacuguuacaaauuacaagaguauccaacacccaacaagguuaaauucacaauuuagucuugacuccaaucagaaauuaccugucuccaaucaaaaauuacugagaaugcagagaaucaggaaacuaaggcuaauaaugaggagaaaaaucacugaguugaaacugacugugaaacaaugccaguauaaaaaucagagagggaaaaugauuaacaaagcaucauugcucuuaaggggcuaauucauguguaacaggcauccucaaaagagagaaaagggaaaaaaaauauuugaguaagugaugguugaaguuuuucaaaauuugaugaaaauuauaaacccacagauccaacaagcucagcaaauccaagcaaaagaaaugugaagaaaacaucuuaaaaaguuauagagaaaaucuuaaaagcagccagagggggaaaagagccauugcauacagaggaacacaguuaagaaugucagccgacuuagaagcaauacaagccagaagacaguggagcaacaucuuuauuugaagaagugaaagaaagaaaacuugcauucuauaccuguaaaaauauuuuucagaaacagagauuucaaacacacaaaagcugaauuaauugccagccaccucgcacugugagaacuguuaaaggaaguuuuucagacagaaggaaaaugauaccaauggaaauuggugguacacaaaagaauacaaauaaaagguaagcaauauacaggcuuaaaaaacaaauauauuuuuguccuucugacaagggcucguguguauaauaaaucaagaauucucaaaccaaccaccuggggaaacaguuuguuuuaaacguuaaacccaauuauuccacuuccaaguauuuaagaaaaaugaauacuagaagaaacccaaauguccacccacaggugaauggauacaauccaugguauauucaucaguggaauauuacuuagcaauaaaaaaagaucuguugauaacagcaacauggaugaaucucauaauuauccugagcgaaaaaagaaaaaggccaaaaaauauauauaaaccacauuauuccauugauauuauagaaaauaacaaccuaaucucuguugacagcagacagaucagugguugccuggagccaggaggcugggaagaguuuauggggaagaagggaaggugggacuacaaaggggcacaaggcaacuuuggugaggcuuuauggugugcauauacauaaaacucuuuaaauuauauacuuuaugugugguuuauuuucuauaaauuauaccucaguaaaacuauaaaauaaucugagucuuaaauuuuuucuuagagacugguucuugcugucauuuaggcuggaaugcaguggugugauccugacucacugaggccucaaccuccugggcucaagcaauccuccugcgucagccucccaaguagcugggacuacaggugcacgccaccacaccuggcuaauuuuuuaauuuuuuuuaaagauaggaucucacuguauuacccugcuggugucgaacuuuugggcucaagcaauccucccaccucagucucccaaacugcuggguuuacagaugugagccaccuugccuagccuucuuuucuaauaguuuaaacaaagacuaguuuuggauaaagugaaaagaaauacuguaaaacuaacaaauuauuaaaaacaagaguaagaauuugugagguuaagauaggccacagggcauuuaauggaggaauaaagguagacuugaacuaacuguaaaaccuguuacagagucauauugaaauguuaaaauuuaaucaaaaguguuuuuuucaaaaagcaaaugacuaaaaacuccuuucagccagaggugagagaucggggggaaacaaaaaaacaauaaaaagaaaguccaaauaccuauguugcaccagccugaccaacauagugaagccccaccuuuacuaaaaauacaagaaauuagcuggaagugguggcauacuccuguaaucccaacaaaauacauguaaaaccuuuaugcccaaaaccaucuugugauguggaagauuuguacucccuaugguuuauaucuuagaacagaugucagaaaacuacagcccacaaucaaagaaugguuuuuaaauuuguaaaggauuauuauuuuuuaacuccuaagugaccauguguuacucagaguuaaaauauauacuagcuggcucuugcagaaaaaguuuaccagcaucugccuuaaaaaaaccuuggcagauagguaucagagacauguuuaugaauguuuguagcaacaauguuuagccuaauacuggaaguaauccaaauaaaauggaauagaauguguaaguauauuuugauguauucauuucagacacuacuauacaacaaagaaaauuacuaaaguacaacuacuuguauccaauugguugagucucacagauaugauacugaguaauuaagaaacagucauaaaauaaucuauuauuccauuuauuuaggaucaaaaacagucaaaacucaacuauguucuuuugggauacauauauaugugguaaaauuauacaagaaauaaaaagcaaguaaguacugguuggacaaagugggucacgccuguaaucccagcacuuuaggaggccaaggcaggcagaucaguugaagccaggaguuugagaccagccugaccaauauagugaaaccccaucucuaccaaaaacaaaaaauuaaccaggcaugguggugcaugccuauaaucccagcuacucaggaggcugacgcauaagaaucacuuaaaccugggaggcggagguuguaaugagccgagauggugccacugcacuccagccugugugacagagcaaaacucugucucaaaaaaaaaaaaaaaaaaaguaagugcucuucacaaaacugguaggaggggguuuugauguuagaggugcaugagacgggaaggcagggauacuucuuuuuuuucuucucccuuuuuuuuuuuuugagacggagucucacucugucacccaggcuggagugcaguggugcgaugucggcucaguacaagcuccgccucccggguucacgccuuucuccugccucagccucccgacuagcugggacuacaggcacccaccaccacgcccagcuaauuuuuuguauuuuuaguagagacgggguuucaccauauuagccaggauggucucaaucuccugaccucgugauccgcccuccucagccucccaaagugcugggauuacaggcaugagccaccgcacccagccaaggcagggaugcuucuaagauacuagcaauguucuguuucccaaucugaaugaaguuacauagauaauuauuuuguuauuauacuuaauuuaaacuguaauauauuucuaagcacucuauauucgucuguucucgcauugcuauaaagaaaugccugagacugaguaaucuauaaagaaaagagguuuaauuggcucacagcuccgcaggcugcauaggaagcauaguggcuucuagggaggccucgggaaacuucaauuauggcagaaggcaagagggaagcaggcacgucuuacauggcuggagcccgaggaagagaagaguggggggagcaccacacacuuuuuaaagaaccagaucucaugagaacucacuguacaguaccaagggggaauggugcuaaaccauuagaaaccaccuccaugauccagucaccucccagcaggccccaccuccagcguuggggauuacauugugaaugagauuuagguggagacacacauccaaacaauauuacacucagauagauagauagauagauagauagauagauagauagauagauagauagauagauagauagauaagauagauaagauagauugauuagauagauuagauagauagauagauagauagauagauuagauauuccaaaccccaaaaaauagcaaaaucauucgaagagaggccuaaauauauagaagacuuuaggagaaaaaaagcuaacagaaugggaggagaggaauugaagacaauaaauagagacagccuuugaagagaauugcuuucauaaggauaagcguugaauuggauucguauauggagaggaugaagucaagacagaggauccuuuuuugauugaaagauagaugcauguguuuguaugcugaagggaaaggcuuaguagauacagaagauuugccucugcaagggacaagagagagaguuguaagguccccagggagggugagagccaccacaaaaauggaagcggguuagccuuagauaacagugcagaggauuucaugggcaguaaacgaggacaaggagaguauaaggauacagauauggguagauggauagauauggcagcaagagaaauucucuucugauugcuuugcuuuucucagugaauuagucaagauaucaaguacauuaucagaguagaagaauguucuaaaguuuuguaaauguagaaauccauuacagcuauauuaagacuaauauucaaaggaaagaagcaagauacaggggaaaugugacaaguaugccuaauaaaagcuuauuauauagaacauuuuuaucacuucucuauguucuaagaugguaacagugagacuacaaguaaauaauccauagagauaaauuguuacucgaagaaaacugauaguaaguuuucacaugggaaaauguugucuuaccagcaauccaaaaaaugagaauuaaggcaacuugaacacaaaaaguaggcuaaaacauauaguuagcaauacugugcauagagacguuuaaacauuacugguugcuaggcauaucaagcccauuuuucuauaaaucagucgggauauuuaacaaaaugcaaaauugcuguacuuuuaaauucuaccucuaaaauuuuaucacaaagauaauccaccccagaauuuaaauuguggcuaaacaaauuauaacagugcuauuauuaacauaagaauccaaauaaaaagaugcaaaaaaaaaaacauggaguaaccugguaaccuuugaauaguuuaaauuuucuucuccauuuauuuuucugcuaggcugauuaaguuuagcuuaagucauagugagauuuacuuaguugucacagaccguuucucagauagugggaccagugaguuuuaaagguguuuguucuguguuaauugcuccaguaucuucaauucagaagaauaaauguuugauauucaggcugcuauaguucacaaauggauuuuauugaugacuuacagcauuuuaagugaauagagcacaugucuauuaaguaauauuauuaaguucaggaagcuugcuuaacugccauugacaauaagauguagggugguuuaaaaaggcagaaaaccaaaugacuuaacacaccuugacaacuguucauaaauuuucaaagacaucgcuucuaguagucacuaaaagcuguaguagauguaugacuugcuuuucaaaugaaucaauuauugcuugagaagaauacacuuguuccuauucucccaucuaaaaaauaauuugaaauagcagccaugaaauauuuacaaaaacauaaagagaaaagacacaugauggcaguuuauuuucauguggaauuucccaugcuauuaauuuuccuaagucucgaccuuuugugggugauuucauacaacaggauuuuguaaauacuuuucauguacaguagucccccuuauccagaggguauauguuccaggaucucccagugaaugccugaaaccauggaauugaacccuguauguacuauguuuuuuccuauacauacaugccuccgauaaaguuuuaauuuauaaauuaggcacagugauagauuaauaacuaaugauagaacaaugauaacaauauacuguaagaaaaguuacaggaauguggucucucaaaauauuguacauuggccuggcacaguggcucacgccugugaucccaacacuuugggacacagagaugggagaaucgcuugaggccaguaguuugagagcagccuugggcaacauaacaagaccucaucucuaccaaaaaaaaaaaaaaaaaaaaacuauaaaaauuagccaggugcaguggugcacaccuguaguccuagcuacuugggagacugaccugauaggaucacuugcaccccggaguucaagguuacagugagcuacaaucuuaacacugcacuccugggucacagagcaagacccuaucuccaaaaaauaauaauaaaguaaauauauacacaugcauacauauaaauguacucauccuuguggugaugugagaugaugaaaugcauaugugaugagaugaagugaggugaggugaaugauuguaggcguugugacauaauguuuggcuacuguugacucuccaacaggaugucaggaggaggaucauuugauucaggugaucuagaucaucaagucgugacaguguugauagcuaaaugucaggagcaaagaguguccaugacuaacaggcagcauggauaugcugggcaaagggaugauucacaucuugggcagcacaccaugagauuucuucaugcuacucauaaugacaugcaauuuaaaacuuauaaaguguuuauuucuggcauuuuuaauacuuuuggaccaugguugacugaggguaacugaaaccaaggaaagcaaaaccacagauaaggggugacuacugugugcaccauuuuuauucauucugccaugugcuuauuuaucuuguuuuuaaacagcucuauugagauauaauuuauauacuauacaauucacuuaacauguacauuucaguagcuuuuaguguauuuccaaaugugugcaaccaucaccguggucaauuuuaaaacauuuucaucacccucagaaagaaacccugagguggaagcaacucaagugucuaucaacagguggauaaagaaaaugugguauguacauacaguggcuugagccaggaguuugagauugcagugagcuaugauugcaccacugcacuccacccugggcgacagagcaagacguugucucagggggaaaaaaaaaaaaaaaaaaaaaaaggcugggcgcaguggcucaugcugguaaucccagcauuuuuggaggccaaggugguuagaugaccugaggucaggaguuuugagaccagccuggccaacauggcaaaaccccgucuguacuaaaaaauacaaaaaaauggccgggugugguggcucacaccuguaaucccagcacuuuggaaggccaaggcuggcggaucacaaggucaggagaucgagaccauccuggcuaacacgaugaaaccccaucucuacuaaaaauacaaaaaaauuagccgggcaugguggcaggcaccuguagucccagcuacagcaggaaaauggcgugaacccaggagggcagagcuugcaguaagccgaggucaugacacugcacuccagccugggcgacagagcaagacuccgucucaaaaaaaaaaaaaaaaaaaauaucaggcauggugaugugugccuguaaucccagcuacucgggaggcugaggaaagagaaucacuugaacuugggagguggagguugcagcgagccgagaucgcacuccagccuaggugacagagcaggacuccugacucaaaaaaaagaaaaacauauagaguaaagagaucucagucuaggaacagacuuaagagguggcaaaagagagcagcauagaaucaacuauacuaaaacugaaauuauuguuuagcagguguuuucuaucacuucauugacccacuaaagugcugucucuaacagaucugcuaauacgcugcuugaugauggcugguucauccuaaugcgcuggucagaauaugccccaucucaagaucagucauucuccaggagcaucagagacaucuuuguggugaauuguguuuaugauaccuacccuccaauuucucaagccgaaggcaucuuuuccauuaaauauauaauguagacucuuuuuuagguuucaugcaaauacuuguuuaaguacuuaaaaaguucagagcuccuuuuuaaggaauauauuagcccuucuugcagguacuucugcauccuaccuauuuauuaaaugggaaauaauccucuuugggcaagauuuccagcccagcuucuaaguuuccuaguaaaacaugaaguauguuuuauaugugauacuggaaggcuggauuucucuauaauuaacugcaugcuguaaauuuauuuuagaauacaauuaugauauucugcaauccagcaccugccaguggccuaacugcuugcuuuccuuaucauccuggcaguuauauaaucccugggcucaccauuuuaucuuagcugccaagaaacacaaagcuacauucaaugcucuaugaaagcaacaaucuuagggcaggcguccccacucccuuuuuuuaauacuucauuuuuuagucaaauucaguuuuuuuuuaauggcucacauuagggaauagaugagcuauaaauuaaugcuuuuauaaauaugagcauuuaaccagaaagcccagauaaaucagcuauuagcauuuaaaggaaaacccaaaaaaugacacauuaaagauuuugacauuuauuuucauuaauugagcauauagucaaauucugauuaauugaaaguuuauauuauacuagguauauauacccucaccacaaaaaauauauauaaaauggaaauuacuaugacuuugagaaagcuuaugaggcagaaaguugguguuuucuuccagagacuacaagccuaguugagcaucugaccugcaaaugaauugguuauuuauucauuuauuuauuuauuuagagacagagucuugcucuguugcccaggcuggagugcaguggugugaucucagcucacugcaaccuccgccuccuaggcucaagcaguucuccugccucagccuccugaauaacugggauuacaggcacccaccaccacgcccagcuaauuuuuguauuuuuaguagaaauggguuucaccaugcugaccaggcuggucucgaacucuugaccucaagugauccgccugccucagccucccagagugcugggauuacaggcaugagccgccacacccggcugaacugaagguuuauauugcagaauaucagcauaaacaucuucaaauggccauacucugacaucugcugaaguuuucugaagcagauucaaauuguuucauugaaauuaacuuucuacuauaacauuuaaaagcuaaacuuuucaguuuucaaaaagcauuuuaaaguauuguuuauaauuacaaaaugcaugcaugcuuuuuuuuuuuuuuugagacagagucucuuucgcccaggccagacugcaguggugccaucucggcucacugcaaccucugccucccggguucaagugauucuucugccucagccucccaaguagcugggauuacagucaugcaccaccacacccagcuaguuuuuguauuuuuagcagagauaggguuucaggcuagucucaaacuccugaccucaagugagccguccuccccggccuccccagaugcuaggauuacaggcaugagccaccacacccagccucuuacagaguuuuaauguagcugaaaucuuacuguauauauuucacuuauuggucauaguaaaaauuuuuucauccuauuaaaaauucauuaauauaauuuaaugaucauacucuuacauuuuaugaauauacaauaauauauuuacccuauugcagaacauuuaggucguaucuuuuuacuuuauugaaccaucuuguaagcaauuuuaauuacucccuuggcaugaguccuuagaagggaauuaguagguuaaaggaugugacuguuauuaagguccaugguacauuuugccaaaaucuuugauucacagucccaauauguacugacuccgcuuuacuguuuucacauuucauaaauggcaacauguauuaauuuggcucugugauuauuaaugaaguuguacauuuuuauguuuggcuguuuacacuuugaauuauuuggccaaaucuuucaucauaguuugguaaggcaagugcuaauugcauguuuaagugcuaauggcauguuuguugaugaaagagcugaaguucaaauaacauguucagacucauauaacgaauaacaaguagaguuggaacacagcccugugcucccuucugacacccaaauacauggugcuuugcccuaggucagguauuaaaugucaaaggcauuaaaauagcaauguacugucacuugaauuugcaagaucuagugaauauaucuuaauaucaagcauugauauugcuugauauuaagcaguggugggcgcuuguaguuagcuacucgggaggcugaggcaggaggaucacuugagcccaaguguucagugcuucaguaaccuaugauaacaccacugcauuccagccugaggaauagagugagaccuugucuguuuaaaauaaauaaauaaauaaaaucacacuuugauaaaguaaguuucuaacuuuaaaaauacauuauauuugucauuuuuuuuaucauggcuucaauuccaaaacaugguaagaaugaauaacuaauuaacuggagagaaggggaauuucucugaauuacccuauaauguuaaaggaauaagaugagcacuguaaaaaaacucagaagaaggaccgggcacaguggcucacgccugcaaucccagcacuuugggaggccaaggcuggcggaucacgaggucaggagaucgagaccauccuggcuaacauggugaaaccccgucucuacuaaaaauacaaaaaauuagccgggcgugguggcgggcaccuguagucccagcuacucgagaggcugaggcaggagaaugguaugaacccgggaggcggagcuugcagugagccaagauugcgccacugcacuccagccugggugacaaagggagacuccaucucgaaaaaaaaaaaaaaaaacucagaagaaaccugugggauauccuauaaugucuuucaucaaucuccagugaucuuguagaagcauuucacagcaguuugucuggcucuaccuuacguagagaagaggcagcuccuaaacaggaaaaaaauauugguaauaauuuuuauugcaguggccuuaauacaguugaaaguggauauuuugauuuuuuuuuuuaguuuacauauccauaguuuuguuuuuguuuuuguuuuuguuuuuguuuuuuuugaacauucuuggguguuucucgcagagggggauuuggcagggucauaggacaguaguggagggaaggucagcagauaaacaagugaacaaaggucucugguuuuccuaggcagaggacccugcggccuuacgcaguguuugugucccuggguacuugagauuagggaguggugaugacucuuaacgagccugcugccuucaagcaucuguuuagcaaagcacaucuugcaccgcccuuaauccauuuaacccugaguggacacagcacauguuucagagagcacaggguuggggguaaggucauagaucaacaggaucccaaggcagaagaauuuuucuuaguauagaacaaaaugaaaagucucccaugucuaccucuuucuacacagacacagcaaccauccgauuucucaaucuauuccccaccuuucccccuuuucuauuccacaaaaccgccauugucaucauggcccguucucaaugagcuguuggguacaccucccagacggggugguggccgggcagaggggcuccucacuucccaguaggggcggccgggcagaggcgccccucaccucccggacggggcggcuggccgggcggggggcugacccccccaccucccuccuggacggggcggcuggcugggcggggggcuggcccauucauaguuuuaugucaggacuuuucaggaaguuuggggauaaaugggauuauuugagauugauguuucauuuuucuguuaaaggguaggauaucaacuuugaaugacuaggccuggugcuuuacuuuaaaaguccuucuuucccuccugucuuccaaaggaggagaaacuugugaaauuacuauagaacugauucaucucugguauaauauauuuguauuuuuaaagagagaguguaaauacugacuucugugcuuucuuuuuucuaaaguguuuaagugauuuaagagggugucucauugccuagucuaugucccuugaauuaucuauacgucucucagaagauaaguagaggccuggaacucauuuacauaauucuaaaacuugauucuuacucauuuaccuaacggguaaucuagugcuagaaacccacuagagugguaaaaugaaaucgcaguuuguaauuuaguagaguaugggcuauauugcuuacuucagugaccgaccugaguauucccuucccuuugcaggauggcuugcuuucacccacaugucucagaccuuagcaaacaagaucagagugaggggcauggcucaggagagcuguucacauggguuagaacagagccuaaaaaaccuuccaccucuggggaccuuucuguuuuccucaauuucggcacauuuacagacuuaagcuguauuauuuccacagguagcuaauacuuauauuacacauuacaaccauaauuaacauaaauuucagaaaguacuguuuucacuuaugauccaaaaucacuuucuauuaaauccucccuuuauaucucuuuuucccuuuuauugaaccgcucugaguuacugccccuaaaaaggcauaaagcuuuacuaauucuuauuaacugucagccugaaagacagaauuaacuuuuuauuauggaaaucuguaaacauauauaaauauaaacagaaguauacugaacccauauaugcccaucaccaauuauguaauuacuaaucuguuuucauauaaaucucugccucuucucccuccaauauuaguuugaaauaaaucccaggcaucauaguauuucauauccaugaguauuucagcauauguaucccugaaggauuuuuuaaaucccacauaauaucauuuuauaucuuaaaauauugagguuaauucauuaauuacaucaaauauccaguuaauauuuguauuuccuucugccccgcaaauauugcuuauguuuuuacacauuugucuuagaguuucccauauucuggauuuuaccgauugcgucaucauacugucauuuaacaugucuuccuguauucucuguaauucaguaguuuuguauaaaguuuaaugcaauuauacgagacacaggugcaaaaaguuauuccaacuaaauuaagaaauacuguuuuuguaagacagcuuuuuaaaaugacaaagacaauagaguuuuagauauaaauuauggcucucaguuacucaugaauucucagaauaguaucauucugugguuuuuaacuauuauaaaaaaauucuagaaaaaacuucagagauaauguuaugacaaaccccauauuaauuugagucugaaagacugcucaggccaggugcaguggcucacaccuguaauuccagcauguggggaagcugagacaggaggaucacuugaggucacgaguucaagaccagccuggccaaaauggcaaaaccccauucuacuaaaaaugcaaaaaguagccgggugugguggcagacaccuguaaucucagcuacuugggaggcugaggcaggagaauugcuugaagccuggaggcagagguugcagugaacugagaucguaccacugcucuccagccugggugacagggcagaacucugucucaaaaaaaaaaaaaaaaaaaacuaacuguucaaaaauacagcaguaacuuaaugguuucacacuaauagccuuuaauuuuugucaauauuuuguuaacuaugucagaacauguucuguuguuuccucuauucuuaguaauuagucucgcucugucgcacaggcuggagugcaguggcgcaaucucggcucacugcaagcucugccuccuggguuuacaccauucuccugccucagccuccugaauagcugggacuacaggcaccugccaccacgcccggcuaauuucuuguauuuuuaguagacaugggguuucaccguauuagccaggauguucucgaucuccugaccucgugauccgcccgccuuggccucccaaagugcugggauuacaggcgugagcaccgcgcccagcccauucaagaauguuuauagucauccuccucucauuaugcuguuuuuuuguuuuuuccauagcucuucaguagguuaccugcaacauccaggaucagaacaaguacaauuuccucgaaccacuucaccaugcaguucccagcagcuucaaggccaccaauguacagguauaaagaaaucagugaaaauaagaugauugguucauaugagaaauaguucgauuacuuuccuuaggcauuucuacaaaaagcuucucaauuugugaugugcugaaauacacccacaauauugagggugcuguacugaaucauaguuaacaugugcaguccacuucuuccuuuccuucuacugcugcuaucacaguacuauccugauucuccuuucucagaaguauugauacucucuaggguuauuuccuaugccuucugucauuacucuuccagcuguuccuguuuacuccaaauuaccuuuaugauaagugagauguuuaggccuacagaguccaucuuaaugccuguuuaaacacacaauacuuguagugugaugcacuagggcuucaaccugguuuucuuaguuaauaguaaaauuuuauucagaaauguaaaauuacuacuguuauccuaguguucagaaacaccaacuaguugcuaaaauauucugacuauagcauccuaaauucugauuuucagcuggaccaccaccgccaccugguggggggauggugaugaugcagcucaguguaccaaacaauccacaaucuugugcccacucacccccgcaguggaaacaaaacaaauauuacugugaucaccagagaggacagaaguguguagaauuuagcaguguagacaauauuguccagguaagaugguuuuguucauuaucauuuugaaacguuacauuuuuguuaccuaagauugacuuauaaggcuugaauuugaaaucccgucagccagauuaauaaaagaauuugggccaggcgcgguggcucuccccuguaaucccagcacuuuuugggaggcugaggcacggggaucacccaguuucagaccagccugaccaacauggugaaaucccaucucuacuaaaaauacaaaaucagcuggguguaguggcacaugcaaaaauacaaaaucagccggguauggugguagcaugcaucccagcuacucaggaggcugaggcaggagaaucgccugaacccaggugaguggagguuguagugagccaagaucgugccauugcacuccagccugggcaacaagaguguaacucugucucaaaaaaaaaagacggaggaaaaaaagaaucaguguuuaaauauuauuugcuaacuucugcguauucaaaaaaguguuuucuaacuuaaaaagauaaacuagaucuaaaauuuggugaagaaaaauaagcauuuauccuaccuuucccauaugacuauauauuaauguaaccaaauaguugauaagggaauguucucuguagaauaauccaguuaauaaaugcagaagcaaugguagaauuagaaaauugccagaaaaucaucagcagauccuaaaaauauuagauuaaaaaguuuugguugagaaacugcucacuuuaaaaaaaaauuuugagagguauuuuaaauggaugaauuagagagacagcccugaauccacugaucaguuguaacaucacuaaaagugggccagccaaacauuauuuaccucuucaugugguauagaaggaaguacacagcauuacuuaugauauacucuuaccgaaauuugaaucuauucaagccucuaacccuagcuacuaguuuaugggaaauauaagaagaaacaaaaacaaauuaccugauaccugauaccagugggacauuuuacuugacaaauuggcccuguuacuugaauagauggcauuuugaaauaggagcuuggucuguuauacauuaaaagagacucaagagguauaauaucagauauaauguauggaucuuauuuggauauugaaugaucaaaagacauuuuuuaaggccaggcgcaguggcucaugccuguaaucccagcacuuugggaagcuaaggcagaccuggaacgcaggaguucgagaccagccuggguaacauggugaaacccugucucuauaaaaaauacaaaaaauuauucggccauggcagugugcaccuguagucccagccacucaggaggcugaggcaagauugcuuuaucccaggaguucaaggcugcagugagcuaugaucaugccacugcgcugcccccuagcaacagagggagaccccaacucuuugaaaaaaaaaaaaaaacccaggcacaguggcucaugccuauaaucccagcacuuugggaggccaaagcgggcagaucaccugaggucaggaguuugagaccagccuggccaacauggagaaaccccgucucuacuaaaaauacaaaacuuagcuggacgugguggcgggcaccuguaaucucagcuacucaggaagcugaggcaguagaauugcuugaacccaggaggcagagguugcagugaucugagaucgugcccuugcacuccagccugggugacagagcgagacucugucuaaaauuaaaaaaaaaaaaaaaaaaaaaaaaagaguuguccguuagauauaaauguuuguauacugaaauauuuacaaguaaaaugcugagauuugcuuuaaauacuucaggaaaaacaaagccagggcgaucacaguugaaccuggaugauggguacauggaauuucauuaugcuuuucuaucuauacuuuuauauacuugaaauuuuauagaauuaaaagguuuuaucuuuuguugagaaaagguuacccucugacaccaggcuggacugcauuugcacagucacagcuuacugcagccucaaccuccugggcucaucauuuagagacagggucuggcucuguuaccuaggcuggagugcaguggcauguucugggccuacugcagcuuccaucuccugggcucaagccauccucccaccucagccacuugaguagcugagaccgcaugcacaccaccaugcccaacuaauuuuuuuuuuuuuuuuuuuuuuuuauagagaugggguauugccguguugcccaggcuagucucaaauuccugagcucaagcgguccaccuggcucagccucccaaagugcugggaucauaggcuugagccgcuuuacccagccagguuuuaacuuuuuuuaaaagauacagguugggcaugguggcuuacgacuguaaucccagcacuuccggccgggcacgauggcucacgccuguaauccuagcacuuugggaggccgaggugggaggauuacgagaucaggagaucgagaccauccugguuaacauggugaaaccccgucucuacuaaaaauacaaaaaauuagcugggcgugguggugggcgccuguagucccagcuacuugggaggcugaggcaggagaauggcgugaaccugggaggcggagcuugcagugagccaagaucgccccacugcacuccagccugggcaacagagcaagacuccgucucaaaaaaaauaaauaaaaauaaaaaaaaucccagcacuuugggaggccaaggagaaaggaucacuugaguccaggaguucaagagcagccuagacaacauaaugagauuccaucucuauaaaaaaauuaaaaauuagccagguguggugguauacaccuguagcgcuaguuacuugggaggcugaaccaggaggauugcuugacccugagugguagaggcugcagugagcugugaucacacuacuguacuccagccuagguaacagagugagacccugucucaaaaaaaacaaaaggagggggaacaaagguuauuacagaucagcucacaaacuaccaauggccauuaaacagaugaaaauauaaaacuacuuuucaucuauauaauugggaaaauucaggaagaccaauaaucugccguaguaauaguuuggcaaagaucaaguuauaagcucugggacucucuuugugguaguguaaauugguacagcucuuuggaaugcacuuuggagacauuuuucaaaauguagaauuugauccacagauaugcuucuggaacuuuacccaguaaaaauuaaauaauaagugcaaaaauauguguacaauauuucuuuuuuccuguuguaauauugaaaaacugugaacagucuugacauucaccaguggguaacugauuauuacugugccauuuaggaaaaugcccuuaaguguguaauacugaaaagaauaagauaaaccuacuauugaaaugguaguuuguaaauaaccagucuccauuaaaaggaacuagggcuccuuagaaaaauaacuguugccagaguuggugcagggaaaguaccagauggguguaggccaucuuggcuaugccagaaaguaaggaagggauggaagaaaaauagggacgucuugaagaauacaggaucaggaguggagguuuggggcauaaaacaaugauagaaaugaaugaucauccauagaauaaaauaagaauucaugaguccauacugauaaaaaucaauaaauggaaaaugaaacugucuuaccuuaguguaauauaaagugauaaauguagaaucgugaaauuaaaagaucaccaccaagaaaaccaucaggcaagagucaccacuagaggcuacaaaacuagugggugaaauucugaggaaaagcauaauuuuuuuuuaaaguaucucccuacaagauacuuaaaacuacaaaggaaaaaaauuguaauuuacaguggagaaaccugauaggcaccauguuaacaaagcagucgaaguaaauaucaccaauacugugaugagagauagacgucagguuccuucugaugugauccauugagaaggacacauuacuucucugguguuccuuucccaaauauauaacaugaacuuuuuaaugaggagacagcagacaaacccaaauugagggacagucuacaaaauaacugaucuuccaaaacaaaucuucagaaaugucaaagucaugaaagaaagaagagacugugcuguucugcuucagauuaaagaagauuaaagagccaugacaacaaaaugcagcccuugauucuagucuggauucuggacuugaagggaaacauuuuucuuaucuuuugcuauaagggacauuagugggacacuuggcaaaauuuaaauuaacuguagauuagauaauacuauuguauuguuaauuuucuggcuuuuauucuacuuugauuauauuauaaaaguccuuguuguuaggaaauagacacuaauuauuuuggguuaaaggaauaucaugugaaauucacuuucaaacaguuccaaaaaacacagugauauauauguauauauauggguguauacacacacacacacacacacacacacagagaaagcaguguaauaaaaguuaagaucauuugggaaaucugggaauucuuuuacaaucuuaggaacuauucucuaaugaaauuauuuaaauaugaaauguuacaguauuuaauaugaaaaaagagugaguucgcuguauguauucucucaugcaaaaguaucggcaauauuauugccaagguacaaaagcaaguuuugaaaguaggauguauagucuguucccauuuuugugaaaaauggauguaugaaugcaugugcauagaaacaaucuguuggccaggugcgauggcucacgccuguaauuccagcacuuagggaggcugagccaggcggaucacaaggucaggagaucgagaacauccuggcuaacacagggaaaccucaucucuacuaaaaauacaaaaaauuagcugggcaugguggcgggugccuguagucccagcuacaggcugggacugaggcaggaggcucaggaggcugaggcgggagaauggcgugaaccugggaggcagagcuugcagugagcugugauugcgccacugcacuccagccugggcaacagagugagacuccgucucaaaaaaaaagaaaaaaaagaaaccaucuguuaccaguguuuauuuuggggaguugcagaucacaugcuucuauaauguuugaauuauuuucuaacaaguacguauauguaaucaggaagaauaaaaaauaagccugcccaaaaugcugacccauuuucuugacguauuguaauugcagcacagcccucaacucaguagccccauuauuucaccagcucagucgccagcaccagcucagcuguccacccugaaaacuguacgucccucuggaccaccacuuuccaucaugccccaauuuucuagaccuuuuguccccgggcaagguaagugcacaugaaacuagucacaacuucagagaauuuaagacauccauucccagucacuugguaauuuaucuugguaauauugccuuucuauuuuccauagagcugcaucuucaccuacacucaggcaugucuauuugugaccauauacccuccuaaccuuaauguaucauugcuaauuaauaauuauuaauucaguaauuacuucuguuuaguaauuacaugaucacauuaaaaucacuuuaacuuauucuuagaauccauuccucuauaguaauaauacacaguuuucuacauuuuuucgguauuuuaauuucuacuuagaguaauauauaucaaaaguuuauccaggccgggcgcaguggcuuacgccugcaaucccagcacuuugggaggccaaugcggaaggaucacuugaggccacucaagacccugucucuagagaaacuacaaaaaucagccagaagugguggcacaugacuguagucacagcuacucaggaggcugaagcgggaggaucacuucagcccaggaauuuaagacugcagugagcucugauuaugccacugcauuccagcauggacagcagagcaagacucuugucucaaaaauaaaacagaaaaaagagauuauccaaaaauuuauucagcaaucauuuauuaaggaaauggcuaugcccuugguguauaaagaugaauaaggagaaguccucacccucacuaacccuuagucuacuuuggggagcagauaugcaagcagaugauuauaaacuaauauggaaaccauuuuauuuccuagaauuuauccuaaggauaaugcacacaaagauuuauauacagaagaguuuauccuauagcaaaaaaaauuuacaaacaaccuaacucuguacaucaaugaggaauacuuaaauuaugguauauucauacaaggaauauuauguagcuaucuaaagaaucacuaaaagggggcaauauucaggcuaggugcgguggcucacaccuguaaucccagcacuuugggaggcccaggcagguggaucacaagguuaggaguucaagaccagccuggccaagacagugaaacccugucucuacuaaaacuacaaaaacaagcugggcgugguggcaggcaccuauaaucccagcuacucgggaggcugaagcaggagaaucacuugaaccugggcggcagaggcugcagugagccaagaucgugccacugcacuccagccugggcgacagagagaggcuccgucucaaaacaaaaaacaaacaaaaaaacaaacaaacacggggagcaguauucacaauaugguaagugauuuugaaaaacaaguuacacagacauuuugaaguaguaugcagaugucuaauaagcccuugaaaagauauuuaacaucagucauuauagaaaugaauaucaagccagaauaccacuucacacccauuagaauggcuauaaucaaaaagacggacaacaccaaauguuaguaaagaauguucucacuugccaggcaugguggcucacgccuguaaucucagcacuucgggaggcugagguggguagaucacuugaggucaggaguucgagaccaaccuggccaacauagugaaaccccaucucuacuaaaaauacaaaaauuagccgggcacaguggcacaugccuauaaucacagcuacuugggaggcuaaggcaggagaauugcuugaacucgggaggcagagguugcagugagccaagaucgcaccacugcacuccagccugggcaacaagauugacacugcaucucaaaaaaaaaaagaagaauguucucccuugaaagugggagcuaaacauugaugaacacaaagaagggaacaauagacacuugggucuacuugaggggaaagggugaggauugaaaaauaccuauuggguacuaugcuuauuaccugggugauaaaauaauaaguacaccaaacccccacaacaugcaaaauccacaugugaguauuuaaaaaauaauguugguaaagauacagagcuacuaaaauucucacacauuggcgguaagaguguacagugaugaaaccgcuuuaggaaaagguauggcaguuuccuaagacuuuaaucauuuaccacauaacccagcaauuccacuccugggggaaagagaauugaaaacauguucacauagucuuguguacgaacaucuauagcaaccuuauuuuauaauagcucaaacuggacaugaccaacauguccaucaacaggagacuggauacccaaacaaguugugcuauauccuuaaaaggguacuacgcaacaauaaaagugaacaaagcaagcuacugacacacaacaacaugaugacucuccgggucacgacguuaaccaaaaaauaagacaaaaagagaauauauucuauaugauucuaauuauaugaaauccagcugcagacaaacuaaucuguuauguuaaaaaucagauaguaguagagaugggguguggaacugacugggaagggacuggagggaacucuuccagggauggaaauguucuuuaagggggugggggaacaggguaugguuacacggacuuuuacaguuguuagaauucaucagauucaacacuuagaauguuuauuuuauugauuguauuguauguuaauuauaucucaauuuccuuaaaaacuuacacacacacauaugcaugagucagcccacacauguagaagacugaaaagauagacaccaaaauguuagaagugauggaauuaccagaguggguuuuguugauguugguuuguuuguuguuguuuguuuugagacacugucuuauuccaucgcccaggcugcagugcaguggugcacuuguggcucgcuacagccuuaaccuccccgggcucagaugauccucccaccucaaccuccugaguaacugggcuuacaggcacaccaccacaccuggcuaauuuuuguauuuucgguagagacaggguuucaccauguugcccaggcuagucucgaacuccuuggcucaagcagucuccccaccuuggccucccaaagugcugcgauuacaaaugucagccacuacacccagcaccagggugguuuuuauuuucuccuucguaauucucuaucuccaaauuuucuacaaaacaaauuccuuauuaaauuuagaaaaaaggcuaugcgcaguggcucacaccuguaaucccagcccuuugggaggcugagguggguggaucaggaggucacgaguuugagaccagccugaaacauggugaaaccccgucuccauuaaaaauacaaaaaaaaauuagccgggcaugguggcgcacgccuguaaucucagcuacucaggaggcugaggcaggagaaucgcuugaacccgagaggcaaagguugcagugagccaagauugugccacugcacuccagccugggcgacagagcaagacuccaucgcuaaauaaauaauuuaauuaauuaauuaauuaauuuagaaauugcauauuuuaaaaaaauaaauugaaacaguaugcgucauacagucugguaugaaugccgcaggaggaacaccuagcccagccuauuaggaggggucuuuguacugcugacuauaaucuuaucuccauauuugaaaaaaauuagcuggacaugguggugggcaccuguaaucccagcuacuuaggaagcugaggcaagagaaucgcuugaaccugggaggcagagguugcagugagcagagauggugccacugcacuccagccugugugacagagcaagacucugucucaaaaauuaaaaaaaaaaaaggaguuauccauuagauauaaauguuuguauacugaaauauuuacaaguaaaaugcugagauuugcuuuaaauacuucaggaaaaacaaagcaggggugaucacaguugaaccuggaugauagguacauuaugcguuucuaucuauacuuuuauauacuugaaauuuuguagaauuaaaagguuuuaucuuuuguugaaaaaucuuaggugucuuuaucuaggggauuccagaauuuuuaagcaauguucucuguauucuguuaaugcuaaguuuuugagccucauuaaauuuuuaaaauuucauuauuguagcacuuaacucugacuucuuuacaacuauuuucuuuucuuuuuuuuuuuuguuucgagacggagucucgcccuguugcccaggcuggagugcaauggcaugaucuuggcucacugcaaccuccaccuccagaguucaagcuauucuccugccucagccucccaaguagcugggauuacaggcaugugccauacgccuggcuaauuuuuuguguuuuuaggagagacgggguuucaccauguuggccaggcugaucucgaacucugaccucaugauccgcccgucucggccucccaaagugcuggaauuacaggcgugagccaccgcgcccggccuucacaacuauuuuuuauacaccuucacacuucacuuugcaucucugaucucagugcuaaacccccaugucauaucugcccuuccaucuauagguugggaaagaguaugucaugcauauguccugccagggagcugcccaggcaucuucacuguguucacccggaaggagccuuguggaauggcaagaaguccacaccuugcugcuuucuguuaugaagcucucaggagaagggguguacaguuuccugaggaugcuuuccuagcaccuacugauaacccuccuccaaacacaaaauguacuaaauuugagaacuuaaaauaaaugaaaauguaacacaaaaaccuuauuauccaagacaaaguuuuugcagucagcauuuauuaagccuuugccgugugaugacuucaggcuuuccugagugauagaaagcaauuggaagaucuccauccucauuaacccacauuuacugauuuaggaagggaauacuuacgaauaaugacacuuaagaacuacacaacuuuuucugaacagguucaaauuauaaaugcaaauuucacuuaaagauuaagaagagcagacuuaagaccuaggauguacaacuacccauugguuaaaacuauuaaaguguguuugaguauauguaaauguguacaugcauauauuauaugcauaaauuuuuagcaauuaauagugaauuggggagauaaaaacuuaauguuuauccagaguuucuuccuuccucugaaagguaagauuuuaaucauaauagagugauauggauuucagcaccucaaaugauuggcauguguauuguaguuauuuugguguauuucauacgggauguuaggauuuagugucauaguuuucuuagauucuuccucuuccauaucuucaaaguauccagagaaguuucucuccauccugucucuauucauguaguuccuaccaugcacccuccuuccuaaccacuguuauuaguccuuaaucuuuucagaauuuugccugggcucuuaaaaggauauguggaaauuuuuaauucuuguuuaaaaugucauuuagccaagcaugguggcuuguaccuguaaucccagcaacucaugagguggaaggauugcuggaggccaggaguuugagaccagccuggucaacauagugagacucuaucucuacuaaaauaaaauuagccaggcaugguaguuugugcuuguagucccagcuacuugugaggcugaggcaggaagaucacuugaacccaggaguucaaggcugcagugagcuaugauugcaccacugcacuccagccuggguugucaacagagcaguacccugucuccaaaagaaaaaugucaguuaucuauacuuuuuuuaugccaccauacuuguuuccccuguucaucuuauuuugaacaauuagaaaacucuggcaaguacuuuuuguuuuauuuuauuuuuuauuuuuuugagacagucucucacuccgucacccagucuggaauauaguggcgccaucucagcucacugcaaccucuaccucccaaguucaagcaguucucaugccucagccuccugaguagcuagaauuacaggcgcccaccaccaggccuggcuaauuuuuauauuuuuauuagagaugggguuucaccauguuggccaggcuggucucgaacuccuggccuuaaguaauccgccugccucagccucccaaauugcuaggauuacaggcaugaaccaccgugcccggccucuggcaauaaaauaaaauauuuuauugacuuucaggagauuccagguauccauuacuuggccagccacugcaguacaauccuccugcuguucugcacggacacauuccaaaccaacagguaggaaagacaacuaaccuccuaggcuuuguugcagaacaucauagcucccucagaguguaaggggcaacccugagcccaccuguuggcacugcccaagaagagcucugugccucagccaguugguuuacacagauuaucacuggcuccaucaggagcagagcaaaggagaagauggugugcugcuuggcagagcaguaauucucuagugccacccaaagacaaggcaguggcuagggauuggggcacucuugcuaaugaaggaccgucagcaagugaucggucauaaugaaggacaggaaugccacugccacaggcagaauccagaaggccugggacugauuuucuucugccagagugcaaaacccaaacuaaagguguuuugguguuaauuuguuaaacauccaaaguguguuuuucagcauuauuaacguuguuucucaacuauuuguggguuuucagggucagccuggcagcaggcauggaaaccgaggaaggagacaagcuaaaaaagcugcauccacagaccuuggagcaggagaaacagguaugucucugaggggcaacuagaugugggucugcaaacuggugacagucuaaaaauacaccacagcacagaaauggguuuuccucuuccuagaauccugcaaaaagucauaauuuuugccaucucugauuuaggguucuuggauauguuccuaugaccuugugucauuugagaugugagaguauauaugguaagaugcagguagguuuaggagggacagaggggccacagggaaaugugugagaggaacaaguagagugaaacucuuagccucuuaguucuuugagaaaggguuuguccuuacauccaugugggagaaagucugagugaacaaauauguugccucucugugguaaaguaccuucaaguuuauauuuuaacuuucuacucagcagccuuguggugugguuagggcaagugcuuuuauuuuauuuuacaauggaaaugugaaguucagaaaaauguuugagaucaccuaauuuagagaagccacuguacaaugccucuuuuuauuugugcaacuaccaguaaagacuaugacaucaguagcuuaauuuuauuuuuuuuauuuauuuauuuauuuuugagauggaguuucauucuuguugcccaugcuggagugcagugguguagucucagcucacugcaaccuccaccucccagguucaagcaguucuccugccucagccucccgaguagcugggauuacagucgcccaccagcacgcccagcuaauuuuuuguguuuuuaguagagacgggguuucaccauguuggucaggcuggucucgaacuccagaccucaggugauccacccaccucagccucccaaaguacuaggauuacaggugcgcccggcucaguagcuuuaacacuauuagcccucuauuccuugccuaucggguaaguaggaaugauuuaaaagauggaugucccuggccggaugcagugccucaugccuguaauccucucacuuugggaggcugaggcagguggauugccugaacucaggaguucgagaccagccuggccaauauggugaaacuccauccgucucuacugaaaacacaaaaaauuagcugggcaugguggcgggcgcuuguaaucccagcuacuugggaagcugaggcaggagaaucgcuugaaccugggagguggagguugcagugagccgagaucacaccgcugcacuccagccugggagacagagucagacuccaucucccaaaaaaaaaaaaaaaaaaaaaaaaaaagauggcccuaacaguuuuaauuuuguguauucgaauggucauuucccaugucauauuugggucugcagugcuuuuuuacccaacuuuuuugguaacaggaauguauugauucuguaccuuuucuauucuaguuguugggaaggucuuggaaauuacugaacuaccagauggaauaacucgcauggaagcugaaaagcuuuuuggggaacucuuuaaaauuggcgccaagauccgguggcuccgggacccccagucccaaccacgucgucacccccucugcuguggcaguggggacaacacugccaacccugaacgcucuaaacccagugacuuggccuccaccuacaccgucuuagccacauuccccuccauuucagcugcacagaaugcacugaagaaacaaauuaacucaguuaacaaguuuaagcugagaacaagcaagaagcacuaugacuuucacauuuuggaaagggcaaguucucaguaacagccaccuuuggacccuucgccuuuaugguuccccugcccucucccaucuuugauuggcuugguauuuggagcuucuguuaacauuauagagacuccuaggauguguguucauggcauuauagcuuuugaagaaaggccagugauccagcaaagggggaaaaauaugcauuucaccccacaugacuaggaauccacaucagaaugauacagaguuagcagguuuuucuaaggaaaugccauucaaaugccuccuaacuuuuauaguuauuuuguuuuauauuucuaaauucuuguaucagauccaaagcucuauuguacagcaaauuauucuucaaaaugauuauaaccaguugcacccuguauuucuuuuugcagccagcacaaugugacccaacuuaaaauuugggggaaaaagaaugcaggagugaaauaaccaagucaaaaccauguacuaucuccuuggggguuagggaugcuaagaagagcccacaaauagaggauuacucuuccccugaaucucuaaacucagaaacaauuaccaaaaaauacauaacucuuccuuguagggcccuuuccuuauucauuuagguagugugaacauuaaguauaaaauaaauuauguucuuaaugccucuuaaaccacuuacauucaaaggggaacagaaaucauucuaagcaggaaaauacuuccacuuuuuuuuuuucaaguaucucucuaauaacuaaaugccacuuauuugcauucuccuuguggauuuuuugucaccuaaggaaaugcauuugaugagugcuggaaacuucuuaagugcuuuacaguuuguuuucauuguuugcagcggaucacuggacaucaaagauucauugcacuuaugaacaaggaaccuucuuuucaauuucuguguaauuugcaaggcuguacaaugugugcugaugcaagccuuuuucaguucaagagaauaaauguuuacaaauaua

SEQ ID NO: 191144 - RNA, 81018 nt, Homo sapiens
guacaacucggacuugcuguugcucgagccgcgucugcacgggucucggaccgagcggagcucgcagccucggucccggagcccaccuucgccucgcccuugcccagccugcggugauggaggcggccaccacacugcacccaggcccgcgcccggcgcugccccucgggggcccgggcccgcugggcgaguuccugccuccacccgagugcccggucuucgaacccagcugggaagaguucgcggaccccuucgcuuucauccacaagauccggcccauagccgagcagacuggcaucuguaaggugcggccgccgccggugagucacgccagcaccccggauccagcucguggcugggggagggagcggggacgcgcggguccggggaggcccgaggcgcggggggcggggagccggucgccccgccggccucgucaaguuuggggcugccuagaaggucggaguugaggccgggggaggaagacgggggcuucuccagggugggagaugaggagcgugggagaaccgggggcuucggcggugccaugggagggccgggucgccgcggggcucgggcggccgggugcggagguucggguucgguuccggauggagugauggcaggagccggggguggucgcgggggaguuuccucacggagccuggcggaggcgcgggcuggagggaggacugugggcccggcgaggcucggcaggcugguccucgccuccgcucccggggugcgggggugugugaugggguggggugggggugggggacuugcgaguugucgugcgaggaggaaaguuuucaauauggcggcgggagccccugguccuuugugugguggcggcgucggcccggagcggcccucaccugggcgccccacccuccagaccagggcaccccuccaccgccugguccccgggccuccaggugucccccgggccggggucaagaagggggcggccagcgcuggcugggggcggggaggagccgcggguccagccccggagcggauguuuguggggggcguuagugucugggggacacuuuuggggcggcgggggcaggacgggcggcggugggccccgaugcccgcccgcgcucccgaacgcgcacacucccggcuucuucuggcucagccgcucggcuccccggggaggccugggcugugcugguggggaugggguccgggcgaggccguguuuguaggggaacgucagacggagagaccuccgaagauuucgugcucguuucccccggcccucaggcuccgggcacugaaaggcagucacccaccgcagcccuuccagcccugucuacagcgccucgggccugggggcagugagugagggguggguguugcugaaaccauccguaacggcuccaacguucgcugaggagagcccggccaacuccuuccuccguggccggaacugggugcgcuccuacaccccuguuuuuuuugcccaccuuucgggagggucugaguccgaguuggccuaagcggcgguuggacgggcugggaccguugggaagcggguuuaacugccuuuccugcuguuuaagaaucuucuccccacucucuucccccacccccacuucuaaguagaggaagaccccuucccaccccuuucucccuuaagcuugcuuuuuguaaugacauuuugaguuguagggauucuguuuguaaucguuauguuuuggaaagcuguuuucagggagaucccugaaaauaaggcuucuuaacccuucccugccccaaauuaaaacacggacaccuacuuuaguuuuucuuaagcaaguuugaaaauggagaugaaauacaugcuucagaaaauaacuggccagcgaauaugagggaaauguuugaaaauagauccauuucuuacagcgaagugggcaagguugauucuugcugcuuaagggaaguacguuucucuuagugcaaagaggccugcagaaguuauaacagggcugguuagagccaagguuuuaauucuugaauaauaggucauguuucacacuguaguaauguagcuucaugucacaugcuaggaagggugaauaugaauauugcacauuugcauaaugggauuuuauucagaaauuggguaacuugacuaaguucuuaguaaccaaaacguggggagucagguuccugggagguguccuccauguugguauugugguauaccagggcugggguaaauccuuuaucuuguuuucuuguucuuugccuuuuagagggcccuuuuucugaaaagauaguguugcucugguuaggcuuggcuacccauuuccucaucuuggcuagaauauuaaugguaaucuuugcaaaaugugugaucgaauugccuuuuucucacucugaaugucagacagacaugauggccaccauuuuguauugagagugcuacauaguacagccugaggaaagggguuaaagaggcaccaauaaucuacaaauacaaccaguacucuguuuggagaccuccuuuguguggaggggacuugcuuccuccuuuguuuaacaaacuccuuugccaaauggaaagaguuugagaguauuuguuguugauauaaccacaaaaagggaaaucuuuccagaaguuguagcucuugaagaggggucuuguuggaacaaaggcuucuuaagagauguaaacagucuuuguuuuagaaacuguuuuguuuuugggaaagcuaacugugaacaagugguuucauauaguugauauauagcaacaaaaaaacccuucaagaagugugaaauauuuuccauggugauauauauaaugucuguauuucuggaugauuuuuguucaccgaguuuuuggaacacaaaugguuauauuagaaggggaauuggaacuauugguauuuuacuuguuagaagguaaggagaaguauaaaacauuucugucuccuuuuguucuuaccuuuguaucuuuaccaaugguacuuaauauaguuucaguuuauagcugcuuucucagugagacucccaaacugcuuggcuucugaaaacuuagaguacuuacauuauuuuguauauggcagcuuagggguucucagaaauuugaaaauauaguaagauaaaugugagaaaacgugauuaagucaagaagacuauacuucaaaucugaguuugaaguuuaauacaaaccuuuguuucaaauuauaucaacuauguaggauaaccaggcuuguuuucuggaccaaaaccuucuuaaauuuacaauucaucuggcuucugguuuugucaccuuuaaaaugcaaauuuuuaauuuccuccaugauacuguacuuagaugucuguuuaaggacaaaugauauuuuuccauaucacuuugugguauuuggagaugaguaauuuuaaggguguaacuauuaggcagaaaaauaguuggcugcucaguaaauacuuuuuugucucccaaauuuugauaggaauauauuuauggcuuuaguaacuuauuuucuugcuuucaaaugucucacauuuggccauagauagauuccacaaauuucuuuuuuuuuuuuuuuuugagacggaauuuugcucuuguugcccaggccuggagugcaguggcucaucacaaccucugccucccgaccucaggugauccaugcgccucggccucccaaagugcugggauuacaggcgugagccaccgugccgggccuagauuccacagauuucuucuuuguguccggagaagguuuaaaucaaaccccagaggccacaagagacaaaaauuuuucagcuuuaacuucuugugguuacuaguuugauuccuucaucuuuauagccaaguguaaaacugcccuuaaauguuuuaauacagucaccauuuuugagugagccuguugguuccacuccuagagaagagggaggaacuuauacacuucuuuguaugguagaaguguuaaugauauggagcucauuuacucccuuuccagcguaucauucucccuaauuugggguuugaucgacuuaggccuaacccucucucuguuuucccuauuucuuuggugucaugaaaucuuucccuacuuguaucuuuggccacuuuaagccuuuaacguuuagagaagaggcuuaucaguagaaacauccuugagcaaaggaagaacuuauaacuacuuaaaaaaaaaacccuuuuauugaaauauaccauacaauucacgaauuuaugauguguaauucagugguuuuugauauuuucagaguuguacaaccaucaccacaaucaauuguagaacauuuucaucucccucaaaagaaacccugaacucacuuguaacuacuuuuuuuuuccuuuuuuuaaauuauacuuuaaguucuaggguacauguguacaacgugcagguuuguuacauauguacacaugugccauguuggugugcugcacccauuaacucaucauuuacauuagguauaucuccuaaugcuuucccuccccccucccccgaccccuaacuaccuuuuaagacaaauuuaggacuauaaugcccaggagaaaaaccugguaggagguuggauuaaguccuacaguucuaggccacaaaugucuaccuuuuuuuuuugagauggaguuuugcuguuguugcccaggcuggagugccauggcgcaacgucauguugcucacugcaacauccgccucccggguucaagcgauucuccugccucagccuccugaguagcugggugggcaugcaccgccacgcccggcuaacuuuguauuuuuaguagagacgagguuucaccauguugguuaggcuggucuugaacuccugaccucaggugauccacccaccucggccucccaaagugcugggauuacagacgugagccaccgcaccuaggccacaaaugucuaccuuaaagcuaaaacaaacuucauuuguuguaguuauugaauggguguuuagcuaaauuugacuuugccagugguaaauugggcacauuaguagccacaaacauaucuacccaguuguaauucuuagugaacuaauaaacaaaacguguagacuuuaagaauguaaugugaaugauauugcaaauaugagucagcuaaagauuugaguccccacccccacuggaaaaauuuccuucccuuccuaugguuauaggguaugguuuuaaacaugcaaucuaaacuuuuaaaagagcgaaaugaguagagaauuaccuuugaaaaacauuaauaaacauucucuauuaaaagccagggccugaaauuuccuuuuuuuuuuaaucucacucugucauccaggcuggcaugcaguguugcaaucaaggcucccugcagcuuccacuucuugggcucaagugcuccucccuccucagccucuaauaaauuguagggaugcgguuucucaguauguugcccaggcuggucuugaacuccuggcuucaagcaguucucccgcuuuggccucccaaagugcugggauuacaggcaugggccagugcaccuggccugaauuauuuuguugagacacugauaagaaaaauuaagagaaaauuauuaaaccuuaauuuuauucuuucucuguuucuaggguaauuuucuuuaugaccuguuggccuagacuuagaguauuagaguauuucagguugauagauuagugaaaaauguguuuacugguuuacauuuauaaguggguagaaaucugccagugggggaauuuucucuuggguaaaaaaauacagggcugggcauaguggcucgugccuguaaucccagcacuuuugggaggccuaagugggcggaucgcuugaggucaggaguucaagaccagccuggccaacauagcgaaacccugucucuacuaaaaauauaaaaauuagcugggcaugguggcaggcgccugcaaucccagcuacucgggaggcugaggcaggagaauugcuugaacccaggaggcagagguugcagugagccgagaucacuccauugcacucuagccugggcaacaggcucaaaaaagaaaacaaacacaacaacaacaacaacaaacaacaacaacaaaaaaacaguguaaacuauuugauuaaaaaaaaugaacccuguuuaaaugcuguaaugggaccuuuuuguagacuuuuguaaccuuucauuguugccuuaauuggaccccauuaagguuggcuguagaaaaggauaagggaaagcccgugccccuaaaaugaaagugcuaauuagguuucugguguucaggguuuuuugaagccuaugcguguacuucuuuccaaaugccaucuauagguuugaaaaacuacuaaccuaggaguaccuugcuuucauccuuggacaguccucucaguguugagauuguugugcaauuuuuuuuucucuaagagaauuugguauuuucuaauauaccuguuauaguacagaucauuggcagccucaaaaaaaaaaaaagauggaaugaagguugggaacuggagggcuacacauucucaaauuuaaguuugggucucuugaaggggacucaccagagggcguaccgacaagucucuuuggggugagugggugggugaguugauaccuugggaaagccauauucuuaggcugcugccauugacuuuugauuauuuaaaguuugagauacuaauaacuggauuuauaaaauccagauugugagaaacuuguuuuagacauaagaaugguaugcaauugagaaguauuucuuaaguauuuauuaacugcuguguccuugcaugggauuaaagaggaaaaauuaauaugaaaauuaaaugaaaauuguaaauaaaaauuaaaugaaaaauuaaauuguacacuuccacaaauucauucagaaauguuucuuuuucugucauuauuagaugaauucuuugaauuugcuuuuuacaaccaaguuuaugaaccagauuaaugaagaaaagaugucucuaggacagugaggcauuucaguuccauaauuguaggauguuuggaacaaagaugcagaauuugacuggaaugcauucuuuuaaguccucuaccccccaccaugauuuaagacacucaguccuuuaacuguagaccauccuucuuaaagcaccaucagcauauaucuuuacacauggccuuagagucaucccauaugugcugcugcugcuuuuuuuuuuuaagcauuuaagcuuucuuucggauauaaaaacuaaucauuuuguucugccagacccgucacuucagggaguaaauuaaaaaauuuuauuacaaaaaaugugaagcauacacaaaaguguaaagaauaguuacuuuagcuauuuuccuggauagaagagcagaaaguggaguagcagcauuggaguugagacaaaacuagggaucuucauuuguaaagaacagcuuagcuuagcuuuuguccuauucagguuauaagugacauuugggcaauuaugaggugagcuuucuagccuucagucagugauggucauuuugcccaauuagguuggggauaguauuucucaguuuuagucaauggcuuuguugcuuuguuacacauuuguugggacaugucaaguaacuugaccagcugcaggucuguuggcacauggagguguuggagucgguugguggguggagguuagucucugcuaacaucacuucauuucuuuaucuguucauuuuuguauuggccagacuuuaucugaacuuucuuuucuuaggaaggggccuucuggucagaguggguauuuagccugacaaaacagagcugacaucaguaguaaccaagaaacagaaugauguucuagccaggcaugguggcucucaccuguaauuccagcacuuugggaggcuccaggcaggaggaucgcuugaggucaggcguuugagaucagccugggaaacauagugagacccuaucucuacaaaagacaaaaaauuagcugggaauggugacgugcaccuguagucccagcugcucgggaggccaaggugggaggauggcuugagcucagaaguuccagguugcggugagcccugaucacgccacugcacuccagccugggcaacagagcaagacguuucaaaaacaaacaaaacaaaauggcugggugcgguggcucacaccuguaaucucagcacuuugggaggccgaggcagguggaucaugaggucaagagauugagaccauccuggccaacauggugaaacccugucucuaccaaaaguacaaaauuagcugggcguggugguacgcaccuguagucccaagcuacucgggaggcugaggcaugagaaucacuugaaccugggagguggagauugcagugagccgauaucgcaccacugcacuccagccuggugacagagcaagacuccgucucaaaaaacaaaaacaaaacaaaagucccuuucuggaaaagaaguuuuagggaaaugagaauuugaagagucugaugaauuacuuguuagauuguuagguucaauuuaaaaauuaggucauuggaaaauauuuucuauuaaugucccuuaaaaucuaaagacuucucccugcuuccuugaaauaauaacuucauuucugagauaggagaugccaccaggcagguggucacauaaugaccuuuuagaacuuguugauuucauuucacaugguaaucucuuguaaaaugcugugaaauuuaacuauuauuuugcagggauaaaaaagagguuuaucaaggggacuguguguauguauauuuuuauuuaucacguuuuuuucuuuuuuaaaaauuacuuuuuuuuuuuuugagauggaguuucacgcuugucacccaggcuggagugcaugcaguggcgugaucucggcucaccgcaacuuccgccucccagguucaaguaauucuccugccucagccuuccuaguagcugggauuacaggcaccugccaccacacccggcuaauuuuguauuuuuaguagagaugggguuucuccaucuuggucaggcuggucucgaacucccgaccucaggugacccgcccaccucggccucccaaagugcugggauuacaggcgcgagccaccgcgcccggguuaaaauuacuuuucaaaagccaguuccucuauuauguaaaagaggacaggagggguauuuucuagauuuuaaaaaauagguggguagagucuucaaucuaguuacaucaugaccuuggacaaagucauuuuucugcaacguaugcuugucaucugcucuaaggggaucugacacugaccuagggcugcuguccagacuaauuaauugauggauugcaaggagcuuaaaucccaaagcuuuauuugcucauugcuaagaagagucuggggacagauuuagugagacaaggguuagugccaaguacacaucccucauuuucccauauagugaagggauuuccccuugucccccggggacagagucuugcucuguugcccaggcuggagugcaguggugcaaucauaguucauugcagccuugaccucaugagcucaagccguccucucaccucggccuccugaauagcugggaccacagguauacaugccaccacacccagaauuauuauuuuuuuuuagggacagggucuugcuguguugccgaggcugguucgaacuccuggccuuaagccauccucccaccucagcuucccaaagugcugggacuacaggcaugagccacugcaccuggcugugaagggauuguuuucuuuuuuucuuguuuuguugcccaaacuguaaugcaguggcacaaucacagcuccuuggagccucgaacuccugggcucaaaugaucccaccucagccccccauuuaguugagauuacaggcacacaccaccaugccuggcuaauuuuucaaauuuuuuuguagagauggugucucacuauguuagccaggcuggccaugaagggauguuuuaaaagugaaacuugaaaaggcaaaccgcaccccgcaaccccaaaaaaaggcaaaaacccaucaucaaaaccagaguauagccagcauaguggcucacaccuguaaucccagcacuuggggaggugcaggugggaggauugcuugagcacaggaauuugaaaccagccugggcaacauagcagacccuaucuguacaaaaaaaaaaaaaaaagacaaaaaccaaucgaacaaaaaaaacccuagaauauauagacuauaauccuucaauugguuuagacaaagcuuuucugucccugaaucuuuauuuuuuuugagacagggucucacuauguugccaggcuggagugcagcaugaugugaucuuggcucacugcaaacuccgccuucugggcucaagucauccuuccaccucagccucccuaguagcugggacugggacuacaggugcauaccaucaugcccagcuaguuuuuguauuuauuuuaauagagacgggguucaccaugcugccuaggcuggucuugaacuccugagcucaagcaguccaccugccuaggccucccagagugcugggauuacaggcacaagccacuaugcccggccugucccuaaacagauuagugagauuaacauguuuuaaaagguagagcuguuaaaaauuauuucagaaaauuugcaggugcauuugugugucuuauguagugcauguauauaggcaggaguuuaguuuggugagauuuguauuaagaaggguuuacagugauuuaaauuuccccuaauaugggaugacugugacauuguggaagccacgcaaauagaaggauauuguacuuacuaacauaauuuaaauaaucucaauucaugucugacaggaggggucaauaguugaagucuaguaauuuugcaauuauccuacuuguaaaguggggagaaaaguagaaguggcaggaaaaauguuuaccuagaucuuuuaagaaaauauuuuaggacaagagccaccaucauauuuuauucuuuuauuuauuuauuuauugaaguuaauuauauuuagacuuaaggaauuaacaaaggagcagggagacuagaccaggucccaggauaucuugacuccuuggggcaggcccagcuacagcaagcacagagggaaacauaggggaggggcagauagcagauuuggucuugaacuuggaggguaggaaauggaugauccccaggauggaagcagcaggaggaagcugugucugaggauggccugggcugcccagaggggcagccuaccccuggaccccuggggcuguugcacagcgggaauggaaacaaggauccuccccucagggcugagggguucagucccuccuccccucuuuccccaucuguuggagagauggggguccuugccuccuugccccuuugaauggcccagaugcugguccugauugagucucuuuaagagacuuuugcugaacucauaaguggugaucgugauagcauaggaggggauagacuugaugauccaagggaggaagccugcaaagagcccucugaugcccgacuuggcacagauccaccucugagcaaccagguagaguccgcauccagggaugucacuuccacggcuuccaucacuccgaguguggccugguguugagucuucaucacgacaaagguuagggucagcacuguagccagcaucauggugaugcugccagcugcaaagcugacuccuaugguugucaugggaccauggaguuccuuuggccugagcccauucagccagcucuucacuagcucguaguugaaccaguacagggcugagaagggcacauuucuaaggagaguggggccccggcacagccacagugagcaccaaccacucuaagccaccggagcucaaacacagguaccagcacauaguauaacauaugcuaaaccugcagcuuugucugcauaagcuccagggcacugaugauugcagugauagugccaggguggaccagcacaccagcuaccaagguuauguagagguaagggcucagccacacaggcaggccuugaguugguuguaggcagugaaguaguuggugguagcuggcacagucaucaccaggguggcugggaggccacuccacaggguccuggugcccuugugccucagaaucuucacagaggcauccaaggugccagugaagcugguagggucuuaaaaccagguggcacagcggggaccauuuggucauagguacagaggcuccaggacaccauuguaguacaggauuggagagaggagggcagcuuggcauaagagaggcucugaagucuggaggaaggugucagcucacuggccaccagcgggcacugaggcugcaaauggaccuuccaccauguccaggggugucacgaggaaggaggugaccacagcccuugaaacgugagaccaccauuuguuggagggagcuaaugcccccagaguccugucagucaucuugcagcuucaguccuagcucuagauuggugcuuguacagugcgaggcuggucaggcccauuacagcucuguggccucaccuugcaccaagacugacucccuguauuuuacucccuauauuuuauuauuuaccaacaauuagacaaucuucaccuugcaccaagacugacucccuguauuuuacucccuauauuuuauuauuuaccaacaauuagacaaucuuauguuaaaaaaaaaaaguuaauuaggaccccuauguaaucauauaaacuuaaauuuccuaguuuuuuauucaaauauaucuucuguuauuggaccucauaacauugccucuuagguaaacccauguagagaguaguccccucuuuuuuuuuuuuugagauggagucuugcucuguugccuagguuugagugcaauggugcgaucucagcucacugcaaccucugccucuggguucaagugauucuccugccucagccuccugaguaggugggauuacagcgacgugccaccacgcccaacuaauuuuuguauuuuuaauagagaugggguuucacuauguuagccaggcuggucucaaacuccugaccucggaugaucugucugccucagccucccaaagugcugagauugcaggugugagccacugcgcccagcuucuaguagucuccucuuaucugcagaaaggaaaaccacggauagaauuugucaacugcuguccaaaaauaggugaggacaguacaauaagauauuuugagagaaagacuacauucauguaacuuuuauuauuauuauuuuuuauuauuuauuuuuuggagacagagacuuacucugucccccaggcuggagugcaguagugugucucggcucacugcaaucucugccuccugggcucaagcgauucucaugccucagccucuugaguagcugagacuacaggcaccugcuaccacgcccggcuaauuuuuguauuuuuaguagaguuggggguuuuaccauguuggccaggcuggucuugaacuccugaccucaagugaucugcccgccucagccuuccaaaguucugggauuacaggugugagccaccacacccggccccauguaacuuuuauuacaguguauuguuuaauuguuauuguuaaucucuaacugugccuaauuuauaaguuaaauuuuaucauagguauguauguauaggaaaaaaacauaguauauauaggguuuaguauuugcuauccaugguuucaggcauccacugggggucuuggaauguaucccuccagauaaggguggggacuaccauaugcuacauuucuauugugacuuuaauguggauuuuuuggucuugaaucagucacuuaauacugcuuucuaaauguauuaagacacuccccaaugguauauguaccauuuaaaauugucaaaugcuuagguauuuuuguuaggaguagauagcuaggcuaagauuucuuuucccagcuauguacuuuaugugcccuuaggcagauuguugugcauucuugaguuaauuuuugccaucucacuggcuugaccaaauuguaauguucagagaacuaaagccuaaacuuaguguguuucaagcacuugauuggaacuuuucauuaagcacauauucuuauggggcauacauacuacaggcuacagauacugaaacauuuuaauacuacucuaaucacauaaccccagaaacaaagaacaaaucccuaucaagcccacauaauuacaaggucuuuaaggcaggauccucccaauuuucugugguuauaccaacucaucauuuggugacauuuaaaccagaugguaauaucucauccuugccaggcuuuaacuuggaagagaugggagguaggagcccuuaggauuuguauucuguuaucuuuauaggacaguggggaaagggguggauauaagagaaguuuauacagugaaauuugaguauuaccuccacuuuguaaaauuccaggucuuuagacuuuugccugucucagagaggcuuucauccaauaugauguauuuuggacaaauugagaacagccaccaaauuuuccagugggaggcuggcuucagggauuugugguagaguauggguuugggguuuuuaaaaauugugcuugguagcagcccacucuucuggguuccucuauaacuacuguuuuucucugguaaccuuguggcuuuucccaucuuccauuucuaaaauauauuuuugauuuauagaauauauaguugcucaucaagauuuuuuugacaagaacaaaguuuagaauuugauuuaggauucuaagauaauuugguuuugagggguaacauuagccagcuaggaaaugaaaacuucaagagaauagagauuuuguggaaagaauagaguaggaaucaaaauguuggguuucuggcauguguuccauuauuuccauguuauccuugagcuccuaaccuuaaggagggucaugacuauuuucagagcuuuauucuauuaaccuaucuguaaaaugggcagcuuaaaauaucagcccuucuuuacauagugaggcccaaagagggaaggaaucuagcccaaauccugguggagccagauuugaacuuaggcugugcagguccucaguuacugcucugaacuacugcauugccuuuuauauaaccauaguaaugauacaauugugauuucaugagaugauuaaugggaaauuaugaaucuauuauuuuugcauauauacuuuguauccugguagguucagcaaaacaaaaacaaaagcaacauauuuguugguuuuugcugcuaaggcagauccauuuuauagaaaaggaaacaaacugagcuugagagacuugacuugccuaaggugacacagccuugaaaggacaaauuggauguugcaaaccauggcucuuuauucccaaguucaguguucuucuaauuuaauauauaauggcucccuucauagauccuagaaauuagccugcuucucucuuucaucuccccuuacagucuuuuuuuuuuuuuuuugagagggagucucgcuguguggcccaggcuggaguuggagugcaauggcacggucuuggcucacugcaaccucugccuccuggguucaagcgauucuccugccucagccuccggagcagcugggauuacaggcacccaccaccaugcccggcuaauuuuuuuuguauuuuuaguagagacgggguuucaccauguuggccaggcuggucucaaacuccugaccucgugauccacccaccucagccucccaaagugcugggauuacaggcgugggccacugugcccggccuacagucuuuuuuugacuguggucuucucucucuuccuucuggccacccagacuugaauucauuaauaacaauaguaagcugcauguauacaguuaucaaaguaccauuuagauuuguguguuuuaucuacuuaucaguauuuuugaacuuagcccauucauauacuguuaguuuguuggcucauuuauauguaaacuccuggcucaucaacuccagugaccacucagcuucacauuggaagaguauuuaggacucggggcucccuauauaaauguaccacugccucccauuaaagucauucugggguucaucccagaauaacugaauuagaaucucaugugggccuaaguguuugaauuuuaaaaagcuccuccggaagcucugcuagguuugagacccacugguuuagguaauuucaugacagguuuaggcagcuaauauaaggaauucucaaaaaaaaaaaaaaaaucuaaacaccaaaaucccucaaaauauagaaaacaaaauaaaaauaagaaagaaagaaaaaauaaggaauuaucuuaccuguugacuucaaauuaaucagaaauuucucaguucuacuacagaaaacugggcaauucuuuuuaucagcucuguugaaugaagaaaugaauugaguccuuggaguugguuguggucucaauucaguacuuauuauugauaugucaguaagugcauuguguuaaaguccuagguggcucaugccuguaaucccagcacuuugggaggcugagacgaggucaguaguucaagaccagcauggccaauauggugaagcucugucucuacuaaaaauauaaaaauuagcugggcaugguggcauguaccuguagucccagcuacuccagaggcugaggcagaagaaucgcuugaaccugggaggcagagguugcagugagccgagaucgcgccacugcacuccagccugggugacagagcaagacuccaucucaaauaaauaaauuuaaaaaauaaauaaaggaacucauaauugacuggugagaaagauuagcaaguaugacguaugcaaggaauagaaguuauguaccgagugguuaaagguuggggggauauggagauggaugagagggagcugucugggaaggcuuugcuucacuuggauuagaguaggguugcgugaggaaauagguguguagaaugagaaugagggucaugacauccuccuacaaaacaacaauauucaaggaaggaagagaauuugguuggagguaccaggaaauguguuguuaggaagcuaagaagaaaauaguaaguucauuguuaguauuucagacuuagguggcuuaauggugauauuucugaagucucaacucuagacacagcuguaaaacccuggaaaaguagauaauuacaguuuuuauagaguauaucccauugauaccaggcagccauucaaaagaaaaccaguuuuaucagacugcaacuuccucauauuuuaggcuaaaguggguuaucuuucaaaucaaauuuacuuuggacuauggcaauaaauuugaaagaaauaaagcauuugauaauaccagcgcuacuacagucacacagcauagucugaaauauaucauaggguaaguuucuuuuaagaucuuuugacauacuuuuaucuaccauccuaaauugagcaugccuauguauuauuaguacauccuuaucucuuuaaaguaggagaucuagccuugaagcuuggucaguauguuaguucauuuguguugauauaacuauaucugagacuggguaauuuauaaauaauagaaauuuauuucuugcaguacuggagacugggaacucuaagaucaaggcacugucagguuugaugucuugugcuggccuggucuccacuuucaagauggugccuugaaugcuauguggaagggcaaaaggggccuaggguguagguucuugcaacucuuuuauuuauuuuuauuuuuauauuuauuauuauuuuuucuuugagacagagucucacucugucacccaggcuggaguucaguggugcagucucggcucacugcaaucucugccucccagguucaagcaauucuccugccucagccuccugaguagcuggaaucacaggcgugugccaccacgcccagcuaauuuuuguauuuuuaguagagaugggguuuugccauguugaccacgcuggucucgaacuccagaccucaagugaucugcccaccucagccucccaaagugcugggauuacaggcaugagccauggugccuggccuaauuuuuguguuaaauauguuuuguagagaugagauuuugccaccuugcccaggcuggucucaaacuuccaggcucaagcaauccacuugguuggccuccaaaagugcugagguuacaagcgugagccacugcccuuggccugccauccauccauucauucauucauucauuuaugagacaguuucacuguuguugccaaggcuugggugcaguggcgugaucucggcuuaccgcaaccuuuaccucccgaguuugagauucuccugccucagccuccugaguagcugggaauacaggugugugccaccaugcccagcuaauuuuuuguauuuuuaguagaaacaggguuucuccauguuggucaggcuggucucgaacccucaaccucaggugauccgcccgccucgcuggucucgaacuccagaccucaagugaucugcccaccucggccucccaaagugcugggauuacaggcgugagccacugcacucagccuuauuauuauuuuuuagagaugaggucuuguguuucccaggcuggaaugcagcagcgccaccauagcucacugcaguagaugggacuacaggcacgugccaauaugucuggauaauguuuuaacauuuuguagagaugguaucucacuguguugcucaggcuugcuucucuugcucucucucucugucugucuuaagccucccagguagguggaacuacaggugcaugcuaccaugccuagcuaauuaaaaaaaaaauuuuuuuuauagggucccgccauggugcucuggcuggucuugaauuugucuuaauuccuuuccuuuccauuccccuuuccccuucccuuuccuccuuuccuuuccccuuuuccuuucuccuuuccuuuucccuuugccuuucccuuuccuguggagucucgcucugucacccaggcuggaguucaguggcgccaucucaguucacuugucucggcucacuuugcaaccucugccuccugggcucaagugauuaucgugucucagccuccccaguagcugggauuauaggcgcccaccaccgcgucccgcuaguuuuuguauuuucaguagagaugggguuucaccauguuggucaggcuggucucgaacuccugaccucaagugauccacccgccuuggccucccaaagugcugggcuuacagacaugaugagccacugugcccggcccuucuuucuuuaauacuauugcaaaugugucaucuuuagaugggauauugacacaacaaagauuuugccaucucguaguauuuuuugaggcucaaacugauuuuuagucucacuucuguucguuucuugacccugauguugaaucuccaggcguguguuugcagaucuaaugaggccuuaaaguuagggugugggauguuuaagcuuccccugcccuuagugcccagguagguuuggguguugcuuaggcaagguuggggucagaguccaaccucuuuccuaaaucccuucccccugacagacagaucauuuuuggaaucuuuuuaaaguauauaauccuuucuuaaccuuggcagccucaguuuucugccagaaauuuuuucuucccuggauucuagguauggaaaaaacacaaugaaaacuaguuacuagagaaccuccuuggaaaagcugugaaauuauauauacuugauuacagcauggcuugauauaggcaugcugaaguaauaugugcaccaauuauaauugauguagggggaaggaucugaaauuucuucucaucccauucagugauugaaguaucauaaaaugucugugaaugacaugaaagaaauaaugcuuuccuguuuagaggaccuaccaauaccaauaccaauaccaauaccaauaccaauacaauacagaucauuauuauugccaaguuuuauuaaaagugguaaaagaggaauuuaaugugacgaaugcuuaaaaaguaaauaccauggcauaucccuuuauuacuacuauauuuuuauuuacuaauauuccguagaaacagugcuuugcauucccaaguauuucauauucagaagcuaaaauaaucuuugaaacaaguucuuuaaaacugauagcuuucaccauggccuaucuguaaaaguuauaauacaaguucucauuccuugguacuuauuuuuaauaaugacuauuaaaagucuacaugauuguguugguauuuucagggucuuuuuggugauaggacuuuagggaagacuggguugacccagguauaacuuuucuaaaaauguugacauuguaaaaauaggcggucaauaaaucacuauuagugaauggagaauacacuugaaagggcuguguuuuaaaucuggaugaaaagaguucuuuggaaggacagauuguaugggguguucugcagggcguucaauagggcaguuacuuccagggugugggccgaggacccuuggaggguucccaagacccuuucaguggauccaagaaaacuccccccuuucagcuaaauaucugugagaggccagauuuacuucacauaauuuuuuuuuuuuuuugagacagagucucacacuguugcccaggcuggagugcaaugguggugugaucuuggcucacugcaaccuccaccucccggguucaagcgauucugccucagccucccaaguagcugggauuacaggcgcccgccaccaugcccagcuaauuuuuuguauuuuuuuuuuuuaaaguagagacaggguuucacuacguuggccaggauggucucgaacugaccucgugauccgccugccuuggccucccaaagugcugggauuacaggugugagccaccgcacccggccuacuucacauacuuuuaaccgaaacaauauaccacaccugauuggagaagaaauuaaaacccaguuuauuuauauuaaaccagacauuaaagagauuugcaaaauaauacaaugcauuacagauuaaagagauuaacucauuuuuaaaauguuucaguuuuaauuucuaaugugauaaaaaaucuauagauacaauccauguaaauuaacauucuuugagguccucaauuuuuaagauuuuaaaggacuccuaaggacaaaacauugaguuauugcaguauuaaaaagggaaacuuggucggauggguggcucacaccuguaaucucagcacuuugggaggccaaagguuggaguaucccuugagcccaaaaguuugagaccaacuuagucaacauagcaagacugacucuacaaaaaauuucuuuaaaaaauuagccugaugugguggcaugcauguauacuugggagacugaggugggagaauugcaugagcccgggaguuugaggcugcagugagcuaugauugugccacugcauuccagccuagggacagagcaaaauccugucucaaaaagaaaaagaaaaaaaagggaaacuugauucugcaaagacaugacucaguaggaauaaagcuaagaucuuagcuuuuuguauauuuaguagagacgggguuucuccauguuggucaggcuggucuaagaucuuagcuuuuuguauauuuauaaagacgggguuucugcauguuggucaggcuggucucgaacuccugaccucaggugauccacccacuucaaccucccaaagugcugggauuacaggugugagccaccacgcccggccaauauguguauuuucuaaaacuucaguaauaagccuuacauuuguauuaaaauuauuuuaaaucuauucuguugccuagcuuuugccccaauaaaagaacaugcagucaagaaguuuuguauagugggcacacaggaaauggcaugguauuagguuggugcaaaagaaaucgugguuuuugccauuuuugcauuuuugcuuuaauggcagaacugugauuacuuuugcaccaaccuaauaaaugugaaauacugcuaucauggaaccauaccuagguuugcuggcuacaguguuaacuuuuacaguauacaaguucaauuccauugccaucccagcagaucuacucucaguguguugucugccuuuacccuugaacuauauaucuaaaaaaucuuagcagcucuuuaagcauggaaaucuaacaauaugugcucuuauuuuaaaaagcaagguuggauugggugugguggcucacaccuguaaucccagcacuuugggaggccaaaguggaaggauugcuugaggccaggaguuugagaccaaccugugcaacauagugagacccccccccccaccccccgucucuuaaaaaaaaaaauuagcuggucaugguggugugcaccuguauucccagguacucuggaggcugaggugggaggaucacuugagcccaggagaucgaggcuauaacgagccaaguuuaugccauugcacuccagccuggaugaccuugucucuuaaaaaacagaaacaaaaacaaacaaaaaacaagccugcauuaggccacuuggaaacgaaagcuuugcaacaugaauauuuuccugagaaaaaccggcacuuuuuuuuuuuuuuuuuaauugggagucuugcucuguuugcccaggcuggaaugaaguggugcaaucucugcucaccgcaucaucugccuccuggguucaagcaauucucgugcucugccuucugaguagcugagacuacaggugugcaccaccacaccgagcuaacuuuuguauuuuuaauagagacuggguuuugccauguuggccaggcugcucuugaacuccugaccucaugaucugcccgccuuggcuucccaaagugcugagauuacaggcgugagccaccacaccuucccaaaacuaauauuuuuugaccauuuacuuaaauaaaguaaauguugucugaggguucuaccuguauuauuuuacuuaacccucacaauuaucccuuuauucacauacguaagguacaaggaacuuaaccuaguacaaagccgcacaguaguaccaggauuugaacccaggcagugugacuugagaaucuguccucuuugacaucuauuuugauguacaagguaaagguaaauggccucacuguguuuuaaaaaaaaugaccaucagagaaauaacaaugggaaaauauagaggagguuaaaauggagaaauacagaggaggccuuuaaccuguguuaaaguggcuaugauaaaaugugcuaguugacaguuacaugccagcuaggguuaggcuggaaggauaagguccuuaaagguaaguaagguuuagaggucagaugcuccuugaaaguugagguugcagcgcuuuuuguauaggaagauucauauuucaguggucagaacuuaacauaauuauaauuguuacuuuuacuuuacaauuuaaugaaaaaaccuuuauauuuguaaaaucaguucucaccacaguccuaaaagguagucuguacuuuuuuuuuuuuuuuuugagacaggcucucacuuugucaucuaggcuggagugcagucuuugccucccagguucaagcaauuaucaugccucaaccuccugaguagcuaggaugacaggugugcgccacaaugcccggccaauuuuuguauuuuuuguagagacuugguuuugccacauuggccuggcuggucuugaacuccuggccucaaggccugucugggccucccaaagugcugggauuacuggcaugagccaccguuccuggcccuguuuggaagacuuugaaugcaauucuuugucguacaaaacuuuucugauagacaccuaucagugaguggcaauuagacuccaucaggggcucauaaauaguuaacucugcuugucuuuuauaggaguuuauaaugguugugauagaccuaguucuaccuuuugcauuugugcagguguuuuaagggcauauuacugaccugaaaccauucauuugaugagaaaguggucuuuuauguuucauauaucuguuauucugaucuuuauauuaaaguuaaauuuugucauccucaccugaaagauuugcuaacuugcaagugcauuuauucuaugaugacuggguuucauagaacauauacaauuaaaacaaugcuuugguccuuaguugauguuauucuugguaaacuaacaagaaugugcuuuugugacacugauuucuaauugguuuugucugcagggaguuagagccaacuuucguagccucuguagagcauauacuuuuucauuuugcuaauuaucagaucucaaaaugacagccuuucuauaauuagaaggauaaaaacaguauucuaauauauuaaauauguggauguuaauagcacauccucuacagagugaauuuuccuggcauuuuuuggaaaaaucuucagcaucuuuugaaaguuguucucacagugguugacuuuauuuuuuaaacauuucucucaguuaaaucugcuuuuaguuguuguuaaguuaaugcuggcacugaggaaaauguuuaccugauguuucucaggccucugaggauuuugaagcuucaacuuucuacuuaauugccuuccuaaggaauacauuuuugaguccuaaggaaacuaauucaacuucuuuuuuuuuuugagacagagucucgcucuguccccagucuggagugcaguggugugaucuuggcucacugcaagcuccgccucccggguucacaccauucuccuaccucagucuccugaguagcugggacuacaggcgcccgccaccacgccuggcuaauuuuuuguauuuuuuuuuaguagagaugggguuucaccguguuagccaggauggucuugaucuccugaccucaugauccgccugccucggccucccgaagugcugggauuacaggcgugagccacugcacccggccugaacuuuuaaauaauaagguucuuguacuuuaucuuguaaggguuaaaauaaaacuauuuucaaguuuuuuuguuuguuuuuguuuuuuuuugagacagucuugcucugucgcccaggcugcagugcaguagcaugaucguggcucacuacaggauugaccuccuggauucaauuaauccucccaccccagccuccugauuagcugggacuacaggugcaugccaccaugccuggcuaacuuaauuuuuuuuuuguagagacagagccucaauauguuuccgagucugggcuggucucuucucuuuucucuucucuucuuuucuuguuagacagagucuugcucugucacccaggcuggagugcaauggcgcaaucuccacucacugccaccuccgccuccuggguucaagugauucuccugucucagccuccugaguagcugguuauaaagaaugagagagguauuuuaucaggcaugcgccaccauguccggcuaauuuuuguauuuuuauuagagaugggauuucgccauguuggccaggcuggauucaaacuccugacaucaggugauccuccugccuuggccuccgaaagugcugugauuacaggcaugagccaucacacucagcacccagguuggucuugagcucccaggcucaagcaguccucccccuuuuggccucgcaaagugugaaccccacuacaccuggcuuacuuucaaguuuugaaaguaaaggaaauuaaaauaaucucagugaggaauuuauauggaacugcauguaaucugcaaauucuuauuacaucuaguuaguaugaaaaggcuguuuuauguuagaaaaagugauuuaugaucaguuuuauugauagggaguacaaguuuuacuuuuuggccagcuuacauuauauuccuuuuagacacuuaagcaucaaguuaaacauuaucgcaauguuucuaaguggggauuuggauuauuuauuugacuacauaauuugaggauuauuuuucaaaauuuucaccuuagaagcuuuauuaugaucuguuguauuuaccuuucauaauggcuuccccuaccccccauuuaaaagucauggcuuggcuucugccaugccucacaccuguaauccuggcacuuugggaggccuaggugugaggauugcuugagcccaggaguuccagaccagccugggcaacauagcgagaccucaucucuacuuaaaaugaaaagaaaaaaaaauucgugucccauugaggucagacuuugccaaagguauuuuaguuccguaugauagugaacauuacaaauaaauuuaauuuuuuuauuggagucuaguuuugcagcugacagugaaugucccaaaacugaaugacauuuaucucuucucucauucuuuauaaccagaagagaugacagaguuuguagugauccauuuuucaugcaaaaaugaucuucucaaacuauuucuuuaguuuuaaacauauuuauacccacuguaugagcauccuuauugacagauauguacuaauuuccauuugaugaaucauuuucaggauucauuuuagcuuuaugcuaaaauaaguauauuguguauauauucauacauagaagcucauuuuaauuuguaaaacuuuaauauacaggcuuuugagaacaucaaauaucuuuauaauuguguuuugguauuagaagguacauuaucugaucaaucagggaauaacauuauauaucaccuguaagucuuaguuguuaaaauuuucaggccauuuugaaaguauguuaagacuaaauauuugaacauuuacuucuauauucugacacauuauuuuucauaugcuuuugaucucagcuuaacccagaucaauucauuucugaaaaccaacagcuuuuauaacacacuggaagcaaagcucugagcaauauaaaggcuuccuguuagccuaccauagaauaucaagaagcagugugauuuccuuuugcuaggauguguucuguauaaauuaaacacauuacuuuggcuuuuaguuauugagcuaaacaaaaauaaaucagacuuuaaucuuuuucacuugggauggagguauuuuuuaacuuuaacaaaguauaguauuuuuuaacugacauuuaaaacauuaaccauaaaaaggcaguacaacuauguuaaacauuugaaggccuuaccgauaauuaccuuugcuuuuuagcuuaacauuuuaucaugcaucaccggcgggcauuuuuauugaagucuuuguuaucacuaaaacaaaacaaaauuucauuuauguauuuauuuuagagcuagguucgugcucuguugcccaagcaggagugcaguggcacaaucauagcucacuguaaacuuaagcccccugggcuuaagucauccuccugccuuagccuccugaguagguaggacuacagguuugcaccacuaugccuaauuuuuacauuuuuugguagagacggauagagacuggucucaaacugcuagcuucaagugauccuccugcugcugcagcccaaagugcugagauuauaggcaugagccacugugccuggccgucauuuuuauucuaaacuaaaagcagucuauaaugauaaguuccaacagcacaaauuugaaauguuaaaaaagccucuuuucuccuuauuauugugauauuauuuaaaaucugcauauguaaaauucaacacaauguuauuagguuggcgcaaacguaauugugguuuuugucauauguauauguagguaauggcaaaauuacagcuuuugccacauauauauguauuuuuuuuuuuuuuuuuuaguaauggcaaaagcugcaauuacauuugcaccaaccuaauacauguuuuuguucuaguuuuuuacucauugaugcuuggguaucuuuccauauuuagaauaucuagauauuuuuuauuauagcugagugguauuuuauuguugguuguagauauaccaacauuuauuuagcuuuuucucuacugauacuuacauuuuaacuugaaggaauuuugcagugaauuuccuuuugccuauauugagguguugugagugguaauagauauuuguaaauuccuaucagaaaauugcugggucauggccaggcgcaguggcucacgccuguaaucccagcacuuugggaggcuuaggcagguggaucauuugaggucagguguucgagaccagccuggccaacauggugaaacccuguuucuacuaaaaauacaaaaguuagccaggcaugguggugguacaugccuguaaucccagcuacuugggagacugaggcaggagaauugcuugaacccgggauguucaauucuugcuugcagugagugaagacugugccauugcauuccagccugggugacagcaugagacuccaucucaaaaaauaauaauaauaaaauaaaaauaaacaaaacugcugggucacaaggcaugcgcuguuaaucugauagcuaaaaacaaugagaguuuguauauuucuugaauuuugagugaaguugggugccagucuuaugauuggccauuuuucccuuuuggcuguugauacaauuugcccauuuuucuguaaguuauuauuuugucuuauugauuguuaugaacucuuuauaaaucuagcacuuuuaaaugcuguauaauauucaauguuauuguaauaccauaauaaucguacauuccuaauguaaugcugcaguuaauuucauucauguauuuuguuuuuucuuccuuuauuuuuuauuuauuuauuuauuuauuuauuuauuuauuuauuuauuuuugagacggagucugacucugucgcccaggcuggagugcaaaggcaugaucuuggcucacugcgaccuccaccuccuggguucaagugauucuccugccucagacuccugaguagcugggacuacaggcaugugucaccacacccggcuaauuuuuuguguauuuuuaguagagacgggguuuugccauguuggccaggcuggucuccugaccucaggugaucugcuugccucggacucccagagugcugggauuacuggugugagccagugcgccuggccauucaacucugguugaauuguuuucuuuuuuuucuuuuuuuuuuugagacggagucucgcucugucacccaggcuguagugcaguggcgggaucucagcucacugcaaacuccgccucccggguucacaccauuuuccugccucagccuccugaguagcugggacuacagccgcgugccaccacgccuggcuaauuuuuuguguuagccaggauggucuugaucuccugaccucaugauccucccaaagugaugugauuacaggcgugagucaccgcgccuggccgguugaauuguucucuuaggauaaacuugguauaaaauugaguuuaaaggcugugaauuuccucauuaauauauucacacaaucugaaauaauacauuuauuauuuaauaaauauuuaauguauuuuggauuauauuuaaaacaaacaaggauguaaaauuaccuauaacccugccaguaaggacaaccacuauugugagccuuuuugcucuagauagcuuuccaguguuuuauuuuucuacuguaaagccuguuccgccccccgaccccuuaacauauauagggaaaaucuucccacauuaguaaauagagaucuaggcugggugcgguggcucacacuuguaaucccggcacuuugggaggccgaggcaggcggaucauaugaggucaggaguuugagaccagccugaccaauauggugaaaccccgccucuacuaaaaauacaaaauuagcugggugugguggcacaugccuguaaucccagcuacucgggaggcugaggcaggagaaucacuugaacccgggaggcagaggcugcagcgagcugaggucacgucauuguacuccagccugggugacagagcgaaacucugucuccaaaaagugaauaaauaaguaaauaaauaaauaaaagaucuaugcuacaggguacauuuuuccuuuuuugcuuuuuucauuguauuaaaauauuaaaauguacauaacauuaaauuuuugccuuuguaaccauuuuuaaggauacaguucaguggcauuggguacauuuacauugcuguacagccauuaccauugucuaccuccagacccuuucaucauuaucccagacugaaaccuauuaacacauuuuuauaccuuuagcuguucucuuguuguagacauucauuuccaguuuucucccuucguagguaacaauucauacauauauguguguguguguauauauauauauuuaauugucugauuacuuccucaugauggcaguucuuccaugauaggaaaauucuccucuagagaacaguugucuauacgaguauacauauuaaggacaaauuuuuuuuuuuuugaggugaagucuugcucuguugcccagguuggagugcaauggcgcgaucuuggcucacugcaaccucugccucuuguguuccagcgauucuccugucucagccuccugaguagcugggacuacaggcgccugccaccccaucuggcuaauuuuuguaguuuuaguagagacaggguuucaccauguuggucaggcuggucuugaacuccugaccucaggugauccacccuccuuggccucccaaagugcuaggauuacagguugagccaccuugcccggccaaggaugacuuuuaaaauuggauuuggaugucaguuuuucucccccugacaccacuguagaauuuacccucaauuuaauaagaaaaguuaaggugggccaggcucaguggcucacacuuguaaucucagcacuuugggaggcaaaggugggaggaucauuggagcuguagaguucgagacugaucugggcaauacauguaccuacaccucgucucuaaaaaaaaccuuaaacaauuagcugagugugguaguguucaccuguggucccagauacuugggaggcugagguggaagaucgcuugagcucaggaggcagagguuuccaccagcugugaucacaccacugcacuuaagccugggcaacagagugaaaccuuaucucaaaaaaaaaaaauuaaaaaaguuaaugugacuggaagguuaaauguguuuuuuaaaguuauagacauauagcuguuauauaaaaaaugagguaugucuaugguaauacagaagucaaagugucuuuugccuaaaugaguguuuuuuuuuuuuuuuuuuuuacaggcucaaugacauugcucagugggaagguuuguggggagagguguauaugugauauaucauuuauuugggaaaggguguucauacauauuuugcugcucucauggacaaaagguugagaaaccacuacucuguguucuauuuuguuugauugguuagaauaagauuuaccuaaccuggguuuuaauuuuaaaacaaauuuuugaaugucaaaugcuuauaaguuauucuaauaagagccuuugcuuucuccuaggauuggcagccaccauuugcaugugauguugauaaacuucauuuuacgccacguauccagagacugaaugaauuggagguaaugucuucacuauuguucuguuugccuguauuccagggggaccgucuuugaaauuauuacgauauauuaaaauuguuacagaaucaccauuguaaaucuguuuuuagauuuguauuugagcaaauaagaacauuucuuucuguagagaacaggucuuuaaaauaucgaauuggcuaggcaugguggcucacacuuguaaucucagcacuuugggaggcuggggcaggaggguuggccugggcaacauagcgggacccugucucugcuaaaacauaguuuaaaaaauuagccacgugugauggugugugccuguaguuccagcuacucgggaggcugagguggguggauugcuucagccugggaggucaagacuguagugagccaugguugugccacugcacucugcacuccagccugggcgacagagcaagacccuguauuuuauauauauauauauuuacauaugugaagauacacacacacagaauuguguuuuuguuguaggguugaggucucccuauguugcccaggcuggucucaaacuccugggcugaagcgauccuccugccucugccucccaaagcugggcauauaaaagcauauuuacuugccauauaauuuuaaacacuuauauggaauugugcuuacaguacuaauuaaguuccuuucagagugccugcuuacaucacaggaagguuuacugaguguuuaauucuuugucugucacgugguaggggcugaauuaaauuuuuuaaaaaagucaauuaaaauuuuuacuuuuuuuguuauggagucccgcucugucacccaggguggagugcagcagcauuauccugguucacugcaaccucugccuccuggguucaagucauucuccugccucagccucccaaguagcugggauuacaggugugugccaccaagccuggcuaauuuugguauuuuuaguagagaugggguuucaccauuuuggccaggcuggucuugaaauccugaccucaggugaucugccugccuuggccucccaaaguguugggauuacaggcaugagccaccaugcccagccugaauuaaauuuuuguugaguuaauguauguguguguauauauuauauauauauauauauauauauauuuuuuuuuuuuuuuuuuuuuuuugagacaagagucuuguucugucaccaaggcuggagugcaguggcacaaucucagcucacugcaaccucugccucuuagguucaagugauucuccugccucggccuccugaguaguuggcauuacagacguauaccaccacauccagcuaauuuuuguauuuuuaguagagaugggguuucaccauguuggccaggcuggucucaaacuccuggccucaagugaucugcccauuuuggccucccaaagugcugggauuacaggugugagcuaccacacccgaccauguauaauuauuauuuuuuuauuuuucuuuuuuauugagacagagucuugcacugucaccugggcuggagugcaguagcaugaucuuugcucacugcaaccuccaccucccagguucaagugauuuuccugccucagccuccugaguagcugggauuacaggccccugccacuacgcccagcuaauuuuuuguauuuuuaguagagacggaguuucaccauguugcccaggcuggucucgaacuccugaccucgugauucacccgucucggccucccaaagugcugggauuacagccaugagccacugcacccagucguauaauuauuauuauuuugagacagagucuuacugucucauccaggcuggaguacaguggugugaucucagcuuacugcaaccucugccuccugaguucaagcaauucuccugccucagccuccugaguagcugggauuacaggcacgcgccaccacacuaggcugauuuuuguuaauagagaugggggguuucaucauguuggccaggcuggucucgaacucccgaccuugugauucgcucgccucagccucccaaagugcugggauuacagacgugagccaccgugcccggccggccauguauaauuauuuaaccagcuuuauuuuguguauuuuuggccguuucucacugaauuuagaaagugguauuauaugauuuugcugaaagagcauuaaauuaaaaaaaaauuuuuuuaagugguauuguacuuaaauauucugugaaagaaaauaauggcagguaauaggagcuuuaaaauaagcuaaaugagaugaaaacucaauucuuugucuuuuaggcccaaacucguguaaaauugaauuucuuggaccagauugcaaaguacugggaguuacagggaaguacucugaaaauuccacauguggagaggaagaucuuggacuuauuucagcuuaauaagguaaagagcuaaugaccaucuuacuuauuuuauaaucuuacugacagaaugaauuugaucuucuuugccuuaaaaaggaacuuauugcucagccagguggcucgcaccuguaaucucagcacuuugggaggucaagggaggaggauugcuugagaccagccuggguaacauaaggaaacccuguguuuacaaaaaauuuggaaauuaggcaugguggcacgggcccuguaguaccagcuauuuggguggcuaaggagggaggaucacuugagcccaggagguggaggcugcagugagcugugauugcaccacugcacuccagccuggguaacugagcgagacccugucucaaaaaagaaagaacaaauaaacuuacuuuuugagaugugugaaaugagauucucaagucaguugagugaugaggaucaucaggucuugaagccuuguggaauauuuugcuuccaccuguuuuucucauuuucacacuuuacaaaaauucugcaagcuauuucuuuuuauuacagauaaggaaacugaggcucagggugauaaaaagguaaaaaaaugcugagccauggccgggcgugguggcucaugccuguaaucccagcauuuugggaggucgagguggguggaucaccugaggucaggaguucaagaccagccugaccaacaugucgaaaccccgucucuacuaaaaauacaaaauuagcugggugugguggcacaugccuguaaucccagcuacucgggaggcugaggcaggaaaaucgccugaauccaggaggcggagguugcagugagccgagauugcgccauugcacugcgggcugggcaacaagagagaaacuccaucucagaaaaaaaaaaaaaaagaagcugagccauaauucaauaccaggcccauuugauucugaaauuuacauucuuuccaucaaacaugcuggcaugcauccuagucuuuaguuuuuggaggcuuauuuaagagcccagaauaagaccaaguauuacagucccuucuuugguagagauuuaguuuuagguaaccugguucuuuccacaugauugcuuuggggaugugaaaaguagcuuagaggggacaaaauguuuauggaccauguugucaagagagauguugaaaauuucuaacuuaaaauuaauaguguguguguauauauauguguguguguguauauauauaugauuggcaaaacauguuuuuaaaagauaaccauagccaagaacauuuuccccuuggagucauacuuagaugugauuagaagugacuuccauauaguuguuucuaauuuugcuauuuuaacaguuaguugcagaagaagguggauuugcaguuguuugcaaggauagaaaauggaccaaaauugcuaccaagaugggguuugcuccuggcaaagcagugggcucacauaucagagggcauuaugaacgaauucucaaccccuacaacuuauuccuguccggagacagccuaaggguaaguuugggggcuagccuuaaccuguuuuaucuuacuacuuauugguacauugucuuuucagggaaaugaaaaagccuugauuguguuuggaagaccuuguuuuagaagaccuuauuuugguggggcgcgguggcucacuccuguaaucccaacacuuugggaggccaaggcaggugaaucaccugaggacaggaguuugagaccagccuggccaacauggcgaaaccucgucucuacuaaaaauacaaaaauuugcugggcaugguggcgugugccuguaaucccagcuacuagggaggcugaggcaggagaaccgcuugaacccggaagguggagguugcagugagccgagauggugccacuucacucaagccugggcaaagagcgagacucugagacuccgucugaaaaaaaaaaaaagaccuuguuuuguguuuuuuccucuaguguuuuuguucugcuuugagagcagcuauacuuagaaguuuguuucuggaaugaguaagauuguggaggaaauuuuuuuacuguccaaagcugaggaguugauuauuaucuacuuguuacaacuuugcauucucuuuaaauuuaaaguagcuaaaguauuccuggcugucauaugaagguauaagcugugaaauaacuugccuaccuguucucuucugccagcugagauuuuugaggagauugucagaauguugauaugguaaaaggggauuuuauaaugcuacauagcuaacggguuccucuucuaguaauuccuauguagccaaguucauuucugacaaaaugguauuugugaaauuauucacuuaaaaacuuuuagguaaaacaguacuguaaaagcuucccauuuauuuccaggccuugguagaaagaagaggggugucauuauccauucacacccuuugaguuauuuuaggacuacagcagugaguccuauaacuuuaagaauuguuuucugugcuguagagagguaggaagagaauaacauaguuuuugagggguaaaucacuaaccaaaguccuguccuaauacuauacacacacaaacacaccaucuguaaugcuuaaauccaguagauuuuuucuucccucucucccuuauugauuccaggugaacacuuuuuagccuagaagaaaguagccaaucugacauucaaaacuuuuuuuuuuaauacauuauaugaauguuuagugagcccauggaugaaauuguuuagaauguugaaugugagccgggcgcgauggcucacgccuguaaucccagcacuuugggaggccaagguggguggaucaugaggucaagagauggagaccauccuggccaacauggugaaacccugucuccacuaaaaauacguaaauuagcugagcgugguggugcgugccuguagucccagcuacuugggaggcuggggcaggagaaucacuugaacccaggaggcagagguugcagugagcugagauugugccacugcacuccagccugggugacagagcaagacucuucucaaaaaaaauaaauaaaauaaacaaaaacuuaaaaaaauaaaaaauaggcugggugcgguggcucaugccuauaaucccagcacuuugggaggcugaggcagguggauccccagaggucaggaguucgaggucaggaguucgagaucuggcuggccaacauggcaaaaccccgcauuuacuaaaaauacaaaaaaaaaaaaaauuagcuggaugugguggcaggcacuuguaaucucagcuacuugggaggcugaggcaggagaauugcuugaacccgggaggcagagguugcaaugagccgagaucgugccauugcacuccagccugggugacagaaugagacucagaaugagacugucucaaaaaauaaauaaauaaacaaacauaaaaaauaaaaaauagaauguugaauguggaaccuuuuugccucuuauagucagaucuagauacaguugcccauaguagauuaauuuucucuucuugaacucuuccuaaguacggaagugauagugaauaaagggagagagagucccuuuaaugaugcuuuguggguuguaacauuuuagaaacaugucacuuauauacuuaaaaaggcaauguaguuuuaugguuaaaaagcacuuaaguauuuauacaaucaaggagucugaaaggaauaagcauuuaaagguacccuuuuguaaacauugcaucuacaauauagguagauauuugugagggacuuacucugugccaaguauguuuuaggaagugauacacauucuuuguagaaaguuuaaaaacauaggaaaguauggcaaaaauaaaaucacuccugauccuuccaccuguuacuucucucacggcuauuuuuaugcauacauucacaaauucaaguguacuguucauauacaucauugcaucuuagguuuuuuuacuaaucauaugagcauuugcuguaucauugaauaguuuuugaaaaugcaauuucuaaugacugcggcaauccguuuuuuauagccagacuuuauuuugaugucuucuauuguagaauguuuaggucaguucuaguuuuuuauuauaauacuaugaugaauauuccuuguauguaaauuuuuacaccuauuucugauuuuugaaauaguuauuagggagagaagaauugaagaacauauacuuaagaaaaacagagguguacaguaaaggaauuauugcaaaagggugaaguaggguguaaguuaaauuucaggaagcuugagaaaaguugaugcacuguuccaguggaacagaggccucaaucuugcaucaucauguuuucuaaauguuuuaagggauugcucugucuuugggaugaugugauuauggcaugaugaugauauuaaucaccuguaaguccugguuucucaaguaaagguuaaaauuagcgucuguauguuaauaacauuagauauaaaaccauaucguguguauuuuuaauugugguuuggaacaaaauaauaaagcucuucauauuuauucuaaaaaacuacagggcaugauuuucuuagaucugcaaaguccuuacagaaccaagcugaccauagaugauggaaccauugagacuaacuaguaggagauaggaaccacguauauagcaucugaauuugugaucauccacuuaauacaauuuaugucauucagcucaauuaguauuuuccuaaucacucauacuuuugugugucaaauagaaaguacauuggauacauaaaggggauuaauuuagaugaugaacagguuuuauuccccucugcaugcuuucauuaaacauacucuaaaugcucaacugaggacuuguuauagaauagaaggcaauguucuauacaaauuuuuucaaaaaacagaauauuuuuuucucucaauuguuggguguuuaauuugucucauaauuuuuuuuuuuuuuuuuuuuuuuuuuuugagacagagucuugcugugucacccaggcuggagugcaguggcaugaucucggcucauugcaacauccgccacccugguucaagcgauucuccugccucagugucccgaguaggugggauuacaggcaugcaucaccacauuggcuaauuuuuguacuuuuaguaaggacgggguuucaguauguuggccaagcugguuucgaacuccugaccucaagugaucuaccugccuuggccucccaaagugcugggauuacaggcuugagccacugcaccugaccaacuuuuuucagaauguaagugcuuaacuauuaagaauauaauaggccaggcggccgggcgcaguggcucacgccuguaaucccagcacuuugggaggcugaggcagguggaucacgaggucaggagauugagaccauccuggauaacacggugaaacccugucucuacuaaaaauacaaaaaaauagcugggugugguggcaggugccuguagucccagcuacuugggaggcugagguaggagaauggcgugaacccaggagguggagcuugcagugagccaagauggcgccacugcacugcagccugggcgacaaagcgagacucugucucaaaaaaaaaaaaaagaaaaaaaaagaauauaauaggccguaggccgggugcaguggcucacaccuguaaucccagcacuuugggaggcugaggcgggcugaucaccugaggucaggaguuugagaccagccucaacauggagaaaccccgucucuacuaaaaauacaaaaucagccgggcgugguggugcaugccuguaaucccagcuacuugggaggcugaggcaggagaauugcuugaaccugggagguggagguugcagugagccgagauugcaccuuugcacuccagccugggcaacaagagcgaaacuccaucucaaaaaaaaaaaaaaaaagaauaguuaacuuuucuggaucaaaucaauauguagguuuaaguagaaugagcagaauguuuaauauuuauagagcgcuauuaccagugguagauuuauuacuuguuaacaaguaaugagucaguuuuuaauaguauaucauauuucuuaacuauuagaaauaaauuuuaucauuguguugcuuuguacuuuauuuuguucuucgcccagucucuguauuucugcaaaugugagggggaaaggggcgaaucucauuagugagauucuaugguaguaacuaugcucauaguguuagugcuucaggaagguuguuauuuccacguaucucauuccagauauagcugcuauaacacacccuagaggguuacuuuuggaacuuacuuuuacaaagguuuuucgugauguuccuggguccuguuaugaaaaaguagugcuuaccugaaauucauauuagcuucgguggcaauauuuugucguguuaauguuauauuggcauuaaauacccuccuuuagccagcuuagaauaaaacuaaaaagaaaaaccaaagaagagaugcauuucugaucagaaccaaaguuauugcugugggcuacccguugaucuuugccuugcgaguuagacuuuguagggauauacugugguaaauggaaacccuagugaggaagacuacuuuagucaaaugaccuguuuucucaauucaggugauaucuuuggaugauaacuuugcuaguuauaucugaaacuauacaguuguaaaaucuagaaaacauauuggauuccuuauuuuuuuuuauuccgaacacuuguuaaaaaugagauuuuuaauauggaaaauuguuuugggagcuuauaaggggccuuucuaacaauauggaccuuccauuaacugacagucgcaagcacaaauaacuccaagugguucauugggaaugccuugagacuguuauggccuguuguaaccugaugaugucagcaaugaaaaaucaaagcaacaccaccuguuaaaauuuuuuuuaauguuuuaaaccuguauagauguauguaugugguugguaacugcagacuugucuuuauuuuuauuuagauuuuuaaaaauuguaggccuguugucuacauaaauaguuguaaaauguaccuuacaaaaauccagugaaacucucuaagauuaaaaaaggagggaauccuuucaguccuugcacaccggggaacaaggucgugaaaaaaaggucuuggugaggugccgccauuucauccuuccucggucucugcaccuuucgcagagcuuccagcagcgcuauguugggcuagagcauccggagguucacagccucugugguccguaggagccacugugaggagggcccugggaagaauuugccauuuucaguggaaaacaaguggucguuacuagcuaagauguguuuguacuuuggaucugcguuugcuauacccuuccuuguaguaagacaccaacugcuuaaaacauaaggguguuucaguuccuccauuuaacagauaugaagaguauuuuaagaggugcagccucuggaaguagaucaaacucgaacucauguggcaugcuagauauguuugucaauaaacuuaugaugugaaaaaaaaaaggagggaauuuaucaguacaguuguuauuucuaguguuugcagaagccaaaccugaccacagacacuaaggacaaggaguacaaaccccaugauauuccccagaggcagucugugcagccuucggaaacgugccccccagcccgacgagcaaaacgcaugagagcagagguaagagccucaugagguuaauuuaaaaggaauucucaagcccuaauaccaauggcugucuggcacuggauuucucucaugugugugcucuuuguaguuuugaaccuuguuaaucucacaaagggaugcuguuuguauuccagcuuuuacacuugggugaauuguaccaucaaagggguaaggaaucgaauaagucuuucuaaauuuaugcugccuggacagacagccgcuuauuaccagucaaggccuuagaagaauugguguuccuguguuccuacuuggauugcccauuacccucacaaaauuggcguuguuuaauggagauuaaggcuagaaaacaugaagauuaggaguuuuuuuaaacagagugguuagaagacaguuaaagccacuuuucucagacuucuuuuuuuuuuuuuagagacagagucucgcuguguugcccaggcuggagugcaguggcgcgaucuuggcucacugcaaccuccgccuccuagauuccagcaauucuucugccucagccucccaaguaggugggacuacaggcgugugccaccacgcccggcuaauuugguuuguauuuuuaguagagaccgauuucaccguguuagccaggauggucucgaucuccugaccucgugauccacccaucuuggccucccaaagugcugggauuacaggcgugagccaucucacccagccucuuccuuuuauagguggucucgcucuuucaccuagacuggagugcaguggcaugaucauagcuuacugcaacuuugaacucccaggcucaggugauagcugccaccucagccucccaaguagcuggaacuacagaugcaugccaugcaugccuagcuaauuaaaaaaaaauuuuuaauaaagacaaggucucacuguguuguccaggcuagagaaggauuauuugcuuuaagauuuuucugcucugagaagcuuucccugggaaaggaagaagaguauuuuucuagugaucucguucccauaccagagguaugaagguuuuggauuccugccuagccugauggauaugugaguuuuaggacucagagauaauauauagggaacuguuuagagcugggaagccucauauugcauuaaucauacuaaaucaguaacugguuuucaauaauuaucaaaaaugaaaaaaaucagccauuuuguuuucugaagaaauagauaaauaagagaauaguuuuucacuuugguaaguuggagauaggaaaaaaauuuagugauucacuuuuucugaaugaaggagacugcccagaauaggaaaauaugguuauuugaagcccauaagcauguuuaaaguaaauuaaucuaugaaucaguucuuucuugagcauauucuugaucuuauacauguguauauaagaaaugccccagugcuguggaugccuacaucugccuugaugacaccugauaguaaugauauugcccauggaauaaacucuuuuagcaguggacaucauuaaaauguaugaauaaacacaggcaaagugagaaagcacaguuccacagauacuucaguauuaccacaaaaaaugguuuuauuugcuuuaccaauaaguaucagcacuuuaagaaauaauagaaacugagauuggcuucuauacccucaaugaggaaggagcccuuaauaguuuagugauguuagaaguguguaguuuauaauaauaguuuauuaaaauaauuuauggaaaauuauuguggaagcaaaauuuucuguaaauacugacagaccuuggaauaggucagcaaacucuuagaggcuaauggaguuaugacauuuauauaacuacuuaggauuuggcuuauugcgaugauugaauaaagcauaaagcaaauagauaagaaccaagaaccuucuaggaggaaaauaagaauuguucuuccgaauuugaauagaaacacuucucuuuguuuugagacagagauuggcucuuguugcccaggcuggaguauagugguguggucuuggcucacugcaaccucugccuccuggguucaagcaaaucucaugccucagccuccugaguagcugggaccacaggugugcacaacaccuggcuaauuuuuguauuuuuaguuagagaugggguuuugccauuauggcaggcugaucucaaacuccuggccucaagugauccaccugccuuggcccccccaaaaugcugggauuacaggugugaggcaccucgcccagccacaauuuguucuugauccuuugacuuuucccuauuuguuuuuuuguuuguuuguuuguuuuugagauagagucuugcucugucacccaggcuggagugcaauggcaccaucucagcucacugcagccuccaucucccagguucaagcgauucuccugccucagccucccaaguagcugggacuacaggugcgugccaccaugcccggcuacuuuuuguaauuuuaguagagacaggguuucacuguuagccaggcuggucuugaacuccugaccuuaagugaucugccugccucagccucccaaagugcugcgauuacaggugugaaccacugugccuggccaacuuuucccuauuuuuaaauuucucauucaugcuuuaauaguaguuucaaaggugagcucucuuccuuaggaagagagagaaguauguuuugaaugcccuguuaauagaggcaauugguaggauauagucaccuugagauuccaguuggauuuuuaaagauuauuucuucuuaaaggaaauauucauguauaugacaauuuuuuuaaggccaugaauauuaaaauagaacccgaggagacaacggaagccagaacucauaaucugagacgucgaauggguuguccaacuccaaaaugugaaaaugguaagaaaauuugucaaugaauaggaaagaaaaaguaaauaaaguaaaaauaacuauucauaaguaaacauaagcugaaaauucaauagaaaaaaauuaaaaaguaaaauuuagagcagccaguacauaguagucacuggguugggcuuugagaaaaucuuaauauaucaacaguguccuuguucucauaauuaacugacuagugggagagagaaacagaaacuauauguaugcauauuaggaguguggaugaguuucucagcuguagcaaguugcuacuuugaaauuugauucaaugcaguuacuuaaguaauuugugaaaaacauaggugccuuugaccgaaugucugauagauuuauuucaggcaaggcaaacagacaugcuuccuaaaucugaauugugguuaauugcuugccuggguaucacuugauguaagucacugagagguggauuugagauucuuuuaagagaaaucuuauauccuauauaggaggcacauacaaauuaagaaguuacuaaaauuuguucaaccuagggauuagugaacuaguggaaaggcagcacaaugcacaggaaaguaauagagauacaauauaaaguaauacaguaaucuuggcacaaccgcuaacuaguuauguaaccuuagagauguuucuugauuuacuuuaacaucaguuuucuuaccuuugaaauggguuuguugugaaggauuaaauacuuuauggaaagcauugagcacaaugccuaccacaugauaguucaguaauugauagccaguguuuucgccaaacuucucagucuucagaaccaggaauuuggagaccaggaggaugaccaggaagucaucuuagaucauggagagauaauguguuauguggaggagauauaguuggugaacuguuggucucuuguagucauggccaacaggaauuugauuucaucgguauauguuaugucuuggucuugagaaaacuaauuccuauuuugaaagcauacaaaccugagggacaucuccagaaguaaucuacaucuugaaauuuaaauggcacaagaguuugcauuuuaucauaaaguaaucagcauuugagcccuugaauaaaguauacugggugcuauugcuacuaaaaugugaaaacacacaugaaauuauguuuguguacaguaugugcuuugggagggagaugaugaggaaguggagaaaagcaucauaaagagcuaauuuuggauugccuccuacagagaaagaaaugaagaguagcaucaagcaagaaccuauugagaggaaagauuauauuguagaaaaugagaaggaaaagcccaagagucgaucuaaaaaagccaccaaugcugugagugacaucucccuuucuccuuuuucuuuccuguuuuccuucuucccuuccuuucuuuaauccccuuuacccccaaguuuaaacuuaaauuuguaccuuaaauaagauuguuuaacuuagugucugacaauaaaaauaucuucugaagucaguuuauaguguuaguuaauaaaugaggaaauacaugaucauacuauaaagaugguaguaacauccggggcggcauugacugcgauuuucuggaauacauucaguuuagcacugacuaauaaugaacuguaaucuagcucauuauacauagaauugcucauaaaucacuagcucacuucuacaugagcugaaggcucgcucaaaaauccaaguuaguguuuuccaacuucccagcuagcaaagggaaggaaggaaaugaaaagaaggaacaaaaaagagaaaggaagaaggaagaggaaggaaggaaggaaugaaaaggaaguagagaaggaaggaagaaaaggaaaaggaacaaaggaaagcaguuaggaauagggaagaggacauggcagaguuagagggcugggagcuguuuauucuguggaaaacuuuuauuaaaaguaaagccugauggcauuagaaaggaucugguucuucucugcccccuucugagagccugaaacggugcuuuuuuuucuuggaacuagaaauuauucuaauugaauguucucuccauaaaugucaccuucugccccacccccucuccccaauacaaucagaaaacugacagagcuagauuuuuauuugcuacaauaaauagacugcaacagacuccccauuuaguugaauucucagcuuucuaguauugaguaauguaucaguuugcuguggcugccauaaggaugugccgcagacugaguggcuuaaacaacagaaauuuauuuuuucacaguuguauaggcugggaaauuugagaucaagguguuggcaggguugauuucuucugagcccucuuuccuuggcuguggauggcugucuuucacauggucuuuccucuguacauaucuuuguccuuauaaggacagcagucauauuggaugauuaccuccguaaggacucauuuccaaauauagucacauucugagguacugaggguuaggacuucaacaugugaguuuuuggggggaauacaguauaccccauaaaaaguaauaacuaugcuuuaucacugggcauuaggggaacuucugaaccauguccccuuaauuagaauuaaaagugauaguuuauuuuuauuuuuuuagagauggcuggaguauagugacacaaucauagcuacugcugccuugaacuccugggcucaagggauccuuuugccccagccucuuaaguagcugggaccacaggugugcaccaccaugcccggcuaauuuuucuuuuuuaaauuucuuguagagacagugucucgccauguugcccaggcuggucucaaacuccuggcuucaagcaguccugccagggcccccaaaaguguugggauuacaggcuuaagccaccgugccaggccuaaauugguaguuuaaugugguuaacuuuaagacaguuuuguuuuaaauauggaaaacuuguauuuuuccuucauaaauucuacuuuugguuagguugguaauguauuaccugguaucuuuuuuuuuuuucuccugagacagggucucugucacccaggcuagagcgcaguggugcaauaagggcucacuccaacuuugaccuaccaggcucaagaaauccuccugucucaauuccccaaguaguuggaacuacagacacgugccaccacucuuggccuauaaccuuagcaucuuguuguuuuggaaccuacuaaaaacuaggucuuuaaauaacaaacuuuaaacacaugacaguugagaaagcuaggagauuccacuuuagauuugguaugcaugagguauugugaaauauccuucauagaaagugaaacauuuuuauuuaaaauaucccuuauagagguugaagcauuuguagcaggauguagagacuagauuaugucucagauccauuucauuucuagaauuuuagaaaaucaaauaauagcucauguuccuuuguucuguacccacuuuuauugcuacagguggaccuguaugucugucuuuuauguggcaguggcaaugaugaagaccggcuacuguugugugauggcugugaugacaguuaccauaccuuuugcuugaucccaccucuccaugauguucccaagggagacuggagguguccuaaguguuuggcucagguaauaauuaauaguagagguaacacuagaaaaauuuuuuuagggcauuuuucuuugccuuugaguuuuauuuuuuauuuuauuuuauuuuauuuuuuuuagacaaggacucacuuuguugcccaggcuggagugcaguggcacaaacauggcucacugcagcaucaaccucccuggcucaagcaguucucccaccucagccccccccacguagcugggacuacaggcccaugccaugaugccuggcuaauuuuuguauucuuuguacagaggggguuucaccauguugcccagggcuggucucgaacuccuaagcucaaauaguccuccuaccucggccuuccaaauugcugggauuacaggucugagccaucucacuuggccugccuuuggguuuuagauuuggcagucgacaguaaugaggcccaugaagaaaacugggauggaccugaauaggaaagaggucuuagaagugaguuccacaauguauguggguaguuaagaggcagaaaauaauuuguaauaaguaucuuauuauuauuuuuuaauucuuauaaaaagcaucacaugcucuuugcaagaauuauuaaaacauugaacaacuuaaaaaguagaguuaugcuuucacaaugcauauauaaccacuguuaaugucuugguguauauucauccagacuuuuuucuauuuuaaacaaauggagcuacauuauauaaguaauuauuaguaaucugcuuuuuucauuuauagagacauuuucauguagcacugugauuacugauguuuuuaauagugcaugcugucauugguaaaaucuaaaaaggaucuacgauuaucuucaugaggauuuuuuuuuuuuuuuuuuugagacaggaucucacucuaucacccaggcuggaguacaguggagugcaguggcgugaucucagcucacugcaaccuccgccuccccagcucaagugauccucccgucucagccucccaaguagcugggacuacaggcuugcaccaccaugcccagcuaauuuuuguauuuuuuaguagagacaggguuuugccacguuguccaugcuggucucagaacuccggagcucaggugauccuccugccccagccucccaaagugccggauuacaggugugagccacugcacccagccauuaggauuauuuugcauuaauauuauguagcagucagucuauuacccuucuuaggguugaauuauaauaguaaggagguuuauuuuaaguauagcauggcuauaaagguuugagugcuuuuccacguagcuauguuacaacauaaggauaucuccaucaaugggagguuauuaggcaugggacagggauaaauuauuuaauaccucauaauagggaugaccuuaucaauggaucuggaauauucaagucuauuggcucacaaagaucuaaggcagcuuauacugccccuguuaacucccaguauuagguuauaaucaaauauugcuggccugagagccauucuguuuccaucaagugguuuaucucuauuuugaucuauuguauguugauuuuauaguuuuaacucccaggaggacauuauugcucucauuuucaguauugaaaacauuauuugauuuugaaggaagucgagucuuuagccugccucuuauaaauauauaaauuuauccaaguugugguuguuaaaauugacauuuuauuugcucauuagcaaauaaauaaaauguauuucacuugcuuauuaaaauaaccacauuuuucaggcagguuuauuuuuauaauguagaccuagcauagaaguaaaauaaacaaauuaaagccuuguuuuuuaucugccagcuugaugauugaccaaguauacuugauguuuucagugucaccuagaacguaauuuucuuuauuuucaggaauguaguaagccacaagaagcauuuggcuuugaacaagcagccagggacuauacccuccguacuuuuggggaaauggcagaugcguucaaaucugauuacuucaacaugccaguccauguauguacauauauacugcuuugauuuaggauuuuaauagcuuuuggagaaaaguguaccugaagacccauuuuuaguugaggccucacucuaguaggcauugucacacagaaagcagaaugaaacuuuaauuuguuuugugguauuuaaaauuucacaauacuuuaaaaagcauucuaauuuuuuauuuuagaauuucucuaaagauaccucuuccacacagauuauacagcaccaguaauagaacacuaauaaagaaaaucaucagcaaucauuuuggcccaacaaauauaaagaauacuucacaaaauguauuaaaugacugcugugugccaagguguacuaugcauugggaacacauuuguuguauauuguuauguaaucauaaguuaguauuauaaauuucaggaugaguccauuuuuaauuccccuuuaugcacuuugaagcauaagcauuuuccauucagcauuuaauacuccaucaaaugaguacaccaaaauguaaugcuuuaauucuggauauuuaagcuaugauuuuugucacuacuaauaaagcacugcagcaaacccuuuaugcauguaguacucuuuaauuggaugauuuucuugggaugauuauugaggucagaugagagucauucucccucauuccaucccaguugcuguaucaauuuauggaucccagcaauauaugagugaauuuguuuuuccccagcaccucuaacaucagcuauuaguuacuuaaaauguuugcuuauuuaauggacuuaaauuuauacuccauuugaauuuucaguucucuugacuuccuuauguguuauaauauuugccaauauguuugcuuaaccaauccugaugacuugcauguaaccucuucuauuugugguuaacuguauauuuugacagaauauuagaugaggacauugagggauagacauuuaaauguuaccugccucuggauuuacaccagauuaacaacagauugacauuuagucuggugacucuuuauucuaagggcgugcugcuacaaguugcuccuuuuguuauaucauauauacuggaaguccccaaccacccuuucccaaccuggccauugaccaauaccagucgguggccuguuaggaacagggccacacagcaggaggugaucagugggcaaacauuacacccgagcucugcguccugucagaucaguggcugcauuagagucucauaggagggcaaacccuauugugaacugccuaugcaaaggaucuagguugcauguuccuuaugagaaucuaaucccccccccaccucccagcccuugcgcccugcccuuccccauccauggaaaaauugccuuccaugaaacccaucccuggugccaaaaacacagggacacuggcgaccacugcuauauacuguguuuuuuguguugguugccuacauugcucucagacagguccagugaaaagaaugaaaggauggacucagguaauguauuugaaagcaucucaaaguauaaagcaucauugaaacaacaaaccuuauuacugugcuguugucaacuguacagugcuauacgucauucagacacaacuaaccauuauuacuauacaguuuauguuacauuuuuugaaacacagaaauaucucccggucauaaauaauugcuuuccuuggcucccuuuuacaguuguggccuggcuggugauagaggaacauaaauuccuuuuagacaguagagguuuccugaauugccuaagaucaauuauagaacauuauagacacaauuuuuccuuaggaugcuguucuuugauucccaucacugagcuuaauuggucacagacaguuugugaggaaacucauuuuuucuauuccuuguauuuccagaugguccccacagagcuuguugagaaagaauuuuggagacuaguaagcacuauugaggaggaugucacaguggaauauggagcugacauugccucaaaggaauuuggcaguggcuuuccuguccgagaugggaaaaucaaacucucaccugaggaagagguaggcauauaaguggcuuggaaauugagguauuuauugaaauucuguuugguuggcuugaaguaacuuaugauuacuuuuagcaaauccuuaauuaccagauuuuuaaugauuucaagaaaaguagaaagagccuacagaagaauucuaguccuaacuaugucacuauguuguggucauaggggaaaauuacuuaucauccuuugccuucagauuuuauaaccuugguuucuccuucugaagaaaaccugaaggccugagaccaggucuauuuauuuucaaacuuuaauauuuuugaguauuuuuuuccauacuagcgaacucuuaggaagaguucuguuucuaucuugguaggaaagugugauuuuuuuuuuuuuuugguaguuuucuuugaaaguauuacauaugaucagaaaaguacauaguuauauguauacagacugaugaauuuccacaagcugaacacacccauguaaccagcacuaacuaaaacaagaaauaggauauucccagcaccccagaaguucccuuuucgcccgcucuccuucacuacuuuuccucuuucaggacgagcacuaugcccucaggauaaucacuauccugacuucuaacacuauagauuaguuugccugauuuugaacuuuguuaaaguggacucauggcuuauguuccucuauauauauuuaaaaagagacagauacagaaguaugugcugugugaguccauuuauacaaagcucaaaacugggcaaaacgaaucucugggcauccuagaaggucagcaugguggccccuccucuuccacauuucuuuuuuuauuuugaaggauaauauuuuuagcuggccuucuaaaacguuagcauuguauagcuaaaccuuuauccucuuuugucuucuuauuuuuaggaguaucuugauaguggcuggaauuugaacaacaugccagugauggagcagucuguccuugcacauauuacugcugauauauguggcaugaaacuuccuugguuguaugugggaaugugcuuuucuucauucuguuggcacauugaagaccacuggagcuauucaauuaacuacuugcacuggugagaaguuccaaaaagaacccaugaguaguaugcaugcuggauaggaaaacuuuccuuuucagugcagaugugucuuaacugugucugaagagcauugaacuacuuuuuucccuaagguuuuucacuucuguuagaacaggcauccugacaaguuaagacagugguucuuaagauuccuagagcauccaugaauucccugaaauugcacacacacuacuuugcaagaacaacguaauucugggggaaggguaguuuuuaucugaaguaaggaagucuuugucuaggccgggugcaguggcucacgccuguaaucccagcaguuugggaggccaagaugggcggaucaccugaggucaggaguucgagaccagccuggccaacauggagaaaccccgucuuuacuaaaaauaugaaaauuagcugggugugguggugagcaccuauaaucccagcuacuugggagguggagggaggagaaucacuugauccugggaggcagagguugcagugagccaagagaccgcaccauugcacuccugccugggcaacagagcgaaacucugccucaaaacaaaaagaaguauuuaccuauagaaaaagcauauucuaaauaaaaguuacuuuuacuauagaaaaucccauuugguggcagugcuagccuggauaccccuuugggagaagcgugaauuauaguagguaccacaguguccuccaggucuguguaaugacuagccucucuuuuguuguguugaauucagguaucacuaugcacaguagagugagccuuaucuuggugugcacauugagggggcaaggcgggagggaugugcagauauuugggcuucuuuacuuuuuaaacucuucaagccauuucuucacaucuguuuucuucucuauuuuucuucuaaauauaaaaauauuugaaaaucuguaacucacucaaauccucacacaaggaauuugaggauguaccacaagaaagagaauuggcauauauauguauagaauuaauucugcuucccuaggcaguuucucccagcuguaaaaugaauauuauauuuaccauaccucgcagggaugauacagauaaauuguuugauaauuuaaaguccuuugaagaauaagaauuccuuagaaaugcuaauugccuuacuaguguuugauuuaacuucgucugccagaaugggcaagggaaaagaaaaauggaaaguugccuuacccuuguggguugcuuuaggaaacugugauaacaacauauccugaagugaauacgauaccuuauauucuuagaaauucuggauauuggcugggcaugguggcucacgccuguaaucucagcacuaagcugaggcgggcgguucaccugaggucaggaguucgagaccagccuggcaacauggugaaaccccguguccacuaaaaauacaaaaauuagcugggcaugguggugcacgccuguaauacuagcuacucgggaggcugaggcaggagaauugcuugaaccugggagguggagguugcagugagccaagauugcgucauugcacuucagcauggacaacacagcaagacucagucucaaaaaaaaaaaacaaaaaaaaaacaacaacaacaaaagagaaauucuaggugucugcauuuucuaaagagucagauaaaaaugagaguggggagagggacuucagauguucagauggaaagucuucuguucauacuugaagggggaaaaugcauuacauauguucacaucacauuccuuuuuuguuuuuuuugagauggagucuugcucuugucacccaggcaggaaugcaauggugugaucucugcucacuggauccuccaccuccuggggucaagugaaucuucugccucagccucccaaguagcugggauuacaggugccugccaccaugccuggcuaauuuuguauuuuuaauagagaugggguuucaccauguuggccaggcuggucuugaacuccugaccucgugaucuacccgccucagucucccaaagugcugggauuacagacgugagccacagcaccuggcucacauucacauuucuaaugauauuucgucaguuuguggauuccuuuuuugcguagucuuacaaagccgagucugaaaaauaugaacugguaacccauuuuguuuguguugguguugcagauugauuuauuuuuauaaucuauuuccaggggugagccaaaaaccugguauggagucccaggguaugcugcugagcagcuagaaaauguaaugaagaaacuagcuccagaacucuuugugucccagccggaucuccuccaucagcuugugaccaucaugaaccccaauacccugaugacucaugaagugccuguauguucuggguuaauccuccugccacucaagcuuaauucaccacuucucuuuuuccuuuuuauucacuuuuuuaugauguugauuuaguucuguguuuuccauagcaugacuugauagcagaaacagcuguuuugcugcaguacuguacauuuacucaguaggacuggauccuuagauaccacaaaaacuaauuuguugcagcugauaacuagauugcuaaacagccuuccuuugcaaguaauaauugcaauucauugguuuuaguguauuuauaagugaaaaucuauuucaaggucuugagcuuguauuuuagggugcccagucugacugaaaagucuagagguugcuaaaugaagugacaacuauacagucaugggaaaccuaacaacagggauauguucugagaaaugcguugcuaggugauuuuguugucaugugaacuucauggaguguacuuacacaaaccuagaugguauagccaacuacacaccuaggcuguaugguguaggcuauugcugcugggcuacaaauuuguacagcauguuacuguacugaauaccuuagauagcuguaacacaauaguaaggauuuguguauuuaaauguaucuaaacagaaaagguacagugaaaauaugguauuauaaucuuacagaucaccauugauauguggucugucugugaccaaaauguuguuacauggugcacaacuauacuggcuuccuuuuggagaauacucugaagacauuugggaagccauauugaaauguaugaagaguccaucuuagcuaaauaaaauguaaaugauacauuuacaguguuaaagugaacuuguugugaccuaaaguuuaugcuuuuggguucauaggcuagucaauggagacaacagaaaggacuuucauuugaggcauuauaaauuaugcauggaccauagcuuagaaaguaaucaccaguaagcaccacaaucucaccaucuccucauaguugguauuucuucucauaauauuuuucuuuccucauguugacuguuuuuuccaauuuguuaagaguagauugcuuuaauugagaccugacccugguucuuuaauaauugagcaaacuuucuggaguuagauucuggaccuacagagauagaugaaugaacuccuugugcauuuagggauucauuaucugaaguaaaagauaauguuuauacagauaauacaaggguggugugguuugacaguggugacaacuaugagacugaucuaauaacucuauugagaaucagaaagggcucuuaaaugagaugacaucuguaguaggagcuggaacucugauaaauuaucacauguuuggcagagucagggaaggaggaaguauuccaaguagaagauaugguguuccugugauggguaguagucuuuacacagaacccugaaggccguauuacuacacagauggcuggucuccaccccuagaauuucugauccuguuauuuuguuagucugaguggggcuucaggauuugcauuuccaacaagcuccuaguggauguugaugcuuuuguucugggggaccguacacuagguaagcauugguguagaaauguagaugcuugaaaaggaaucuaauauuauuauauaauaauaagcucaguauaaggauuugugugccuagagcaauauagguacuuuuggggugaggguggugguaggaagaagggaaugaugggagguaaguuugaguuccaaaugaggaggaccucuguauguuaugagauucuugaaauagagugggauugcuuuaauuggugguagaagaugcuacuugagggguaauaauaauauauuaggauauucuuaauugcagcuguuuuuaaaaguuauaccuugaaccuuaauaugggcacauuuuuguuuuguguucagauacuaaucaacuuugguagucugggauacugcuccaucuugugacauaaauuaguaucucuaggugauauucuacuauaauaauuuguuuuuucuggcucaauuucagaaagcugccuuuuuuugaaaauuaucuaauagacuguguccagauugucuuuaguaacaaugucacucuuuaagaaacucaaaaaucuucaauuucugucucuuuagguuuaccgaacuaaucagugugcuggggaguuugugauuacauuuccaagagccuaccacagugguuuuaaccaggguuuuaauuuugcugaggcuguuaacuucugcacuguugauuggguauguaauuacaauguaguuaaccuuuucaaauuuauuguuuuuccugaggaaauggaauauaauguuuuaaagugucaugugggcugggugcgguagcucaugccuauaaucccagcgcuuucggaagccaaggugggcagaucaccugaggucaggaguucgagaccagccuggccaacauggugaagccccaucucuacuaaaaauacaaaaauuaggcguggcggugggcgccuguaaucccaauuacuugggaggcugaggcaggagaaucacuugaacccaggagguggaggucgcagugagccaagaucacgccauugcacuccagccugggcaacagacugaaacucugucucaaaaaaauaaauaaaugucacauggauaguugccuugacccauuacugcucagcuggucagucugcaaauuguuuaccaguccacaaugagauaaagcacuuguaccacaguguaaaucaagcaugaauuaccuaagcauacugcuuaguucagcugauguuuuuucuuuuguagcaagacuuuguugaugaagaauggagucuauugauuuacauucuggcugaagcucaguaucucauugcaaacugauaaauaauuccagucuaaaggcuuuguauaguacuagcuuacauuaucugcaguacagcaauuuaaggacacauuugguuucauuaguuguaaaguuuaauuuuuauauuuguauuaauacuuuucauuuaccuaaaaaguucuagauuaagugguguuaaagcuaaugaauuauaacuuuguuauaauggcacuugcuauaucuauacuuauuucccauuaaguaguuuuucagaguauuauucccugaaguagguugaucauaccaguucagcacaauuauuucaggaaauauauaaggucauacuucuaauuagauucuacauuguuguagauacucauacauuguuaauaugcugggucuuuuuuuuuuuuuuaaccacuuuuuaauuaagauauguaagauuacagaucuuugggaugcaaagauaaauagggccuaggcuaggaauuuuaugagucugguguuuuguuuguuuuuuaaauuuuuucgagacagucucgcucugucacccaggcuggagugcaguggugcaaucauggcucauugcagccucgaccucccaggcucaagcaauccuuccacaucagccuccagaguagaugggacuacaggcgugcaccgccacacccgacuaauguuuauauuuguuuguagagaugggauuucaccauacugcacaggcuggucuccaauucuuagacucaagcaaggcuuggccucccaaaguguuggaauuacaggugugagccaucuaccuggcccagagucugguuuuaggguugguaaaugauacguguuaagacccauagugugauguuugguaauuugauaauaaugggucagagguguuuggaaauagaagaaagaugaauguuauuuuuuucuuuccguguuuugauacagcugccauuaggccgacaguguguggagcauuaucgcuugcuucaucgauauuguguguuuucccacgaugagaugaucugcaagauggcuuccaaggcugauguauuagauguuguaguggcuucaacuguucagaaagacauggccauuaugauugaggaugagaaagcuuuaagagaaacuguccguaaauugguaaggcuuauggaaauccaacugcauguugucauuggguauuauuuaguaaaauuuuuacgcacuuuaauaucauuuuaagcagucuuuuuaaagccuauuuucuuugaggccauuguaauagauguauaguaguaucucgugguuuuaauuuuuauucacuaucuuauuugccacauguacauaugucucuuugaaguagcuguucaaaugucuugccccuuuaaaaaaaauguuuuguagaaacagggucucacuauguugcccaggcuggucucaaacuccuggguucaagcuauccacccaacucaaccucccaaugugcugggauuacaggcgugagccaccacacccggcuugcccuuuauuuuuuuaaaacauuugguuuuuguaauaauucuuuauguauucugcauaccaguuuuuuuuuuuuuaaaucagauagguguuuugcuaauguuuucucccagucuguggcuugucuuugauuuuccuaccagugucuuucagcaagcaggaguuuuucauuuugaugaaguccaguuuguuaauuauuuucuugugugaaucauguuuuuuugguuuccuauuuaauaaaucuugccuaauccaaaguuacaaagauuuucuccuacaaagucaucuagaauuucauaguuugaaguuuuacauuuaggucuuucaucuauuucaaguaauuuuuguuuuucaaaaauaugagucaagguucauuuuuuugcauguggauaucuaguucuuccagcagcauuucuugaaaagacuaucuuuucuucauuaaauugcuuuggcaccuuuguugaaaaucaauucaccacauaaguaugggucuauuucuggacucuuguguucuggugaucuaugcaucuauucuauugcuaauacuaaauggucuugauuauuguagcuuucuaagaagucuugaaaucagguaguaugagucuucuaacuuuguuuuuuuuaaaaaauuguuuuaucucuuuuacuuuuuuuaauguacauuuuagaaucagcuuauugauuucuaccaaaucaauuccuguuggaauuuugauugagacugcaugaaacuauggauaguuugggggagaauugauaucuuaauaauauugagucuuccaauucaugaacauaguauaauuuuauauugcauguuuuuuggcacuauuauaaauuguacuuuuaaaaacugaauuucuaauuguuuauugcuaguauuuagagagacaauugacuuguauauugaccuugucuccugagaccuugcuaaagucacuuaauucccaguagcuuuuucauggauucuuuuagaauaauaauaucugcaaauaguaauacuguuuuuuuuuuuuuuuuuaaaaauaugugccuuuuuggguagaauccuggaauauuggcucucugcagcccauuuacauuuuaacagcagguuaccuaccuuacccucuuauauuuuacaguugggggaaaauagugcccagaggguuuaaguaacuuaccaaagucuuacaucaaaaaugguagcucauuuuuagaacucugagacuuuuuccauauauggaauuuacaaauuaaaauuagguaugaacuacaugauugauucucaauuaaaauccauggaguugguccuuaaucuuauuuuaaacaaaaauguuaacuuucuccaucccaugaaguccuuuuuaaugaccaauucaagaauaaaaccaaaaucuaauuagcauuuuccuuaccuuccucaucuuuguuggcccauauaauuggcagauaugaaauaguuaaaagguuaaaauacaggauaacagaauaaaagaaagaagcccaguaguucauaaacgacuggcauucucaaggcuggauuaggauccaguuuuagauagggagaaaaggugauagaaguuuggucuuuaaaugacaaaagguguauccaagaaggguucucuagauguuaggugguacagauuauguugaaauuuacugguucaagaccuuauuuuuccugacagucuuuuaggaggaaauguuuaauuaugacuuuagucuuugcuauugcacaaauuuucuaacuauucaguuaaugauauccuuucauauaacuuccuguaaaaggcugagagaccacucagcaucuucccaaacucaauuucugcacgauagucuuuuccacucgucccaucuucuuuccuuuuauuuuuguccuuuuaauagauucuccauauuuccucagaaguaggaaacauauuccuuucuuuuaaucuuaucuauaccucuuaucuauacccaaaauguggacaaggcuaauuuguaguagaacagauaacuaaucucaguaguuuuacaguccuaugguguucauacucagaucaaaaugaccaaacauaaggaccugccuugucugaaaaaggagaucucccuagacaaaugaacuugccuguauuugcuaggucauuuguuucuuuguaugccacacauuuuuaaucaugcaucccuauuuugguaaagcuuuuuuuuuuuuuucagacucaaguacuacugcauguuugucuugggcugguggauuauauuauccuuuggaggucucucuaaaguauacuuuauucuagggagugauugauucggaaagaauggauuuugagcuguugccagaugaugaacgucaguguguaaaaugcaaaacuacaugcuucaugucugccaucuccuguucuuguaaaccuggccuucuuguuugccugcaucauguaaaagaauuguguuccuguccuccuuacaaauauaaauugcgguaaguaggaagaacgauuuuuuuuccuauggaaaacaguugauccuuacuaaaagcucaaugauaccgcaguucuagggcugaaauguuaaguauaaaacaucuaguuuucuccaaagcuacacgucucaaagcuaaguguggugguauuauuuccagguauagguacacgcuggaugaucucuacccuaugaugaaugcauugaagcuucgagcagaaucuuacaacgaaugggccuugaaugugaaugaagcuuuggaggcaaagaucaacaagaagaaaaguaugugauacagaaagugacuuggugauuggcaaauuggggcuuauugugauguagccaaauuaaagucaacaaaacauuucuugaaacagccugaccucauccuugguuagccccucuacauagcccgguuuacagagcaccggcagagaagguuuuaaaaccaagaguggauaaggcaguugcccuuacaucccagugaaauuuuguuauaugaguugugcaacaucacuuacuuaacaaaaacgauauuguuaggaaaccuuuauuuuugucucagaaauaaaaauuucacauuucuuacaaagauguugaaaucuuuaaaaaaacaaaaacaaaaacaaagcaucuugugacaaaggcagcaugacacuaaaucaggagucucugaaaugguaguuuaucacuucuuaguucuaauuaaaguuaaggucccuggcacuugucauuaccuuugaaagucacugcuacccuuuauaucucucucucucuuuuuucuuaugaaaauauaguuuguuuuuugcuuuuuacuuuucaccucagggguauaugugcaagcuuguuacauagauaaacuugugucaugggcguuuguuguacagauuauuucaucauccagguauuaagcuuaguacccauuaguuauuuuucuggagccucucccuccuccugcccuccacccuccaauaggcuccauuguguguuguuccccuguauguguucacguguuacuccccuguaugcauccauguguuuucaucauuuagcucccacuuaauaagugagaauaugcaguauuugcuuuccuguuccuaguguuaguuugcuaacuaauugccuccaguuccauccauguuccugcaaaggacacgagcucauucuuuuuuauggcugcauaguauuccaugguguauauguaccacauuuuucuuuauccagucuaucauugauggguauuuagguugauucuaugucuuugcuauugugaauaguguugcagugaacauacacaugcaugugucuuuauaaauggaaugauguauauuccuuuggguauauacccaguaauggcauugcucggucaaaugguauuucagucuuuagaucuuugaagaaucaccacacugucuuccacaaucguugaacuaauuuacacuucuaccaacaguguauaugcguucccuuuucuccacaaccuugccagcauguuacuuuuugacuuuuuaauaauagccauucugacugguaugaggugauaucucauugugguguuuuuuuuguuuguuuuuguuuuuguuuugagacggagucuugcucugucacccagacuggagugcaguggugcgaucucggcucacugcaaccuccaccuccuggguucaagcaauucuccugccucagccuccuguguagcugggacuacaggcacgugccaacaugcccagcuaauuuuuguauuuuuaguagagacaggauuucaccauguuagucaggcuggccuugaacuccugaccuugugaucugccugccucggccucccaaaguacugggauuacaggcgugagccacugcgcccggccuuucauuguaguuuugauuugcauuucucuaaugaucagugauguugagcuuuuuuucauaugauuguuggccauacguaugucuucuuuugaaaaguaucuuuucauauccuuugccuacuuuuuaauguuuuuuucuuguaaauuuguuuuaaguuccuuauauaugcuggauauuagaccuuugucagaugcacaguuugcaaguauuuucucccauucuguagguugucuauucacucugaugauaguuucuuuugcugugcagaagcucuuuaauuagaucccauuugucaguuuuugcuuuuguugaaguugcuuuuggcaucuucaugaaaucuuugccugugccuauguccugacagguauugccuagguugucauccaggguuuuuauauuuuuggguuuuacauuuaagucuuucauuccucuugaguuaauuuuuguauaugguguaaggaagggguccaguuuuaaucuucugcauauggcuagcuguuauuccagcaccauuuauugaauagggaauccuuucuccauugcuuguuuuuguuagauuaguugaagaucagauaguuguaggugugccuuuuuauuucuggguucucuauucuguucuguuagucugugugucuguuuuuguaccaguccauuucucuuucagaguguuuucacuugcuuccauuucuguagcccaacacguaacuccacccgcuuuuauuuaggggaaaggagcaauaucauugucucugagucuccugugcucuaguaacugagcacacuaguuacucacuaacugcagaauaaaaugcaggaggaagaagugguucaagccacaauaagauuuauauuuacuuugcuuucauaagucaguuguuuucuucuuuuugucuauuuuaaacaugccagguguuuuuuuuuuuuuuuuuuuuuuuuuuuugagacaaggucuugcucugucaucucaacuggagugcaguggcauggucguggcucaccgcagccuugaaauccuggguuuaaguaauccuccugcuuuaguuugucaaauaguugggacuacaguugugugccaccauggcuggcuaaguucuuuaauuuuguagagaggagaucuugcuuguguugaccaggcugguguuaaacuccuggccucaagugaucuuccugccuuggccuugcaaauugcugggauuuacaggcgugagccacuguacccgcccuaaaacaugucaggucuuagcauuuuuauauuuaaguucaacucuaggcacuuguuuaaaaaacuccguguucagccaccacccugcaaaaaucaaaucaacaaauuuguuaauaauuuaaagcauugcaaacauuuguaaguuacauuucuagacaagaacugacaaaaccagucuccucugaauuucauaccaguaguaauaaacauaaugauuacagaaaauaugacuuuuuucuucauuccuaggccuugucagcuucaaggcuuuaauugaagaaucugaaaugaagaaauucccagacaaugaucuuuugcgacaccuucgccuagucacacaggaugcagagaagugugccucuguugcgcagcaguugcuuaauggcaaaaggcaaacuagguaugcgcuucugacugcgugaguuuggauucuuuggcaccuauguuuggaaaccuguugugacuccugucuugaauuucugugaccaccugggugugguggacauguauguauucuuauauggcuuccuugggccuuugucuuuacagauaucgaucugguggagggaaaucccaaaaucaguugacagugaaugagcuccggcaguuuguaacacagcuguaugcucuuccauguguccucagucagacaccauuacuaaagguaaccauagagggaugugugggagaauacuuugguaauccuguauuuuguauauaaacucuauugauauuacuaaguaaucuucuuugaugauuaauauguacauuuauuugcagaugcuuuuaauaaccuauugagugguauauguauauaaagagauuauaguagauccacagaggggaaauaaaguuggaaauuuuuacuuugaaagugaccuuggcugggcaugguggcucacaccuguaaccccagcacuuugggaggcugaggagguggaucaugaggucaggaguucaagaccagccugaccaauauggugaaaccccaucucuacuaaaaauagaaaaauuagccgggcaugguggugcaugccuguagucccagcuacuugggaggcugaagcaggagaaucgcuugaacccaagaggcggagguugcagaaaaaaaaaaaaagagaaagugaccucagcuaguuuaagcugggauaaggugucuguuauagucacuuaguauuugcuguuaguuggcuuauguguuaucuuauuuaccuauauuauuacuaaaauuaaaugggaucucauugaauaugaauuuaagauucuaaguuugaaagaagccaauuacugaaauuacuguuuuaaugcaacaaccuguguauuuuuuuuuaggaucucuugaaucguguagaagauuuucaacagcauagucagaaacuacucucugaggaaacgccuagugcugcggagcugcaggacuugcuagaugucagcuuugaauuugauguugaacuuccacagcuugcugagaugcguauccguuuggaacaagcccguuggcuagaagaggugcagcaagcuugccuagaccccagcucccuuacuuuagaugauaugagacgucucauagaccuagggguagggcuggccccguauucagcaguggagaaagcuauggcccggcugcaggaacugcucacagugucagagcacugggacgacaaagccaagagucuccucaaggccaggugaaaaagcagacuucucuuucuuugggaagguuggacaguuaucuccagcuuaaacacagagcacaaugauuggucuauggcaagugcucaguagcugcgguuauuaugcauguggaagacauguagaaauagcugagauauuuggagcugcuuugggaccugaguaaaagaauguuaauuuuuucuuauuuuacugauuaaaaaugaauaauucaauuggacacaccuuuucuagaguugguuuaaugaaauuucccuggauccuguuaauaucgugucuuugagagaggaaaauauuuacaaauaggugaagcuguuuaaacucacaguuaauacgguuccaaggagucuuaaagagaaaugugugagaguuaauaggcacuguucugcaagaaaacagugcagauaauuuucaacaggaauagacaaugucauuugaaaaaaauuauuugccauacugaauuuccuuugaaaugcuaguuuuuuugguaaccauaagaaaaaugaaccaucauauaaaaugcuaagaagucuuuguuugcauuuuguaggccacgacauucauugaauagccuugcuacggcaguaaaggaaaucgaagagaucccugcauaucugcccaauggugcggcucugaaagacucagugcagagagccagagacuggcuucaggauguagagggccugcagguugguuuuaaaaaguauauacagaauguguaagugcauccauaaagagcaauauuggcgccccguccgggagggaggugggggggucagcccccgacccggccagccgccccguccgggaggugaggggcgccucugcccagccgccccuacugggaagugaggagccccucugcccggccagccgccccguccgggagggaggugagggggucagccccccgcccggccagccgccccguccgggagggaggugggggggucagacccccacccggccggcugcccuguccgggagggaggugggggggucagccccccgcccggccggccaccccguccgggaggugaggggcgccucugcccggccgccccuacuggaaagugaggagccccucugcccggccagccgccccguccgggagggaggcgggagggucagcccccaacccggccagccgccccguccgggaggugaggggcgccucugcccggccgccccuacugggaagugaggagccccucugcccggccagccgccccguccgggagggagguggggggggucagccccaugcccggccagccgccccguccgggaggugaggggcgccucugcccggcugccccuacugggaugugaggagcuccucugcccggccaccaccccgucugggagguguacccaacagcucauugagaacgggccgggaugacaauggcgguuuuguggaauagaaaggggggaaagguggggaaaagauugagaaaucggaugguugccgugucuguguagaaagaaguagacaugggagacuuuucauuuuguucuguaccaagaaaaauucuucugccuugggauccuguugaucggugaccuuacccccaacccugugcucucugaaacaugugcuguguccacucaggguuaaauggauuaagggcggugcaagaugugcuuuguuuaacagaugcuugaaggcagcaugcucauuaagaaucaucaccacucccuaaucucaaguacccagggacacaaacacugccgaaggccgcaggguccucugccuaggaaaaccagagaccuuuguucacuuguuuaucugcugacguucccuccacuauuguccuaugacccugccaacucccccucugcgagaaacacccaagaaugaucaauaaaaaauaaauaaauaaauaaaaauaaaaauaaaaaaggcaaaaaaaaaaaagagcaauauuggaaaguugugaagaauaauacguuggaucuugcugcacaguuucaguauuuuagggguugaccagaagacuaauucuauucauacuuauuuggauguacuuaccagcuauuauccugaccaguugucucaaauauuuaaagcuuagacagugucaccaacuuuuucugggagcuggggagucuuucauaacaaacuugaguacuugacugcagauugaagcaaaagagcuaacaaugaaguagugagagaaaguaguuuucuacucuuugauaaguaugauuaccucuuguuggcuuguccacaacuuugaaguucagacaaucaguaauagcaaauucagugaaucuaguuauaugacuaaaugcccagcuaagccccaaggcccagaauuuucaugaaguagugacuuaaaaguacccucccaacccuacaaaagaaauaaaaccuacccaguuccaaaguaauuauccaaaguauccaaagucauuuccaccaaguauuugugguuuuaugcuagauguuauacuuauugaccuguauauaaguuuaaaaaaagaauuaaauucacuuguagcauuguuaagguacaaaaagaauucauucuuuaauaugauuuucccaguuuucagacgacuggcugaaugacuuaauuugaaacguguuugaugggggaugucuucccuuaucucuuaucaucauaaaccaauagguguuacugaccuauugagaaaaaaaaaagucucaaguucuauuuuguugaaguccucaaauucuagaaauaaaauacgaucuggcuuucugaauauuuguguaauuuuaagugguguuaauuggcuaauugcuaacaagaaauaccaaacaggacaauucuagacaaauguuugcaucuguucuuguuaauagggaaaagaagauauauuguuugaggagauuacauaauuaaggacugacuccagcaagccaaaaacaaaaacaaaaguauuuacuauggacauaaacuuuguuaaugagaguuuuagaugcaggcacuugucaaugauaguugguauuguaguaauuaguuuuaguuaugguccuccuuuuuacuccaugauugcuagcagccagaaggugaagucauggcaguaaggagaggcugacauauaaaaucagaaagcaagggcaugcuucuggaugaguuuauuuccuucauauuuuauauguauaugcuacuuacuauguuuguaacagugccauuaagggcaaaaggcaaguuuuuugcuucauuccugaaaaaguagccuaccuuuuuuuugcaucauauauuuaaggacugcuacacaugacuaacaacaaggaacuacuuccuauuuaguggauuauuuaaauguuaugcaguauucugcuuuacacauaggaagcacucggauuucuaaauuaaauaucauaggaauagcauuaauuuaugagucacauucuuaaguguccaucagaacauuuaugcccuaacagauuuaauucuguaagaauaaauaucaaaggcagcaaaauaucaaccuacccagucuucccuaguugucccaaaaaugucccuuauggcuguuugucuaacccagaaacacauguugcaccuaauugucaucucuuuaaguuucuuuuaaucuuguagcguuuuccuccccaccccacuuuuucucaugucacugacuagacaguuaucccaugguaugcuccaccuucuggauuuguuugauuguuucuuuguggaguguucuguucucuguauuuccuauaaauuggaaguuaguuuuaaagcccuggugcauccaaguuaaacauuuuuuuaauauaaugcauuaaaaugucagguaauacuguauauucuauauugcaucacaacaggagauauaucuggaugaccuaccauuagugaugcuaaguuuuacauuguauuggagcaacaccaaugcauuucauccuccauaaccuuaaugcuuuuacucuccuaguuuggcuaucucuuucuaaaaauacaguucccagaccagcaguauuagcaucggcaacagcagcuuuaccugggaacuuguuagaagugcaaauuuauggaccuuccucugacccacugaauuagaauauuuggggauaggacuaaggaaacuguguuuaaacaagccuuccagaugauucuuauacaugguaaaguuagagaaccacugggcugucucaacuuauauuuuaguuuccugaauaauuuauauugaguugcuuuaauuaaucauuggugaguggauugggguaaaauauuguuuuguugccuuuuauuuguguaauucaguaugaaagucuugaguuacuacaaaccuucauuucuguugaaauuuuuuucaaacuguuaauaggaaccaaugagaugaaugaauuuagaaggguauaaauagaacaaagggaccacaguauaugccauguucacauuuguauccuuagagccuagcacaaacuagguucucuaggcccagcacaguggcucacuguaaucccagcacuuugggaggccaaggugggaggauugcuugaggccaggaguuugagaccagccuggccaacauggugaaacaccaucucuacuaaaaauauaaaaauuaguugggcguggugaugggugccuguaaucccagcuacccgggaggcugaggcaggagaauugcuugaacccaggagguagagguugcagugagcugagauugcaccacugcauugcagcccaggcaagagugauacuccgucuuaaaaaaagaaaaaaaaaacaacacuaccaccaccaccaccaacaaaagacccaaacuagguucucuguuuguguaaugaaggaacaaaugucacuucuacccccaauaucauuggucagcuggcagguuagucagcguuugugaauuuagcauguugagaucauggaguaaucugaaguacucaauggaccaaucugaauuaagcuuuuccuguuuuucauagaaguguucuuuucucuaaacugcuguaauuuuucuugacuuauuaggcuggaggacgugugccaguguuagacacacucauagaacuuguuacacgaggccgaucuauccccguacaucugaauucuuugccaagacuggaaacccuaguagcugagguucaggcuuggaaagaaugugcuguuaauacauucuugacugagaauucuccauauucucucuuagagguaaguuuacaaccagcucaucugcaagaccuuagaucuccuaguuugguaaaacaugcaguucaucacauacaaagaugacaucacagauuaaucuauauucugugaguuguucuucccguaaagccagggagacucuucuaauuuucuggugaagcaaccuuuaaauguuuucuugguugauuuagcauaacaguaucuaaagaagaaaauuuuuuccuauugggugaaauuccucuguguugaaauuggacucuuaaacuuggccgugcuucgcccaccugaauuuaguaagccugauaaaugaucucccccauuuuuuaaaagugcuuuaacugcacuuuuuguauuuucuguaaacuugcuugugcaucaugacugggaucaaccaguauauaucacauuuuuaacuuguuacuuaauugaauaaggaaucagucuaucuuuuaugagucuuccuccuccuuuuguaaaggagagccucaggguugcauguuccaaagaaaaucuucaauacuaagaaaugcacauccuuuuuacugcuuaggcuuuuauuuugggacuuccuacauaaugcuuuaucugaaauuuauuuuaccauugguugugccuugucccacauuaggugcuguguccucgaugugauauuggccuuuugggauugaaaaggaagcagagaaaguuaaaggagcccuugccaaauggaaagaaaaaaagcaccaaauuagagagucugagugaccuggagagagcuuuaacugaaagcaaggagacugcuucagcuguauguaggguuuuuuucuucuccuuucuauguuauugggaagaauaauuucuaacccuuucuguuuuauaggaauuuggagaaggcaaguagaguaacuugaaagcguucaguuuuacuaaaaagacuuuuugaaaauugucaaguguuaagaguuuugaaugguaagaugcauagaggugggaaagauucaggguaggcuucccagucucagggucuugcaggcacagaaacagucuuguuuagugccuguggguugauccaggaaugcuaacuaaagauauugagacuaauauuaauagauguaugaaaaugcaaugcuaauuuauuaguuuauaguuaagaaguacauuuaaaaguuuacuggauacuuugauacucaucuggaauaccuuacaucucugaccugcauuuaguaaauacuguugauucaaagaugauaguuuaaagaagaugaggcaauguauaacuaauguuacacauuaagcaccuuaucgggauaaaaaagggauagcuaugugaugcuuuuaauggcacaaagcauugcccguucuagagugggaauguauaccugcuacugggacuagauugaauggguucaucuguggaucuggacaccuucucccauugauuucuuuguagcugccagaccucuugugauagacauggguugccuugauuuauuuagguauuuugacacagauguucuuaguguauauucguauauucagucagguucuagacagaauucugccaucagagguccuccauuccaucugugguuuguuuuuauaaagacuaacugaaaguuacagucccccucuccugagguguauauauguugguuugaaacuuuauaugcaguaucuuuuguagauuuuagucuguccaucugucuguagaccccugguuuuaagaauucucccuacguauuaucuguuaauuuaugguagaacucaaagguuagucauuugcuuuccaucucuaagcugucagaaguuaccuuguuaucauauaacccacacauauuaccuguguauuauauuuacaaaagaaguggauuuuuuuuuuuuuuuaauauacccaaaggucuuuaccugauuugcuuuuaggcuuuuuuuuuuuuuuuuuaauagagauaauggagaguuuauucuggccuuguaagggugcuucaucuggugaaucgugauggaucugaaaggggauagauguggugauuggaaaugguuuuuuaacugugacagauuuuuugagaacuuguuuacuaugugccaggcaaagaguguccuaucccacaucucuuacuugucaucucacccuguaaggugggcacuauuaucaccuccauuuuacacaugcagaaauuuagccacaauggaauacauggcaccaggucacucacagcuuaguaugaggcagucaggauuugaauacagaugaucuacucaggaucccaugcucuuaaccacuaggacucugaguuuuaggggaaggccaagccaucucggacaucauccuugauuguuaacucuuuuucagauggcaacucuuggggaagcucgccuaagggaaauggaagccuugcagucucucagacucgccaaugaagggaaauugcugucgccucuccaagauguggauauaaaaaucugccuaugucagaaggccccagcugccccuaugauucaaugugaacucugcagggaugcuuuccacaccaguuguguggcgguacccaguauuucacagggccugcgaaucuggcuuuguccccauugucggaggucagagaaaccuccauuagagaaaauucugccccugcucgccucccuucagcguauccgaguucgccuuccugagggagaugcacuucgauauaugauugaaagaaccgugaacuggcagcacagagcccagcaacugcuuucgucagggaaucuuaaauuugugcaagaucgagugggcucaggacuguuauauagcagauggcaagccucagcaggacaggugucagacacaaacaaggugaaucuggacuuuccuuguuggguuauuggaauuugcaaagcucuguaccuuucucucgaaccuguagcuuugguguugcuauucccuuggugugaucacuuuacuguuaacagcacccacuuuaccuguagcuucccacuucaagaccaugcagguauaacauauucuuuuaauuuccucugcuccuauuagaaguuguuucccaggcacucuuucuauagagcacauauuuagcuuuucacagauacaaauaauuuuuucauuuauauguaugcugacccauuuauauuuuacauauacguauaugauguaucuuuaagucuuugcuugacuaaaaaguuuuuuacccugcuucuucucauguaagucaauuaguagaaagggaaaacacuuccugccuuuuaucgcuuuuugcccuuuaagggaaaauauuuuuuggaagaaguguuugagcacuguguuauuucagaggaaagcuccuggguuacacaccauuugcgaucuuucugccaaaagcuggauucuuuugacaucacuggaugggcagaguuuucuguuaucuuccauagguggcugcaguaaaagaaugugaagacaauagaaaaguacaaucaggaagacaguauucaaucuuuaugagguuaaucugaugguuuuuaaaguugguaaacaucucuguaccagagauaccacaacucucuugugccauaugagcacagacacauggauuauaugaguuaaauuguugauaagaugaagaccaaacaaaaaaaaaaacagucugucauauuuguuuccuugguuuuuuauuucuuugcaggcuucugaaauacagugccugacacauagaugaugaauuaaauauuuguugcauagaugaguuguggcauuugugcacacucccaaaguggagucauugguguucuuuacccaggaugugcuaggaguuuaccuuucuuaguaaagggaaaggacacaacucuuauauuaauucauggucaaaggaguguuuccccuagcuccuuuaauaaaacacuaaggaagauaggaaagugguuauggaugauuucugacagguccucauuugauuuacucaaagggguacauauguguucaucguauuuuaaucuucaauaaggagaauuagaaaaggauuaaaaggcuguaugaucuguucucacacugagaaaguggcuuauuucccaguggccuucuuuacaucucugaaaucaguccaaguaaaacuggaaagauuaaaggcuuggucuuugggaagauaugaguugauuuggccaguucugaaaugccaggagacucuucaguaggggaaaaucaaguuguuuuuuuuuuuuuuuccccugguugccugccuggguaaugcaagcuacugucauuggacuaaugggaguauuuuuaauccugaagagauuuuauuauaaaacguuuucccuccauuagguaucucaaccuccuggcacaacaucauuuucuuugccugaugacugggacaacagaaccucauauuugcacucccccuucucaacuggacgaaguuguaucccccuccaugguuuguauuuuguuauuacguugagggcuggauaguaaugagugaucuuguauuacuagguuuuuauuauagaugaucaaguaccauaaaaaggacuuuaugcugaaauguaggauauaggcuauuauguauuugcaaaauagggaagggauccuauuugaaggcuuauaaaugcaaaggaacagagaggaagacuuuauauccauuguccucagggaugaaaggguucaugccacaccagcugauaaacaccaagcuuuuaagucagaugcuaagucaugggcucucuuguugcuucauuacuuaggagacuuguggagaaucuuagggauaauccacauuugcuagaguccugauccuuagucauagcaucucaguguaugucuaguaaugugguuagagcuccuugaucuacucagacuguugacacuguggccaucagucuguuucugugcuuucuguuagaagucaucaaggcagaaguacaaucucuucugcauuagcaauaagguaaaugagaagaggauucaguguauaauuaauacuaguaaucagaagacuuaggaaaucuaguuuuggcucuguuuauuauauuguggcuuuaggcacauuaaaccucacuucaacugaagguaauuuguaauuuaagaaggagaggguaguagugguauuaggggcaguccuucuauuugucucauaaacccaaaugugaaugugaaacacccuuuguuguuaucauuuugauuuggucuggucuuuuacagguguuaguccagaagugaaugaacuauugauggaagcccagcugcuccagguaucccuuccugaaauucaggaacuuuaccagacuuuacuugcaaagccaagcccugcucagcagacugaccgaagcucaccagugagacccagcagugagaaggugagugucugagaggcuucuggggcaaggcacagucugggguggggguaugcuuuauuuuacuccucgaaacauaaccagacagcuggugugaggacugggcgauuagacugaggaugacccauuuugaaugcugacuuaguugaaggauacuccuuaauguccuguuucuuaacauaguuaaggauacugcggcugcugccacuuccuucuagugaacuaacugacccaucacauuuaaggccccugagaauauaguuaggauagaaaucuacuaggaagccugaagccaaauuagggaagaacuucacuaaagauagcaugagggcugauguuggcauuuagaauuucauuuuucauggcaaauuucauuugccauaccaaguaguauggcacaaucauugaauguguucaguuaaugcgccuuacaccuauaagguguggggguguacauccuucaagaaggaagauuauuagugugguuccucaggagccuguaggucacaggauagacauaaacaccuagacagaaacuauuauaguaguuagucauucagggauuuggugaaaggaagacucuuagugggcaccucuccaucuucugguauugguugguuaauuggaaggguaaucacgucuuuaacauuccuuuuuccagugauccuuugguagcauuaacagugauaggggaaggaaguauguuaaacccaaacugguugucuuauacaagacugggaggggagugguuaagaugcaguauuuuuuucccguguagauugggggaucaucugauuucuaauuuacauguucucuuuagcuucauuaguuuuaguaauaggugacccauaggcgaaaauugaacuuuccuaucuuccacccagaaugacuguugccgagggaagcgagauggaauuaacagucuugagagaaaacugaagagacgccuggaaagagagggccucuccagugagcggugggaacgaguuaagaaaaugcggacccccaaaaagaagaaaaucaaacugagccaccccaaggacaugaacaauuucaaguuagagagagagcguagcuaugaauuaguucguucugcugaaacucauucccugcccucagacacauccuauuccgaacaggaagacucugaggaugaagaugccaucugcccagcugugagcugccugcagccagaaggagaugaggucagugagguuugggccauagaggacgugcuuucccuuaacucagaaacccuguaagcuagaccucaucucgcugggucuuucuccucugcuuaucugcuuugagcugaucugaauggauugcucagcccuucccccacugauaucugugcucuuaccaucguuccugggucuccucccuuuucuugaagaaacucuuguucuucccuuuuuccuuuucuugcucuuccagcuuucaccuucccggcgcuaagaaggugggagggaugcugaugugaugcccuuuggcuuacuuaucacagggcagcgcugucuuaaccccaaagcagacacgacuugaagaaugacuuugacucgguugcuuuggcuagggggccagcuacacucauuuggcuuagcuguugugccagaggucccaguggugggacaguggcuguuauuggcaaacggccugaauuucuugaggcuggccugcccaauuuugaauccauuuuuuccucugaaaaccccaucuuccugcucuuuguaaccagguggacuggguccagugugauggcagcugcaaucagugguuucaucaggucuguguuggugucuccccagagauggcagagaaagaagacuacaucugugugcgcuguacugugaaggacgcaccaagccgaaaguaaaaacacaaaaacagauaccccccuacuuaauguaauucaggacuccaaccaagaggauuucuucaaaucucagcaaagcuacaggacugguacucaagccagccuguaaacggugcuauuucuauuccuuaugggaucauuuuuccaggacucuuugaagaaaagaaaaaacaacuaaaaaaauuuuugacacuuuuuguauuuuuuccuuaagagcuauuugugguuguugagguuugaaaagcugacuguuuuuuuugcagggguucccaccaauuuggaaggcauugaagcuugcaccuuuucauguacagcauuaaaauuuuaccucucucugggauuuaccagcuuaagaguccaacucacuuccagugcccaaaagggcacccaccagaaauuccaguaaauccucauuugaggaagcucucccuuguuuacucuguuaccacauuggggaaauuuuuaaguuuuucacuuugggaguuuuuguuuguuucuucuuuuccuuuauccacuuuucuucuuccugguagacuagguuuauuuaucugagcaauaacuucuauguugguuucaguggcuggaauuaaaacaaaacaaaacaaacuuccaaacaguguguuggugcuuuagcgauugauugauguacagaacacaaaugucuaguuucuagugucacugaugaacuagugauguagaaaagagacuucucuguaaguaauugccacagcuguauuuuggcuuucucccugucccuuccuuucuccccuauuuuuugguagcuuguaucaaauguuacaguuuauauuguggaauaaauccuucguccuaacauaacacuaaaugcugauuauuuagagccauuagagcacagcuucuucugccccucuacuguugcacagccagaaggggcugcuugcuuuugccucugcccaaccagguugcaguagcaguggauguuagccugcaaacaacauuaggggauucuucuuuuguguccugcucuguuuggugggccauaugccuacagcccucacuaacaaagaaccccucugucuucaaggacuagaaccuaucuuuaaagccgugcucuuuuaaaauaagcuuucucagaauguuggcaaaucacuucaauccucaaaucagucuuccuuguggaaugcugccuuuauuauauuugaauugacaggggaacuugguuuaggguuaagacguuggaaggaaaucuaaggaaaauuaauccucacagagguccggguuuaguauaugucuugagaggagacuugugaauucccagacucugccuccugguuuccuuucucauuucuuucuaacuguagcuaucauuacuggcuguggauagcccauagcuauuuuccuugcuuuucuuuuuuaaaggggucuguucugcaguggagaagacauucuggugaccagacuuuugcuuaccuuuuccuauucuguugccaauuuuuguuuuccccacauucuauagccauaaaccugaagaugaguaaaacuggugggucuuuaauaaaacaacaacaaaaacagcaguuugugauauagcagagguuuaaauguacccuccccuuuuaugcacuucaaauaauuaaaucucuuuaagaauga

SEQ ID NO: 191145 - RNA, 10310 nt, Homo sapiens
agucagaggucgcgcaggcgcugguaccccguugguccgcgcguugcugcguugugaggggugucagcucagguaagcaaggagaguauuccgguuccccaucugaaagaagguacacuggagaaggucacugagucuuggggggaaggaguccuguuuccgccuaauaugggaguuuucgucuccucugaaaggagagccuuagaaaagccacuguugagcggagggucucaccguaucuuugcaugaaaucguggucagagcucccccgagccguccuccugccacagcagggagaaauuugccacuagaagggacauaacagcccaguacuugcugcggguugugcacuggcuguucuuuuuuuuuuuuuuuuuuuuuuuuuuuuugagacggagucucgcucugucgcccaggcuggagugcaguggcgggaucucggcucacugcaagcuccgccucccggguucacgccauucuccugccucagccucccaaguagcugggacuacaggcgcccgccacuacgcccggcuaauuuuuuguauuuucaguagagacgggguuucaccguuuuagccgggauggucucgaucuccugaccucgugauccgcccgccucggccucccaaagugcugggauuacaggcgugagccaccgcgcccggccuguucuuuugucuucuucaacaucugguccaaacccacguuucguucauuaauuauccaaauuuacugcagacuugauacaaaaaaagacuagggaccugcugucaaggaauuccuccuaaggagaagaaacugucaggugaauuagaacacgaugcaaauagauguagacgcacagagggugacguuggaaaggugugagugguggggaggcauuacuggagaaggaguugugauuuaauauguaaccuuuaauaucuaaaggugugaaagaauaaaacuuuuaugggcagcaggaauagugcaguguggcugaagcaugaguuuguggagaguagauacuggauauaaggcgggauauaaggguuagauuguaaagaaccuuuauacccugaaaaauaggcaguuauucauggcauuugagccaaagaauggcauaugccaauuuugguuaacauagugaggcuggagucugguugcuuccuugggagaaauugucuugcuuguucuaauccuuuuaccauggcuuuccacuguucucauuuuauauaaagguauacuuuauacuugugauacuuuuacuguacagucaacccucuguauccaugagggaugguuccaggacauccugcagaucccaaauccaccaaaggucaagucccagauauaaaaugguguaguauuugcauauaaccuaugcauguccucccauauacuuuauauuuaagagauggggauauccuuuguugcacaggcugguucuuuuuuucuuuuuuuuuuuuuuaagaaagggucucgcucugccacccaggcuggagugcaguggcgcgaucuuggcucacugcaaccuccgccuuccugguugaagccauucuccugccucagccuuccaaguagcugggauuacaggcgugcaccaccacacuuugcuaauuuuuguauuuuuaauagagaugggguuuccucauguuggccaggcuggucucaaacuccugaccucaaaugacccacccaccuuggccuaccaaagugcugggauuacaggugugagccaccaugccuggccaguuuuguuuuguuuuguuuuugagacagagucuugcucugucgcccaggcuggaguacaguggcgcgaucucagcccacuguaaccuccaccuucugaguucaagccuuucuccugccucagccuccugaguagcugggauuacaggccuccacccccgcagcuggcuaauuuuuauauuuuuaguagagaggggauuuccccauguuggccaggcuggucuggaacucccgaucucaagugauccaccugccucagccucccaaagugcugggauuacaggcgugagccacugugccaggccucacaagcuggucuugaaccucugcauguccucccauauacuuuauuuauuuuagagaugggguucuccuuuguugcacaggcuggucuugaaccccuggccucaagugauccuucugccuugaucucccaaagugcugcaauuacaggugugagccaccgugcccagccccacccccauauacuuugaauuauuucuugauuacuuauaauaccuaauaaaaugcuaaguaaauuguuguuacacuguauuguuuagggaauaaugacaagaaaaaauguauaguacguguuuggacgaagauguuuuuuuuuuuuuuuuuuuuuuugagacagaguccuaaucuaucgcccaggcuggggugcaguggcgugaucuugaaguacaaaacacuuccagcaaaaaaucuuuauuuuuaagaaaaaaguauuuuuucucauuuucuauuuuugucauaaauuuuuauucuuuccaguggaaccaaaacuugaacuuccuuuugguugauacaugcccagcaagacugaucaaagaaaagauggcacagauaaacaguguuagaaaugaaaauggaaacauaaccauagauaacuacagauuaaaaagauaaaacauuauacaaauaaauugaaaauugcauguaauagauaaauuuguggaaaaauuuaacuugccaaaauugaugcaagaauaaauaacuugaauaagauucaaguaaauuggauuuguagguuaaaauuuucucaaaaugaaaacaccaggaucagauggaguuauuccagacaaccuaguaacaaauuaucucuuggacuaauccacaauauguuaaaaaaaaaaaaaaaaaaaaaaaggaggcaauacucccuaacucauuuuaggaggcuagcauaaccuugauagcuaauaaagacaaaauuagaaaggacaguuauaggccagucuuacugauuagcauaguguuaaaagcuuucccuuuaagguuagaaaucugacaagaaugccaacuaucagcuuuucuuucuuucuuuuuucuuuuuuuuuuuuggcuguuguuuagacagggucucacucugccucccaggcuggagugcaguggcacaaucauggcucacuacagccucagucuccccgggcucaggucauccucccaccuuagccuccugaguagcugggauuacaggcucaugccagcaugcuuggcccagcuaucagcuuuuucauuuaacauuguacuagaaguuacugucagaauagaaggcaggaaaagaauuagaagggaagaaauaaacuugauuauauguggaugacaugauuggcaguguggaauuaccauucccagacugcuccccaccccaaauagauucaucauuagcauuacuaaggcuuugguuaaaaaucaguuagauuggcugggcgagguggcucaugccuguaaucccagcacuuugagaggcugagauggguggauuaccugagguccgugguucgagaccagccucacuaacauggagaaacccugucuuuacuaaaaaaauacaauauuaccugggccuaauggugcaugccuguaacgccagcuacucaggaggcugagacaggagaaucgcuugaacccaggagguggagauugcggugagccaagagcacaccauugcacuccagccugggcaacaagagcaaaacuccaucucaaaaaaauaaaaaaaaaucaauuagauuuacauguaucaguaagaaauggguagaaaauaguguuuuugaaaagauagcaaaaauauaaauacuuagaaaucagucuaacaaaaauuagauaaagcuuuauagagaaaauuauaaaaccuuuggaaagcaucaaaaaaaagacugaaacagcguguucauggaucuuaggauucaauaucauaaagauaucaguuaucuccaaauugaucuauagcaucaauaaaauuacaauccaaaccacagaacccuguuaugauuuggauuauaauuucagauauacauauuuauguauauauuuauggacuuaugaacugauucucaaauuuauauggaagagcaaagagucaagaauaaucaagucauuccugaagaaaaagaccagguggauaagcuauaguaaaacaucacauuguacaccuuaaauauauacaauuuguauuugccaguuauaccucaguaaagcugggaaaaaauuuaaauaauaaaaaaugaauaagcuauaguaauucaaacaguggaguauugucucagaaauaauccacuugaccaguggaacaaauucaagagucccaaaacaaauccacacauauagaaauuuaauuuauaguaauaucagcagggaaaggauggacugauucaguaaaugauguuagaacaauugacuauucauauggggaaaaacuuuaaauuggacccccaccucacucacuauacauaaaauucaauuccuaguggauucaauauuuaaauuugaauagcaaaauuauaaaauauuugaaggcuauguaggaauaucucuacauuuggggguaaggaaaaauuuaauacacaaaguauaaauguaaagaaagagauuuuaagauugauuauguuaagaguauguguuuauugaaagacaccauguacaacauggaaagauaagcacaaacugggggauauuuguaacacauuaaaggauugguguuggcugggcgcgguggcucacgccuguaauccuagcacuuugggaggcugagguggguggaucacgaggucaggaguucaagaccagccuggccaagauggugaaaccccaucucuacuaaaaauacaaaaaguagccgggcgugguggcgggcgucuguaaugccagcugcucgggaggcugaggcagagaauugcuugaacccggaaggcugagguugcagugagccgagaucgcaccacugcacuccagccugggcaacagaccgagacuccgucuaaaaaacaaaagggauuaguguccuuugcuugguuaguaaagagagaacuagaguugagaagaguguugggugaauauguguguagguguugguuuuaggugagagagacuuugagcauauuugaacauugaggguaagaaagauggaauaauugauggaaugguaucccugaagauugggagaagguggaauccauagcacauggagagaaacucggacauuuaacauuuguuuguaccugagaauguugacuaucucuaccauucuugcucucacaaagcauauguagacuuccucacaacagcaaauauuugucaaaucccuuacuaugacaggcaugcuaaggcuacaauaguaagcaaaaucagacccaggccuggccucaugaguuuauaauuuaucaguggaaacacccauuauuuaaaaccuuuaguguuuuuauuuuuuguagaacuuuuugcauuuuuaguucuuuauuuuaaaaauauauuugcuuguauagauaaacguucacaagaagggaguggaaaaacucagauucccuugucagaauagagauuaauaagaggaaucuuggacuggcgugguggcacacaccuguacuuccagcuacauaggcggcugagaugggaggaucacuuaagcccagcagguggagauugcagugagcugagauugugccacugcacuccagccugggugacagagcaagacccugccucuaaaaaaaaaaaaaaaaaaaaaaaaaaaagcugggugcauuggcucacgccuguaaucccagcacuuugggaggccaaggcaggcggaucaccugaggucaggcauuugagaccagccuggccaacauggcgaaacccugucucuacuaaaaauacuaaaaugagcugggcaugguggugcacgccuguaaucccagcuacucuggaggcugaggcaugagaauugcucaaacccagaagguggaaauugcagugagcugagauggugucacugcccuccagucugggugacagagugaaacugugucucaaaacaaaaaagaggacucugucccccacccucacuacauugaagcuguuugcugaaaacuucauagucauuauugcugaugauuuuauggucaccucuuuucuccuccagugcaucccaggcagcucuuaguguggagcagugaacugugugugguuccuucuacuuggggaucaugcagagagcuucacgucugaagagagagcugcacauguuagccacagagccacccccaggcaucacauguuggcaagauaaagaccaaauggaugaccugcgagcucguagguaucaaaucauguauaugaugaaagucaugacccuauugaagauugugcugaaauaaaacauuuuguguauucuucuaaaguaaggagcaguuauaaggucagagugcccuaccaucuuucuacccaaauuuguuuacauuuauaaaagguuugcuugacauuucuugcuucuuugacuuuuuauuauaccuuaugcugauuuauagccaagauuuaaagcagugaagcaguguuuagaucaaagauaaccaucucaaauaucugugaggccagaugggaaacauacaugauuagaauacugcgguccaaacaaaacaaaucuauagguuguauuuggucuuguggccagcauuuugcaacuucugcuuuagauuuucuauauguccuuuguuugacaccauuaacuuuuugaguacauuagcauugugguguguugcaugaggacuuguuaaaguccuggcagagaauuauuguccuaggccuaguuucucuauuaggaccauagaccucauuagcuccauaugguaguaauucaaaugaucugauucccuuuuaacuuuuucuuucuuuuuucuuuuaagaaauauuagguggagccaacacaccuuaugagaaagguguuuuuaagcuagaaguuaucauuccugagagguuaguaugaaucagcuucucaaccuacauggugaagugcauuuauaaauugggagacagagcaauguaguagauagagcauaaaggacuagguuuuaauccuggccuuaucaugacuuaaggugaccucgaccaaguuauuuucucucucuggaguucaguuuccuucuccagaacaaugggcgagaucacaucaaagacccccucacuuucuaaauugugauaaaauauacauaacauaaaguugaccauuuuuaaguguacaguucagugguauuaaauacauucacauuguuaugcaaccaucaccaacauuuaucuccagaacuuuucauccuccuacacugaaacuucauagccauuaaacucuaacuccccauuucuccccgcucucagccccuggcaaccacuauugugcuuucuuaacauuaagcuccccccggcuuuuucuuuuaacauuuauuuuagguuccgggguacaugugcaaguuuguuauauagguaaacucaugauaucacggggauuuguuguacagauuauuuugucacccagguacuaagccuaguauccaguaguuuugcccuucucuguccucccacccuccacccucagguaggccccagugucugucguuccccucuuuguguccauauguucucaucauuuagcucccacuuauaaaugagagcaugugguauuuggcuuucuguuccugcaaagaccaugaucucguucuuuuuaugguuaaggccccuuuuaauucaagucuccuuuaaggcucucaucaggugaguuacaguuguaguuuuguacagaacggggaagggaagaaaugacuaucugacaguugaaacauagacaucuaaucacuaggucagauccuggccaaacuuguuaaagucuugggagaacagcuuaauaaucauguggugcaucaguucuaaaaauagacugggaacuuugcaaggucggugucucacuaaagauacauaauaaccaaaugcaacguaugaauuguaauuggguccuguuuugaaaaacccagcaauaaaaaaaaaaaacuggggagaacaacugaaaucugaacaguaaaugauauuagggaauuaguucuuaaauuuuucaaagggguaauaguauugcauuuauaugggagaauguucuuauucuuagaagauaugcuggaguauuuagagguaaaguggcuugaauccaggugguagauauauggauguuuucaauacuguuauuucaaacugauuuauuuuaaauuuucauagugaaaauuuaggaagagagaaaguuugccucccaaaggcagucucccugacauuucuauaauaccaaaauuauugugaccaagaaacuauuuaaauguauuuagaagcaaaauuauguaaugaaaauuaucuguugucuuauucuuucauagguacccauuugaaccuccucagauccgauuucucacuccaauuuaucauccaaacauugauucugcuggaaggauuugucuggauguucucaaauugccaccaaaagugaguuguggguaaaugguugacucuacagcauucuguuuucuucaucuauuaaacuugaauuagaggaucacauucuaauauaaaagcaacuguucaucuguuuguauauagggugcuuggagaccaucccucaacaucgcaacuguguugaccucuauucagcugcucaugucagaacccaacccugaugacccgcucauggcugacauaguaaauauccccauuuuccucugcaacacauauccuaccuugucuauaccgcuaacucucccugugugaggauagcugcagcagcucuaaccacugcaaaucauguuuuucuccauuaacucuuuucuuugauuucaucucaguccucagaauuuaaauauaauaagccagccuuccucaagaaugccagacaguggacagagaagcaugcaagacagaaacaaaagguauaauguuugcuacuauugucaguuaauuaaguauauauaguauaaaguauauauguauaaauaauguuuuuuuuuuuuuuuuuuuuuuuuuuuuuuuuugagacggagucucgcucugucgcccaggcuggagugcaguggcgggaucucggcucacugcaagcuccgccucccggguucacgccauucuccugccucagccucccaaguagcugggacuacaggcgcccgccacuacgcccggcuaauuuuuuguauuuuuaguagagacgggguuucaccguuuuagccgggauggucucgaucuccugaccucgugauccgcccgccucggccucccaaagugcugggauuacaggcgugagccaccgcgcccggccuaaauaauguuuuuuagauuugccaaauuuguacugaacucuagaaugacuaguuaaucuuuuucuccuauugcaaccuucuaaauaaucauucagcaaaauagccuaauagcucaacuaacaguagauguuucauaacaguugucaccuauugggcaacacuagacggcaggcagcaucugguuaauuuuuuuuauauugcagguagcagggauaguggaguggugucucagauucuuuuuuucuaaguuguccuuuuaacacugagaagaaucuauauuugcagggacuaguugcagagaugggggaaacuuuucuuaggggaccauucauggaagaaaguuaaaggaaaaacuucagguugauagaauuuccucauuuagcaaaauucaaauuacaggaacauggaaaguagcacaucauaguucuugcugaguuaugccaucuuucagauugaguuaaauagcagugguguuacuuguaaaaagaaauaaaaauuaaaacaaaaaaauugaggaagaugucuuugagagaauaucguaugcauaauacuguauuuaaaucuugcaacaaagaaguacauggaaauaauauuacagagcuucauuuuucuccauccuggcauuugugugaaccuuacuguguuucacccugucuccucuuuaggcugaugaggaagagaugcuugauaaucuaccagaggcuggugacuccagaguacacaacucaacacagaaaaggaaggccagucagcuaguaggcauagaaaagaaauuucauccugauguuuaggggacuuguccugguucaucuuaguuaauguguucuuugccaaggugaucuaaguugccuaccuugaauuuuuuuuuaaauauauuugaugacauaauuuuuguguaguuuauuuaucuuguacauauguauuuugaaaucuuuuaaaccugaaaaauaaauagucauuuaauguuga

SEQ ID NO: 191146 - RNA, 23510 nt, Homo sapiens
cccggccggugagcaacggcucugcggccauggcgagcggcgagcauucccccggcagcggcgcggcccggcggccgcugcacuccgcgcaggcuguggacguggccucggccuccaacuuccgggccuuugagcugcugcacuugcaccuggaccugcgggcugaguucgggccuccagggcccggcgcagggagccgggggcugagcggcaccgcgguccuggaccugcgcugccuggagcccgagggcgccgccgagcugcggcuggacucgcacccgugccuggaggugacggcggcggcgcugcggcgggagcggcccggcucggaggagccgccugcggagcccgugagcuucuacacgcagcccuucucgcacuauggccaggcccugugcguguccuucccgcagcccugccgcgccgccgagcgccuccaggugcugcucaccuaccgcgucggggagggacccggggugagugcgccccagacugcgcccgccgcugccugccugcccuuccggcccccagccgcccugcacccucaccuaccccacccgggaggagggacagggaggacccuuccagagcgucccuagaggggccuacuccccgcgcgccgccucuaggccuccuccccuugcuuccucuuuuccucccgggcugccugguuuccuucuggacuuccuccagccacugggcggugcauccuucacccuuuccguccuuccgcgucuccucccuggcccuggaggcuuguccagauugcgccgcauucccgcucaucgcacacugccguuucuaacauuuuccguggcuuucuagaugaccuguuguucaugcacuucacuuagugcccucuuggacuuuugggccgagguaccugauuaucagccaccuuaucucugcuuuaugguggcucuagaauuagccagauguugaucuagcucuuuguucuguguugccuucuaguuccacgguuaaagcucuuaucuuuguuuuuguuuccuccugugaaguccuggauuugauuaacgaaagaauuugaguaaaagugagaacuggaauuagggugcuauaagcauuauaauaauuuggccuucucacuguugguuaacucuuuaauuuuuuuucgggacggggcaaauauuggaaauaagaggauggaguuauguggcuuaugucuguaagagucagaaaauccuuccuggagaguccuuaggcuguggcugccaguuaucucucagguagaguugguugcaaguuucauaguaaacugcuugcuuacaguuuaaucuuuuauuuauuuauuugaggcagagucucacucucguccaggcuggagugcaguggcaagaucucggcucacugcaaccucugcgucguggguucgagcgauucucguaccucacccucccuaguagcugggacuacaggcgugcgccaccacacccggcuaauuuuuguauuguuuaguagagacaaaauuucaccauuuuggucaggcuggucucgaacuccugaccucgugauccgccugccucggcggccucccaaagugcugggauuacaggcgugagccacugcgcccggcccacagcuugguuuuauacauuagggagacaugauacaucagucaguauauguaagaaguacauugguugggucugaaaaggugggacaacuugcagcaaaggcaggaagacuugaagcggcuuccggaucacagauaggugauacacaaaugguuacauucuuuugaguuucugaugagccuuuccaaaggaagcaaaucagauaugcauccaucucagugagcagaguaguggcuuugaauagaaugggaggcaggugugcccuaagcgguucccagguugaguuuucuuuagugauuuugggggcccaagagauuuuccuuucacagccugauaacaccacugcacuccagccugagcaacagagugcgacccuguuuuaacaacaacaacaaaaaagcaaagaugaugaguaagcaauuuugguggaggggggaugauggcuaauauuuaauaagaugagccaggcacuagucuaagugcuugacauagguuaaaugaguugucuuuccauaagugguuaauauggugcgugguacaugguaaguaagcuguguuagcucuuacugcuaacuuuuguauuucuuucuuuuuuuuuuuuuuuuuuuuuuuuuuuuuuuuuuuugagaagggaucaaaaagcucccuacauuguucuuuuuaaaaaucucguuuccaggcugggugugguggcucacaucuguaaucccagcacuuugggaggccagggcuggcagaucaccugaggucaggaguuugagaccagccuggccaacauggugaaacccuaccuccacuaaaaauacaaaaauuagcugguugugguggcucacaccuguaaacccagcuaccugggagccugaggcaggaggaucgcuugaaucugggacacagagguugcagugagcugagaucaugccauugcauuccagccugggugacacagcgaggcuccaucuaaaaaaaaaaaaaaaaaauacucauuuccuagcugaucaguaaaaacaucacugacugauggcauucaaugaucagucaauugaucaauucuuauugacugguauaguggcaccaucucagcucacugcagccuugaccucccuggcucaagugauccucccaccuuagccuccugaguagcugggguagcugggaccaaccacagaccugccaccuccacacuuggcuaauuuuuguuauuuuuuguagagaugggguuuugccauguugcccacgcuggucuugaacuccuggguucaagccaucugcccgcuuuggcaucccaaagugcugggacuacaagcaugagccaacaugccuggcuuaauugagcagccaguucagagaguucccauauacaguucaguaccuccuacauacacauauacacacagauuccccucuugcuaccauuuugcauuaguaugacacauuuguuacaauuaaacaaugcugauauauuauuaaccaagauugaaucauuuuacauuaguauaauaauauauuuguuauaauuaauaaaccaguaccgauacuggaguccauaguuuuuucagauucccuuaguuuuuacuuaaugucuuuuucuguuccaggaagccauccagaauuccacauuauauuuagcugucauguauccucuugggacugugacaguuucucaaacuuuccuuguuuuugauauaacuuugacaguuuguuuguuuuuugagacagggucuugcucugucauccaggccguagugcagugaguggcacaaucauggcucacugcagccuugaucccccugguucaagugauccuccugccucagcccaaguagcugggacuacaggcgcauacaacugcgcccagcuaauuuuuugaauuuauuauuuguagagaugaggucucacuguguuauccaggcuugucucaaacgcuugggcucaaacaaacaauucucccaucuuggccucccaaagaaagugcuagaauuacaggcaugagccacugcucccagccaguuuuuuguuuuuuauuuuuuuauuuuuauuuuuucuguagagacagggucccccuauguugcccaggcuggucucaaacuccuggccucaagcgauccuccugccuugaccucccgaagugcuggcauuacaggugugagccacugagcccagccaaccuugacaguuuugaggaguguuggccagguauagcguaggaugacccuguauuggaauuuaucugauguuuucucaugauuagauugggauuauggguuuugaggggcaauucacagagguaaagugccauuuucuuucuuuuuuuuuuuuuuuuuucuugaaauggaguuucacucuuguuacccaggcuggacugcaguggugugaucucggcucacugcaaccuccgccucccugguucaagcgauucuccucccucagccuccgaaguagcugggacuauaggcauaugccaccacccugguuaauuuuuguauuuuuaguagacacaggguuucacuguguuggccaggcuggucuugaacucccgaccucaggugauccaccagccucggccucccaaagugcugggauuacaggugugagccacugcgcccagccaaagugccauuuucaucagguauugagggcgcauaguauccacaugauuuaugacugucagcguuaaccucgguccccuggcugaagcagugauuaucagcuuucuccacugugaaguuauucucucaucccuuucuauacugcacuguaccuguuauaaggagacuaauuaaauuuuucacacacaaaaacucaaacccagcaucccaacguagcuuccuuaugccucuuaaaauaggucucagacacugcuguguucagaacccuucauuagacuugcccaggccugccuccccaacucugcaucuggagccugcaucuguuuaugccucuccucauguugcugcucgucuccuugugaaugucuccucccuuccuuuccagccaucucaauccugcgugucuuugaagguccagccagaaaguuuucuuccccuaugaaaucauccuggaguaaucgaauccauuucuaaauucuaaaugcuauuuguuacugaccuaugcuccauccugccccucuuccagguaaaugaauggcuguuugcuauaggcaaaaacuggguuuugugauaaaucauucagauuuuacuuuuuuuuuuuuuuuuuuuuuuuuuuugaggcagagucucgcucugucacccaggcuggagugcaguggcaugaucucagcucacugcaacaucugccuccuggguucaagcaauucuccugccucagccuccugaguagcuagaauuacaggugcaugccaucacacccggcuaauuuuuguauuuuuaguagcaacaggguuuuaccauguuauccaggcaggucacgaacgccugaccucaagugauccaccugcgucggacucccaaagugcugggauuacaggcgugagccacugcacccaacccagauuugcccuuuguuuaagagcuaacagaacacagauaaagaaucauauaaccagugccuauuauauaaaauaccuuucuucugaaaagguaaauuuuaggaacagaaaacacauauuaggccaggugcaguggcucaugccuguaaucccagcacuuugggaagcugaggcgggcagaucaccugaggucaggaguucaagaccagccugaccaacaugaugaaaccccgucucuacuaaaaauacaaaauuagucggaugugguggugcaugccuauaaucccagcuacuugggaggcugaggcaggagacucgcuugaacccaggaggcggagacugcagugagcugagaucacaccauugcacuccagccugggcgacaagagugaaacucuaucucgaaaaaaaaaaaagaaaagaaaagagaauguauauuaggcugagcaugauggcuuaugccuguauucccagcacuuugggagacugaggugggcggguugcuugaggccaggaguuggagaccagccuggccaacauggugaaacccuaucuuuacaauacaaaaauuagcuggacuugguggugcacgcgccuguggucccagcuacuugggaggcugaggcaugagaauugcuugaaccugggaggucgagguugcagugagccgagauugcaccacuguacuccagccugggcgacagagcgauacucugucucaaaaaaaaaaaaaaaaaaaaaaaaaacauauuaaucacugacucccaguugaguucugcuuuucugugucuuaucacaaguccaaaugcaguugcuucaguaguuuuuuguuugaugagaaacuacuacagugaaaaggacacagauaggguacagaugacaagaucagaggcucgguccaaggucucugagaugacccaugggaugcagugaggaauggacccuuucugguggcucugcccugugaaguggaugucauacuuuggcauggauuccaggaugaacuaaauacacagaggagagagcuuucuaguucaaaccagacuggcuggcggaaagguuuuaaggauuaccuaaaauucucucauuccagccagcucacuucucuggccagacugagcucgugugggagaugucaguucugaaauguucuucuuuucgcuuagguuugcugguuggcucccgagcagacagcaggaaagaagaagcccuucguguacacccagggccaggcuguccuaaaccgggccuucuucccuugcuucgacacgccugcuguuaaauacaaguauucagcucuuauugagguaaggagacuaagguuaggugcaccugcccuugggaugaagaaaugauuucagaucuaucaaucaggucacguuucagugguaaauuauuauauccauucagugguacuucugaaaaauugcuuacuuuuaaauucuuccaccuacugaaguuguauguagccuuccucuaaaucccaucaguugagcacagauuuaguuucuugaaaccuuuguguucuccaagauagacuccaggccauuaucaucacacacagguggccggucaugcucuuauucaaacuaaucaaaaggaaacucucuccagguaaaaucuccuaagcuuucucuguugucaggucccagauggcuucacagcugugaugagugcuagcaccugggagaagagagguccaaauaaguucuucuuccagaugugucagcccauccccuccuaucugauagcuuuggccaucggagaucugguuucggcugaaguuggacccagguaggagacaaagaccccacaggcaagguuggauuggccucagaggugaggaggacucugaccaguggaccugcuggggggguucuugggcagucuuggauccucugucugaguccagagccuuucugcagcucaugcagcaugagcacagcuggaggaagugcucuuuuucucccugccuuucucacucccucucuccaguucuaauccugcugccuggaaugagaucaucaucccugcuagcaguagcgcuguccugggcugccuuacagagggauguuggaauuuaggcugcaguuuugggaaauggauuuuuuuuuuuuuuugagauggagucuugcuguguugcccaggcuggacuggagugcaauggugcgaucuuggcucacugcaaccucugccuccuggguucaagcgauucuccugccccagccucccaaguaacugggacugcaggcaugccccaccacgcucggcuaauuuuuguauuuuucguagagacgggguuucaccauguuggccaggcugcucuugaacuccugaccucaggugauucacccgccuuggccucccaaagugcugggauuacaggcaugagccaucaugcccggccugggaaauggaucuuuauuaauaucuuuaaguucuaaaugcccuucuagcagcuauauccacuuuccuaucuuuguaccaaaucuuccccauuuucuuuugcacguaguuccuggaaauaacaacuuugguaucauuucccucgaagagggaaguggacucuccuuccuaucugcagcagaugcaugagucuaagccuacggugagagcaaugccuccgugaaguuacauggaucuugugaagauaaaaagggauuuuguaagguuuccugauaaaagagguuugaccaggaguauagguuuuuccuggcucucauauuaccuccaccauagcuuagucccaaugugggagcaucacaggcuggacggugaagccgugaccuuuuccuggcacuguugcuguucuuuaucucuggcccugcucccaguuccuagaggcagugguguccuugacaacauuaguuacgagccucagacuucauaacugggcucaguggcacugcugguaucaugagucuuaguuucugguuaucaguuggaauaauaaaugggauuccauuggcaucugcucccagcgcacacauucaaaacaauaccagucuggaaagacaaagugcccuccucuuacgaagggcugucuuccuaauaggcagggcgggaaauaaccaaaaggaugucaucuuugcaauagacaagcaaguagauaaguaaaggaacgucguuuccaagaauacccuuacuaagguucuacuuguaagaguaugaacuauuaaugggaaaugagagaacaauagauucuaaagauacugagugauaaugauuucuuuuuauacugccuguaauaaaaugacaacaugguauaucgaacuaggugacagaauccacuuaacuggugguaaugccuuauuccuuccgugauuaaauggacaguucuugccuccugggucacaucguagggucuugugggggguuauuuauuuauuauuuuugagauggcgucuugcucuguugcccaggcuggagugcaguggcgcgaucuuggcucaccacaaccuccgccuccuggguucaagugauucuccugccucagccucccaaguagcugggacuacaggugugugccaccauuucuggcuaauuuucauauuuuuaauagagacaggguuucacuauguuggccaggcuagucuugaacuccugaccucgugauccauccaccucggccucccaaagugcucgauuacaggcaugagccaccacgccgggccguggggguuuauuaaaucggagggucuucuggcaagguaugccaccuaucccagucccuguuacugcaagaggaaaauccugggcagaggggaauuauggguauaucccaguaggcccuuuuauguauaaucucuucuaauccuuacacagacuccaugaggaugauacuuucuacauuuuaaaaauaagcaaaccaaggcuguggugaguggcuugugcaggaccacuaguuggcaaaacuggaauuaaaauucagguauuuccauugcaaauccagugcucuuugcaauauacuacagguagugagauugcagcuugacugagagcauccugauuuauuuugacagaaauguguguccugguggagguaucuuggaugacugucuuaaaccuucuaguuguaacaagcugaaguccacugggcugaaggacugugguaauuuugacauccaagguggugguagaacaauucacaaaguaauuccuugaagauacugacugccgucccaugaucuuuuucugucugguuuccugucacaucaucuuuggcgacuuuucucuccuaacacccaggguugaggguggcugcaggguuucuugugccuuucucccucccucccucccucccucuuucuuucuuuucuugccucgcucucuugcccaggcuggaaugcaguggcacaauaacagcccauugaaccucaagcuaccaggcucaagcaguccucccacuucagucuccagaguagcugggaccacagcuacucugucaccaugcccaguuaauuuuauuuauuuucugcaggagcaaggucuugcuauguuguccaggcugaucuugaacuccugggcucaagagauccucccaccucggccucccaaaguguugggauugcaggcaugagccacaacaccaaccuucaggguuucuugaccucuacucagggagccuucuccacucugucagccacccauauucacacccaugcucuggagucuagagccuagacaucgucauugucaugaacuguaccauaucugaacuuuuaaggcccuugagccccuuguccucauucauccugacucugcuaaccuuccagcucucugacggccucucucccacuauauuccaccaugucuccuccuugagcucauggcagccucccuuccggcaagccacucauuucuccugggcagucaagacccuccugacugggcuucccucccuggcccaagugugugguugguuaccucuuaccaacaccccaaagccccuugcccacuucccgcugcuauaaugucccagucccuuguuauacaauuccuuuucucuacuucuauaaguggguauuugggagauguagaaaauagugaaacuacacaguaauaaccacuacaccuuucucaauucuucgugaaaaguuggaauuaaaggaaaguugaaauagacaugugugggguuuuccagaaaaauguaacagauguacagucuucaacugcaggugugcuuucaagguuguucaacaguccucuuauuuaccuuuccaucucacucccuuuaagcuguucuaagacuuuacucuucucuuuaaguuugcuauccaaucccauccccucauuuaagcagaaggucuugucuccuguuuuauugagaauauuaaauucaucagauaugauuaugucaguuuccuguccuccacuuaaaaaguuaucuucaucugcuuuuauccuuccggacugcaacaaagguccuuccuucuguuuaaagccaaaucucuucccuuacauguccucugggacuuugccucaucauuuacaucucucucuucaaaucugcagccucccccucuagacaagcaccaguuucucuaagaucuauagcaaagcaaaaaacaaacucaaggcugggugugguggcucacgcuuguaaucccagcacuuugggaggccaaggugggaggaucaccagaggucaggaguuugagacuagccuggccaacguggugaaaccccaucucuccuaaaaacacaaaaaucagccggacaugguggugcacaccuauaaucccagcuacucaggaggcugaggcaggagaaucacuugaacgugggagguggagguugcagugagccgagauugcacuacugcacuccagccugggugacaaagugagacuccaccucaaaaaaaagccaaaacaaaaaaaaaaaacaaacucggccaggugcaguggcucacgccuguagucccagcuacuugggaggcugaggcaggagaauggugugaacccgggagguggagcuugcagugagccgagaucgcgccacugcacuccagccugggcaacagagcaagacuccgucucaacaaacaaacaaacaacucaaaaaacccuuaacuccauauucucuucuggcacgacacacuguccuucccucuguagccaggugacuucaguggcauguauacgcacuggcugcacuucuugaaacccccccaccccacaaucauuuauugcuacaacccauuggaauccagccccccacccuugccaugccguugaaacuaguaagagaggccauucgccucaauacggauaacauaugugaugcuuuuuagcccuugccuucauguucugcuguuuuucuucugcccccauugacccuccucuggcuucugugacaccacccaugcuggucaucaggccuccugguuaguccuuuucucaucuccuucccugacuccucugcccagcuccuugugugucgauguugcccaaggcucugucuuugaccuguucuuuucuucuacaugcuuuccuuggagagcucacccauucuuguaguuuaacauauuuucuguguucugcagccaggaugauaucuuaaaacuaaaucugauaaugucacuuguuggcuuaaaaugcucccauggcucugaagguccgguucuguaacagugcaccugaggcucuucaugacccgacccucuugggcaucucaugucccaccuccugccacugccucccucauugcaaucugauccuguccucaaguaaucccagacucucggugcuuccucacaugcauaugcaguguuccauggcuacgucuuugcuuuugauauuugggaaguaccugauacugguuucccuguaucuuuucuuccuguuagaauaguuccuaugcuucagcaaacgcagaggaaguuuucccucauccgggccuggacccaucccacuuugccaucagucucuuuuuuuuuuuuuuuugaaacagagucuuacucugucacccaggcuggagugcgauggugcaaucuuggcuccccgcaaccucugccacccagguucaagcgauucuccugccucagccucucagguagcugggauuacaggcauacacuaccauguccugcuaauuuuuuuuuuuuuuuuuuuuuuuuuuaguagaaacagccuuucaccauguuggucaggcuggucugguacucuugaccucaggugaaccacccacuucggccuaccgaaguacugggauuacagacaugagccaccaggcccagccagucucauucauaugucuguguggaaaagcaguucuaagcgcagccaggggcucuuggucaagcagagccuuuggcugcaggaucccugaguccauugcaucuuuccauuagacuggaucuucuuguuuuguuuuuguuuuuguuuuuguuuccuccaagccaccuuuguuucccuaucuuuuuauuaagaaaauuucaaauauuuagaaaauugaaaggaugaugcauugaacaccuauagaaccaucuacuuugucauauuaguuuuaugaguggauuuguuuuuauuuuugcuagaccauuuaaaagcaaguaaaucugugugccucucugaagaauagaggcauucucccuuauaaccacaaucccauuauuguaccuaaggcaguuaacaaauuucuauuaacauuaguagguuugggucggacacaguggcucaugccuauaaucccagcacuuugagaggcugaggcaggugaaucacuugagcccaggaguucaagaccagccagggcaacauagcgaaacccuaccucuacaaaaauaaaaaaauuagccaggcaugaugaugugcaacuguaguccuagcuacugggguuggggagcugagauggaaggaucacuugagccccaggagguggagguuggaucacaccacuguacucuagccugggcaacagagcaagaaccugucuuaaaaaaaaaauaaaaaagguuugucucuuaagguuuuauucaauuccagauucuacuauuagaacgcuuucuuaucucuccucuaaguagggagaagaaaacuaacauuuacuguauaaauguuugaagggcuuuuguguguugucuuauuuaaucuucacucauuuuacagaugaggaaacugaggcucacagagguuaaaucacuuuugcaagaucgcauucaguagugaagccauaacugcguagcacgguuccaccuccaugaggcugucuuggguucuuguuucucagguguggugagcggucucuuggaucuguguggugauccgaucuugcacuccgucacuguggcugacugcauugucacauucacuuggcggaggccaauuuccuacaggugcuuucaggaucaggucacugcgauggucucuaaacaccauucugcuuucucugcucucuugucuuuaggagccgggugugggcugagcccugccugauugaugcugccaaggaggaguacaacggggugauagaagaauuuuuggcaacaggagagaagcuuuuuggaccuuauguuuggggaaggugugguaucacauugacucuagugucuccuguuaaacugagucacuggcuuccauucuuccucuucguguggcuuuuccaccuccugccucccagagcaaaguuucccugaucccagaagugaaggagaggaggaagagaggaggguaugagccaggcuucucacuguugcugaggagagggccuaggagaugagguucuuuguguguguguguguguguguguguguguguguguguguguguuuugagauggagucucgcucugucacccaggcuggagggcaguggcgugaucucagcucacugcaaccuccaccucccagguucaagcgauucuccugccucagccuccagaguagcugggauuacagacgcccuccaccacacucagcuaauuuuuguauuuuuaguagagacaggguuucaccauguuggccaggcuggucucgaacuccugaccucaggugaucuguccaccuuggucccaaagugcugggauuacaggugugagccaccaggcccggcagagaagagguucuugagguguucaaaaugugaccugcaguugccaaguuugagauggggcagcaccgucaagguccuuuguugaccuguguuuucccauugcuggaaguuuccccacacucuguuuuuaacuuugacaucuucagacuuuaggcuccuuagauaaaaggcuccagguuggucuuuaugaccccaaguuggccuccagggaacuccaugugauggagcugauaauacauuuaucaccuccaccccugcuuggaaggagagagggaaacaaaugccuggagagugagcuccaggagagcagacaccaccucgaugagggaagucccagcaaggcaggggagccacgugggagaagcauugaggagccugggcuuuauuuuccgcacugggcccgaagucguacucugccuguuuagugacugcaucuguuagggcuuggaaauaggcuggaaagggaggcgagguagggucugcuccgggaagccagggccucuuggugaccuccccgcuucucggcagguaugacuugcucuucaugccaccguccuuuccauuuggaggaauggagaacccuugucugaccuuugucacccccugccugcuagcuggggaccgcuccuuggcagaugucaucauccaugagaucucccacaguugguuugggaaccuggucaccaacgccaacuggggugaauucuggcucaaugaagguuucaccauguacgcccagaggaggaucuccaccauccucuuugguaaagugcccaccccucuccuaaggagucugccucccauucuuaaccuguggggccagugugaucuccuuaugggguuucagaauacaagugggugugaagagacgaggcaguaguguguauccaacauuuuucuguauguaugaauugucaaaccacacaugguuugacaacugacuuuuuuuuaaaaaaacauuuccccaggucauuaguuuuuuuuuuuuuugagacagaguuuugcucuuguugcccaggcuggagugcaauggcacgaucucggcucacugcaaccuccaccucccggcuucaagcgauucuccugccucagccucccgaguagcugggauuacaggcaugcgccaccacaccuggcuaauuuuguauuuuuagaagagacgagguuucuccauguuggucaggcuggucucgaacucaugaccucaggugauccaaccuccucggccucucaaagugccaggauuacaggcgugagccaccaugcccagcccauuagauuuucuucuauagcugcauauauggauguuuuuuaauuuacugguuguuuccaauuuuccauugaaauauguugacaaauuuccuuacacauaaaugucuauucauaucagaugauuucaacaaugauaaauucuuagaaacauaauuucugggucugaacuuuuuuuuuuuuuuuuuuuuugagacagagucuuguucuguugccaggcuggagugcagcguugcaaucucggcucauugcaaccuccaccuccguaguucaagcaauucuccugccucagcucccccacaucccacucccuguagcugggauuacaggcaugcaccaccaugcccagcuaguuuuuauguuuuuaguagagacaggauuucggcauauuggccagacuggucuugaacuccuggccucaagugaccugccugucuaagccucccaaagugcugagacaacagcugugagccacugcgcccggcccugaacguuuuaaauuacauagucuuuuuaguacauauuguccauuaucuuccagaaaguuuguacaaauucuguacuuucauucagaauauauauagcaagagccuguuugugaauaucuuaaucagccauuaggaauccugcaagcaaauauuuuuaucccauuguacaguugaagaaacugaggcugagagaggcuaagccacuuacucagagucaaaacaucuaggaaagggcagagcuggcugguuccaaaacccugugccccaccccuccacuguucccucagucauuguuuuuaaugcagaaggagacuuagagauccuuaaaaauuugggguugauaauuucuuuugucugacagaaacaguuagaugaaaauaauucuaaguuuucacagaagaucaagucauugccaggcaugguggcucacgccugaggcagguggaucaccugaggucaggaguuugagaccagccugaccaaaauggugaaacccccgucucuacuaaaaauacaaaaauuagccaggcaucauggugugugccuguagucccagcuacuugguaagcugagauaggagaauugcuugaauccaggagguggaggaugcagugagccgagaucgugccacugcacuccagccugggcaacagagcgagacucugucucaaaaaaaaaaaaaaaaucaaaucauuuucuaaaaauaaggccgggggcugggcguggugguucacgcuuguaaucccagcacuuugggaggccaaggcgggcauaucaccugagaucaggaguuugagcuuggccaacgugguaaagcccccucucuacuaaaaauacaaaaauuagcugggcgugguggugcacaccuguaaucccggcuacucaggaggcugaugcagaagaaucgcuugaacccaggaggagacggagguugcagugagccaagaucacgccauugcacuccagccugggugacagagugaggcuuugucucaaaaaauaaaauaauaaaauaaaugaaauaagauaaaauaaaaauacaguacuuugauaaggaaagguaacugucagaaaggugcgauucccccaguccucacuuaggagagagaccaacagccugaguuaaccaaguccuuuguagcccacagcaacagggagcuagggacugagucaggcucucuguaacugucccuauuugcccuggguccccaggaggguaauguuauuaagcuucagguaucugucgcuguucuucuugaggccacaaggaggcagcacagugucucugucaggaaaauacacuuggauguggugacagacguuuucccgaggcuuacguuugauucugcaccaggcgcugcguacaccugcuuggaggcugcaacggggcgggcucugcugcgucagcacauggacaucacuggagaggaaaacccacucaacaagcuccgcgugaagauugaaccagguccaggaggcuccucugucugacacccacuccccucaauugagcuuggagccccaaguuaaugcgaacuucauguugaucagugcacgcuuagaauacuuuauuuggagggaggggcacuccagagcucuuuguagccaauucucuggccccugggcugacugaacccaagccauugcagccagauaggaguucuguccagucugugcgguucgugaugacuucaccauugcuuugcauuugcacaaguccauaucguuuuaccaggcucuuucgcauuccuucaugaucaucagggcagaucuguggauucuguagaauaaaagcauuagccuuauuuuacagaggaugggacugagugccagacaaguuaagugucuuguccaggucauguaccuaaucagugcaugacugcaacugagauccggguccucucuccaaauucagaucuuuuuacuuccuaacauuuuccuucauuccaugugugacuaaucugaaaccuuuuuaugcaauugaagcucauguuccuugaugccguuaaguuugcagaugaauuucuuagagacggguaauuaguuuuagccuggaacagcuguaaaaacaacacauuggcugggcauggugguucacgccuguaaucccaggucaaagcggguggaucaugaggucaagaguucgagaccagccuagccaauauggagaacccugucucuacuaaaaauacaaaaauuagcuggguguggugaugcacaccuguaaucccagcuacuggggaggcugaggcaggagaaucgcucgaccccaggaggcagagguugcagugagcugagaucgugccacugcacuccagccugggugauagagcaagacuccgucuuaaaaaaaaaaaaaaaaaaacauugaucugggaggguagguugaguauuuagguggugaccaauagggauggaaaagacacagcuuggugcucagugggaaaugcugauggaaccuacccacacaaaguguauccugggacuaaggaaauguguccgcuccucuggaaggcugguuucucugucuucauauuagauccacagugaauggcccucugagaucuuggaaguaccuugagagaggccaauaucuggagagagaucuuggccuugagauagagaucuuaagagagagagucuuggccuugagagaguccaagaucuggagagaggccaggaucuggacaccuucuuggccuugcugucccuggggaagcugaauucugaucucuuccaucgcuagucuuugacuguggagcuagagaagaacguuacgggugacaggcuacaaaagcucaaaucuugucugcuuucuccucugccaggcguugacccggacgacaccuauaaugagacccccuacgagaaagguuucugcuuuguuucauaccuggcccacuuggugggugaucaggaucaguuugacaguuuucucaagguauagucacaugaggggagaaggaagaggagcggauaaagccacugggccugaucaaggguagaggcagggggcgaaagauguaagggguuggaggaggacccaggacacagagggacaccacuccccacggggccagagagggucuaaagagcuuucccuccucacaggccuaugugcaugaauucaaauuccgaagcaucuuagccgaugacuuucuggacuucuacuuggaauauuucccugagcuuaagaaaaagagaguggauaucauuccagguaagcagaggaacuggcccacaggcuucuaaaaaauaguagagaaugagaucucauugacacucggaaagauggugguggaugggaaaacacugggucagagucagcuagguaggggcguuuugggaagcaaacccagaauccugggauuuauuccacaagaaugacuucuuuucacuccucucugccucauuuucucccagucuguuuccuuacucucuccucucaccuggacacacagucagacccuuaacuugccuggagagcugccacugcugccgcaccacugccccaagcuaaaacucacagggcaggagcggaggcagcaccccuccuacagccuucugagugaaggcaaccccaguggcccuccuuauuucuuucuuucuuuucuuuucuuuuuuuuuuuuuuugagauggaguuucgcucuuguugcccaggcuggagugcaauggcacgaucucggcucaccgcaaccuccgccugccggguucaagcgauucuccugccucagccucccgaguagcugggauuacaggcacgcgccaccacgcccggcuauuuuguauuuuuaguagagacgggguuucuccauguuggucaggcuggucucgaacuccugaccucaggugauccaccugccucggccucccaaagugcugggauuacaggcgugagccgcugugcccagccgccaguuucugccugggagguaccacuuccaaagaaaaaacgaaaaauguccugucauggaagacacaauccauuagacauacccccacuucuugcugugaccugaaccuugagucacucuauuguugguuugaugaaguccgcguccucugacaguaggauuggucaggacuuuagcagcaccuacuguucgguuggaggcuugcauuuuaaugcggggacuccggagcuaaugguaguuaauaauuccagaguacuuacuaugcaucaggcgauacgcuaagcuuuuaauguuuauuugcucauguaauccucauaaccaucacggaggcagggccuaucacccccacuuuauagauaaaacugaggugcagagaggugaaguaacaugcccguggccucccagcugguuaaugacagagcagggguaggaacccaggcagccugguccuagagccugggugcuuaaguacagugugguugugaucgguaggagaaugugcacgugaauagagcauccaccaacuuggcucugacaacacagugcuaauuuggagcgaaaagcacuuucacggucgaaacggcacagucucuagaugucguuauaacuaggacccugcuggagcgaauaguuacaugggaaaguaauguuaaaugcuggggaaagaguuugggauggagagaggagaaacuugaggucucugggaguugcuuaaaccaguugaccguaaccuggccagagaauucugauagugucuucucuccucccaaacagguuuugaguuugaucgauggcugaauacccccggcuggcccccguaccucccugaucucuccccuggggacucacucaugaagccugcugaagagcuagcccaacugugggcagccgaggagcuggacaugaaggccauugaagccguggccaucucucccuggaagaccuaccagcuggucuacuuccuggauaagauccuccagaaauccccucucccuccugguaagaaaaaauggugaaccagggcuccuugugugcacagcuuuaugucaggggcuagagggaggcucacaaaaaguagugaugcuugccccuagggaacugccacguacacuagggaggcuggcacuccacaaggaaugugccaccgggagguuauggguuaggggacugccacguacacuagggaggcuggcacuccacaaggaaugugccaucgggagguuauggguucuacuuacaagcaccucaaggacaaagucacaaagccuggcauugcucaaguccgaagcuccugcaggcgacucuuguaaggcuuuugugucuauuaagucauuuaauucccacaacuccucugggaaguaggcggugugauguuaauacccaggugacagaaugaacuugagguacaaacaguucgcacagaacccagucauccagagcucucaaccucuaaugcuuuguggcugcucagucaacauaauauucaccaagggguuaaaaaaaaguuagagccaagaugacuuuuagcagaugagugguaggagaaaaaaugggacagauauugggggaauaugucugcuuuaaucuugcucugucgaccaggcuggagugccguggugcuauuggcucacagcaaccuccaccuucugaguucaagugauucuugauucuagcaccucagccuccaaguagcugggauuacaggcgugcgccaccacacccggccaguuuuguuugguauuuuuaguagagaugggguuucgccauauuggccaggcuggucucacauuccugaccucaagugauccgcccaccucagccucccaaaauucuaguauuacaggugugacccaccgugaccagccacaaaccauuucuuucucuucuccagggaaugugaaaaaacuuggagacacauacccaaguaucucaaaugcccggaaugcagagcuccggcugcgauggggccaaaucguccuuaagaacgaccaccaggaagauuucuggaaagugaaggaguuccugcauaaccaggugggugaccccugccucgcuguucccgaaagcacacugggacccacucggccauaugugaaguaaucaugugggcagggcucaucuaggacucaucugaggcacagagggaggggcaaaugaccugaggacccuaccacucagccucuuuacuaguguggcuuugaaggcauugcccuagggacaagaggaggccugcaggcuugcagugcuuucugcaauucagcuggugagaccccagggaaaaaagcuggccagagccaacgcagaggcgggaaagagggugacagugucaugugggaaacacaagagggaaaggggccagaggcggagcaagaggaacaaaggcuuggaggauaggucccugcugcccugugacuugggcaugaucgggacagcagccagacccucugucacuaugugaaaguugcccuguuggggaaaggccccgggcucucaggaugaacugaaugucaucagauuccggagcagggaggggcuggaccggagacgaagcauugcucugcauaaagucagggcugccugccuguucggggauauucugagcccuuugauggcuuccucaaggcucuggauuuuaggaacuugugaugucgcuggcuuauauuugugugaauuugaccuguggguugaccuguggguuuuccuuugcuugacugcagcuggaccguaugcggcugugagcuuuaugugccgcagcugcugauaucugcuauucacgugguggcucaccaccuacaccuuuccagaagucuggaaucccauuguguccacccaacucauucauuuuguugacuguagacguccccauguuaguauggauugggacgcguauugagauccaucuccauggaucucuggcgcccaagaagaugccugaauuagagcacuucugaugagaagcuccucauuccagcugugaugcccacaucccuuuuagcaccuagccauggcugcuguuagacuggcacugggggcagcagggcuggacagauccaccaggcaagcuucuuaggcauguguauguguguuucuugcaggggaagcagaaguauacacuuccgcuguaccacgcaaugauggguggcagugagguggcccagacccucgccaaggagacuuuugcauccaccgccucccagcuccacagcaauguugucaacuauguccagcagaucguggcacccaagggcaguuagaggcucgugugcauggccccugccucuucaggcucuccaggcuuucagaauaauuguuuguucccaaauuccuguucccugaucaacuuccuggaguuuauauccccucaggauaaucuauucucuagcuuagguaucugugacucuugggccucugcucuggugggaacuuacuucucuauagcccacugagccccgagacagagaaccugcccacagcucuccccgcuacaggcugcaggcacugcagggcagcggguauucuccuccccaccuaagucucugggaagaaguggagaggacugaugcucuucuuuuuucucuuucuguccuuuuucuugcugauuuuaugcaaagggcuggcauucugauuguucuuuuuucagguuuaauccuuauuuuaauaaaguuuucaagcaaaaauuaaguua

SEQ ID NO: 191147 - RNA, 121146 nt, Homo sapiens
acggggcggaccucgcgcggacggacggacggagacggcgccgccacauuccuaugcccgggagcggcggcggcggcggcggcggcucccgcgggaggcggcaggcgcgcggcgcggacagcugagcuucuccuccgucggcgcccgggcggacaucgcccgggccccgaugguuugagcuugcuucucccucccucccgacccccgugguggcgaggccacgccaugugaagguuagggccgggacaucccgaggagccgcggugaaagaugggggaugcugcagaccccagggagaugagaaagacguucauuguuccagccaucaagccuuuugaccacuaugauuucuccagggccaaaaucgccugcaaucuggccuggcugguggccaaagccuuugggacagguuaguggugucacccuuucccuccccucuuccuccugaugugguccacaucucgguuuuuguucccgauucucgaaucccucccuccccgugccugucuucucguacagguuaagggagaugaugggaggcuaggaagagaaagaaaggagaaauaaggaaagcagguuuggucuucaaugaagggcacgugaauggucaggugggauuuggccagauuccuuuuauuggauggcaaaaugucccccccaucccccagugagcaauuuuauguuuuuacauagagugguuuugauuugugguauuuucuucauuguguugcguacauuucugccucagucauaauugugauuacaccaccaagaaaucugaguugguuucuuuauuauugcaagaagguggauggugcauaguacuauauugauuuugacauuuguaaugauggcugcuauucaggcuccguuggauguaagguggccugugucgagugcaguauuaauuuuuguugucauucuuuaaggcuguaucagccuucugcacgcauguuaaguucuuauuaaaucaguuauuuaaaaccagcguucaguuugcugacuguagggugcaguuuucauuucauauuaucagugaggcauauucuuuuuuccaaauguauuuuggcuucauaaauuaaaagaaacaaaaacucccuacuuugggaaguuuuuuaauagaugaguuuuucgaaggcgugugcuguugacacagaaauuguauaguacaguagcaguuaaacacucccuccauaacccagucuuugcaaaauaacaggaaaagggccucccguuaugauucuuuaguguugcuuuaggagcccauguugugaaauguuaaaaaaauuagagagcugcuuuucauuggaagaugcuucuguaauuugguaacuuuuaagaguaauuuuacaagauuucuguucccuaguuaaugaaguuuagauauaugaaauauuuguugaaaaguucccuaguacucacaaauuuccacauguuaaauauaggguuuuucagggggagggugacuaauuuccaauuuuaggacuauguaauguuuugguaaaugguuuaguucaguuuuacugcuuaaacuuacacagcugaguauuuucaggacuuacacauccuacuuaaauagcagauuaaucucaguguuuggaaaaugauuugaauuuguuuuuggggaaacuugacauugaugugauuuuauguuuauggcagccuuaauuuuacuugaauuuuuaugcuuugauauuaagcuggcaucaggaauaaauauaguaaauccuuuucaaauuauuuaaauuuuaaacaucucuuugaaauugaaugucuagcguaacucauaggaagaaacacaaaguguuacugccuuuauauaaaaacauucuggcaccacugauauaagcagugagaauaauagauguauuuugguuuuaacuuaagcagcacacugaagccgguaucuauuuggauggcaaaucaaggcuauuuaagugcuuagaaaacauggaaagagggaaauuuacauagucaccuauguggaaaaguaguauguauaaaguggaaggcaaagggaauaagagaaauauuuucuuuccaucuggaacugagaggauacuuauaggauacagauaucaaaauuuugccaugcauacacaaaagcuuccagcuagaaaauggccuacuuucuggguaugugucaggcagguucguagauucuagaccacuugaacauauugaacacaccugaagaagaaaggaaaugaagggaaucuaguaucaguggaaucugaugucugccaggcacucugcuggaugcuuugcaguaaguuguacguuagagauugauaacaagucucugauguagguaguguguuccccauuuaaaaaauaggaggaaaucagugcauagagagguuaacuuuccuacuaucacaguguuaguaaguggcagaagugaguuuugauuugaggucugacucaaaaggguaaagguauugguggagguggaacacugcuguuagauacccagcacucugaauacauuacuucauuuauuccugcagcaacccuguagauacuguucucauuuugcagauaagguaacuggcucacagauuaauuugcacaagauuaaacaucuggcaagugauguguucugcaugucugacucugaagccuuugcuuauuacucuauaccguucugcagaguaaccguuuuaucugcaggugugaaaaaugugcacauaguacauauugaagucuaauuuuuucuuuaaaaauuguacaaaucuuaauucauuuucagauagaugauauuguuggcuauuacauuugccuuggcagcaguuggaauggaugaaaagaccauauucaaaugggaugaaaaacaaguuuagaagaccuugagugacuuaguaacaauauauuaauacauuauuaagaauguuauguuuguacauuuuguuuauucuuuaucaacagucuuucaaaacaaauuuauauggagugaauagaaaaaaauuaggaauuuuuuugauguaaauauucuuuauuugcugcagauacacuuaugcaggaaagguuaauagauagcauauuucaaagguauuaccuaauuauauuuaguuguucaaaaaaucagcccagcuuucaauaugauuuacuaaaaucacuccuuuaacaaugacuuacagggucuucaggcacugauuugguguuuucuauuagaaacuuucuaacuuuugauguacugaaaaaguagucaauuuuauaaccauauguuguaaaagucauuuaaaaugauagcuagaaaugugagcauagaaugaaguaauugaacuuaaaaaaaaaacacugauguuguaauaccuagaaagcaaauauggaauauuuacuuaauuugaagucuuaggagccuugaaucauuuucuucucuuuacaguaguauuacaaaaguauuacaaauagcccaaauuuuaauaguuuauuuuguggaagaugcagauacagguuugauuaaaugaagaauacauuuuuauagaugaauuugaaacacuaaaucgauaauccaaauuccaaaggaggaaguaguucaacuaucugugccuuuucuauauuugaagagcuuaacccauuuaagcaaagauuuuacagaauuuucuuuaaauguucuguucucuuaaauccuuugggggaaaugguagaugcaaaaccucuugugacacucuuacuaaacucuugaauuuggaauucaaggcccacuuccuagugucaguuuaucacuucaaucuucucaacuauuauucuccuuuuuaucccauuuaguuuagugauauaaaauauuuccuaucauaaauauaccuuguuacauuucuuugucugucuuaacaaaucuugcugucaaaguccuguauaaggucugacucuugugcauauaugaagauaguugagagcaguggguagcauugugguuaagagagacccguagcagaggggccaguuugggacauuauugcaagagucugggcaaaagauaagguccugugucuuugacuuuguagucaacagaaaauuuaccaauaagaaaaaaaaaaaagaaguucaugaggucuugaagugguagggggcggguaugauaauaaagcugcuaauauaggcugggcaugguggcucaugccuguaaucccagcacuuugggagaccaaggcggguggaucaccugaggucagaaguucaagaccagcgugaccaacauggugaaaccccgucucuacuaaaaauagaaaaauuagcugggcaugguggcgagugccuguaaucccaacuacucaggaggcugaggcaggauaaucgcuugaacccaggaaguggagguugcagugagccgagauggugccauugcauuccagccugggcaacagagcaagacucugucucaauaaauaaauaaauaaauaaauaaauaaauaaauaaauaaagcugcuaauacuuauugagcuccuacacugugugucaagcacuuuacacauacuguaucauuuaaauccucaugacagccuuuugagguggaaagguuacuuauuccaauuuuacugaugaggaaaguguccggggacuuaggaacucuuccagaguuacccaacuaauggagcugggaucugaacccagggaauuugacuucagccuguacuuguaacuacuguucucuauggguagaagucaaaaaauggaaaggaggcaaaugauagaaaaaauguugcagagauuuaaucucuaguauuucuaaguggguacaugggaaaugguuugaaugaaaagggaauguguaagagggugaggucgccugagguuuuaagaaggaugagguuaccugagauuuugagauuuggugacugacaggcugaauugagaugccauugacagagaagaaaguauaguaacacugaagcccuggaaggagaaaauuucaaggagaauggucugauucaacagugucaaauccuauguguuuaagcuaugccuuucuuuuaagaguuuaugcuuugcuaggggagguaugauaaauguauaaccacaguagaguucagaaauaagcuaagagucauauaauuggaaauaugacauucagagggagacugguggcguuaggaugcggugggguggcaggggagaggccauuuccagccucaucaguggucugugaaggaagaccucucuaguggaggugguauuuaagcuauaggcugaauugaaaguaggcaugguagauggaggaaaugguuuguguguagacauggaguugugaaacccagguagugcuaaugaaacaacauagaccagauugaugggaugagguuuauguaaugaagcagugagagagccagcuugaaagacaaacggacagaauuaugugaagggugaggugaaggaauuugguauuuauuuaguaguuaaauuauccuaagcacauuggauuaaaaaaaaaagaaaaaauacuauuaaguauauuaaacauguaauuugugcucauuauucuuguaagcguuuuauaugcauuauuuauuuuaauucugagaaugagccuauuaaguagauauuauuuuauucuaagacucuaaaacaggguuucucaacugcagaacuauuggccagauaauucuuuguuguugggggcuguccugugcauucuaggauuuuagcggcaucuguggccucuacccaccugaugccaguaguguucccuaccacuaccccuacuccuaccccaguugugacaacccaaaauguccccagacaucuccagaugucuccuggggaacaaaaggagcccagguugagaaucacugcuauaaauauuauaagacacacuauugugaucuaaaaagguuuuuuuuuuuguauguugaaguacaaauuaauuauaagacauacugauuucacaaauauucaauuugaaaauaagaauuuaggaaauauuauaugauaguucacccuuuuuaaaauaaacaaugagacagauuuagaggaguuaacuaacuugcccuugaucauacaacuuguaagagguggaaacaaaauuagagucuaagccuuugugauacugaaauuuguaucuuaaccucugaguuacagucuuccuggauuuuuaguagagauugggguuuugccauguuggccuggcuggucucaaacuuuggggucaagugauccgccugccucggccucccaaagugcugggauuacaggcaugagccuuugugccugguugaugaugauguuaaaauagauuguugaccaugugaacuuauuuucuaauuuacguuuuauagaauuuugucucguaacagauuuugaaacagcagaaauauuuucuauuaucuacccuuuaaaaaauagaugcuagaggucuuuauuuauauagguucuugaaaauuuauugacaguuaaaaaguuuuuaaaaauagguauacagguacagauucaaaacucaaagguauaaaagaguagaucuugugagaagucuucuucccacguggacccugagcuagucaguuucuguuuuaagcgagaugaaaucaucagaagauuuguuuuuagaaaaucucuuggaauacacuuaaaaaugguuaaaauaguaaaguuuauguaauguauauuuuaccacaauuuuuaaaaagaugucuuggaaacaguagaaaaugaauuggaggagggccaagaguuaugaaggaggaaaccacagggaaguuauuauguuucaggugagagaugauggcaucuugaauguggaugguagugguggguauggaaagaaguggaugaauguaaaggauaaggcuuggugauugauuggauauguggaagaaaagaugagaucuugggaaguguuaagauugauucuauuuugugagaaagggaacaauggaagagggccaguguauguguuuaagagcggguuggggggaaagaaccauguugaguuugaggaauauaaaaugguggugugugcauuaggccuguggaaauucauguauggagcuuagaagacuucagggaugagagcuauaagugguaauuaaaauuuaaaaaguaggugacuaccagucacuagucacauuuuuuuuuuuuuuuugagacggagucuugcccugucgcccaggcuggagugcaguggcgugaucucggcucacugcaagcuccgccucccggguucucgccauucuccugccucagccucccgaguagcugggacuacaggagcccaccaccacgcccagcuaauuuuuuguauuuuuaguagagacgggguuucaccguguuagccaggauggucuugaucucccgaccucgugaucugccccccucggccucccaaaaugcugggauuacaggcgugagucaacugcgcccggccuagucacauuuuuuuuaaggucucacugucacccaggcugagugcagucaugugaucaaagcucauugcagcuucaaauuucugggcucaggugauccuccugccucagccuuuugaguagcugggacuacaugccuggcuaauuuuuuugaaaauguuuuguagagauagggucucacuguguugcccaagcuggucuugaacuccuguauucaagcacuuuuccugccucggcuucccaaaguguugggauuaccugcgugagccaccccacccagcugacugccagucacuuugagggagcguauggagaaagaaaggacccaagacaggcgagccagcaaaggagcuaggcauaggguaauuagaaagaaaaccaagggaauguggaggcucagaagacuagggaagagaacauugaggaugaaggaauaugagguguagcugagaaagauuaaucgaggacucucaaaaagauccauuagauuuagcuacaaggaaguuauugaugauuuugcugagaacauuuugaggggaauguagagacagaagcaugacuagguugaaaguaaaugggagauuguaucaauuaugccguccucacuuguaguaacaaaaaguccaccucaaauuggcuaauaguaaagaggauuuauuguuucugaaaaaguccucaagugggaugggcuuugguuuugauuugaucagggcuguagcgucauuucucugugauucuuuuagcugugcccuuguugauguguggauuucauucucaggcugucuagucucaugguagaaaauggcuguagcggccgggcgcgguggcucacgccuguaaucccagcacucugggaggccgaggcaggcggaucacgaggucaggagaucgagaccaucccgguacuaaaaauacaaaaaauuagccgggcguaguggcgggcgccuguagucccagcuacuugggaggcugaggcaggagaauggcgugaacccgggaggcggagcuugcagugagccgagauccugccacugcacuccagccugggcgacagagcgagacuccgucucaaaaaaaaaaaaaaaaaaagaaaauggcuguagcaguucuaggucucacaucuauguaccacaccauucagagcucuucucuaaucacugaaaguucuacacucuucucuugcuuuuuucuugcucuucaaacggaaggauugauuauagaaaaucucaaauauauacaauaacaauaaucuuucauguacccaucauccagccccugcugucaucaacuuauggccaaucuugauucaucucuaaacacuccccaccacugccaauuauuugaaacaaauuccaaacaucaugucaucccaucuauacguguaucaguauguauuucuguaaguccacucccuuuuuaaaauguaauuguggcacagccaucacagcacuguugucacagaauuccauaucaucaaaucaauaugaacauuucugauugucucauaaauguuuuuuauuuuuauuuuacaguuuuauuuguucuaguuaggauccaucuaaaggccauacuuuguaauucguugauaucucuuuauauuguuguguuuuuuuuucuuuuucagguauauaugaccagaagauuuuuuuucuuaauguauaggcuccuucuccaucucauuuuaaucuuccuugcaguuuauuuguuggagaaaccagaguauuuguccuauaaagucuccuacaguuuggagcuccaugauauuaacaaguuucucuuuguccucuguauucguuauaaauugauaguuagaucuagaggauugauugcauucagguuugauuuuuuuuuuuuuuugguauacuuuauacgugguguauaguucuaccacaagauacuuaauaucuaguugucucucuaucaugacuucucuauuuauuagcugaaaugcuguuuuaaaaauaaauuucccuuuauuauuugguuacccugagugcugugugggaaauuaccuugauccaaugguagccucuaagugcgugccauacaaaaacuagccuagaggucacagaacagaaagcucacagaacaacuuaaaaugcccaaauuaugugauuuguuaaaucaguuuuuagugagaagcaagaggaaagagauaggaugaguuaaaacacuuaggauaggaugcaaacagggaggaaggaccacacucccugaaugcugcaguauauacauuucauguguccugucucuacugcauuagccuucucugcugauaguguggucaccaggaccagagcugagguuugaacaaagaggcccacacagacauaggccagugccacacacuugcucuauuagacaugggacaaggaagccugccacagcuguagcuugccacaagccugaugauagccaugggcauuguguuccuugggcagaggacacaugggccagacugggcaucaucaauggguagcugaauuaaggacucaugaauaucaugcucauguguucauugacucuuguuuagugucaugcauauuuacucugucaugaauauuuaguacuuaguauauuuaguguaucaugaauauuuaauacauaggugccucauaaauauuagguaucuuguuuuuuccaucccuuucuauguuuaauauaugugugcuauuaacugcuuaccuuuauuuaacauguucuaucaauuauauguuuaacaaacuuuuaaaacuagcuccuuaucuauacuuaaaauaucuuugaacauuucaucuacauuuuacaaacuuuuucaucuuuauuuauaauagaauugaauagucucaaaaguaaaauuuuauuacauugagauacagggaaagcaggauaaaugcuauauucuuucucuuuaugggggggaaauuggaccagacugaauggaucacuggccccugagaaucugaaaggagguaaagaauagggagaacauuccagagaaugugaaaaggcuccggaguggaagagagcaugguuuccaggaacugaaugugacuggcagggauaggaucauuccauucuuguaggccagaggaaggauuuuaauccuuagagaagugggaagucauuggaaacccuuggggaugggguggugugugugacaugaccaaauuugcuuaugggaaauaagcaaauucuggcuacaguagagaaugguuuggagcggggagcagagugaaugugggaagacaaaauuuggaguaaauauaguaauuaagauaaaaagugcugguugccugaacuagggagaaccagaaccuggagucugagauugugagaagggggaagacuuuagccuggauucuguaauggauuuuauuuaugguugaaggagagggaggcauuaacgaugacuccuagguuucugacuuguucggcucgauggauugugguguacuuuauugauauaaggaacacugaaagaucaucaaguuugggagaaaagauugguuuggggcauuuugaaguuuuguagcuuuuucaacauaauuucaaauguguaagaauaguauaaagaauucccaaauacucuuuacccagauuuaccaauuauuuugucccauuuguuuuauuauucugucucauuccuucuuccuaccucccacacaaaugccuguauguguguguguguguguguguguagagagaaagagauagauagauagauacaucuuuuuuuuuuuuuugagacagaguuucgcucuuguugcccagguuggagugcaauggcgcaaucucagcucacugcaaccucugccucccggguucaagugauucuccugccucagucucgcgaguagcugggauuacaggugacugccaccacacccagcuaauuuuuuuuguauuuuugguagagaccggguuucaugauguuggucaggugauccaucugccucggccuuccaaaaugcugggauuauaggcaugagccaccgcgccugccuuuuuuuuuuuuuuuuuuugagacaggaguuuugcuuugucaccaggcuggaaugcaguggcacgaucucggcucacugcaaucuccaacucccggguucaagggauucucaugccucagccacccaaguagcugggauuacaggcacgugccaccacgcccagcuaauuuuuguauuuuuaguagagauaggguuucaccauguuggccaggcugaucuugaacuccugaccucaagugaucugccugccucagccucccgaagugcugggauuauaggcaugagccgccauacccagcaauguauauauaacgugugugugugugugcuugcauauauauaggauauaaauaaauauauauaauauuucuggaccauuugagaauauguaaagagauauuguacccuacacuccuucaguguauaucuccuauaaaaugaaggauaguuccugaacauaaucucauuuaaaaauugggaaauuuuagcugggugugguggugggcaccugugauccuggcuacuugggaggcugagacaggagaagcacuugaaucaggaggcggagguugcagugagccaugaucgcaccauugcacuccagccugggugacaagagugagacuccaucucaaaaaaaaaaaaaaaaaaaaaaaagcuacaagcuacaauaugaggcuaugguaaaggcagggaccagacuaccagauuagucaguucucucuaaaucauaacagaauauuuaacaaacccuaggagcaauggaaggucacuggugugucaaaagcuuucccuggcuaauaguaaggaugaaaagauggugagagcacagaaguguugcuggaagucacgcaagagguaugggaccuggaaugagguaauuaagauggagagacacagagguguucacagucugugugggaaucuguguuggaaauagagcuugguuauaaauuagauggagaauaggguugggcuguggguguaacaggugcaaaacugagccucaguugacucauuuggaaauagcagaguugugguuuacugacguggaagcacuggauuggggcagacuuauugugugcaacaugggccacauuaacuuggaaaugccuguaaagcauacaagggaagauaucacaaacauaaucuguggcucaaaggggaggucugggcuacaaauccaaauguauuuuuuuaauuuuaucuuucacuuuaaauuaaacauuaaugcaugaccguugggggaaaaaaagcauuaaaaaugaccauagaguucuuucucuacauguguacacauaauuauuauuuacaaaagaauuauauuauuuuuaaucugauuuuuaacauuuugagcacaguuucuucagguaaauauagauuccuucugugauauguaacuuuacugagcauauaauauugcuuaauguaucuauacuguaaauuauuaaccugguucuuauuuuaauauauauagaugguuucuaauauuuugcuacaauaagcagcacuacaauuaacacucuuauaugucuuuguguaaucacuuaguaaaauucauaauucauaagaaaaaaaauugggaaauuuaaccuugacgugauacucuuaucugauucacagcccguauucagauuugccaauuauguugauuuucauuauugcuauuuuauuucccaauucaggaucaugcuuugcauuuaguugucaugucuccuuuuuuuuuuuuugcugagauggagucucgcucugucgcccaggcuggagugcaguggcgccaucucagcucacugcaagcuccaccucccagguucacacauucuccugccucagccucccaaguagcugggacuacaggugcccgccaccacgcacggcuaauuuuuuguauuuuauaguagagacgggguuuugccguguuagccaggauggucucgaucuccugaccuugugauccacccgccucggccucucaaagugcugggauuacaggcgugagccaccgugccuggccuaguugucaugucucuuaagucuccuuuaaccuggaauaguucuucagucugccuuugucuuuaaugauauuaacacuucugaagauagagcaccagccugggugugguggcucaccccuguaaucccagcacuuuggaagauugaggugggcggaucacuugaggucaggaguuugagaccacccuggcaaacaaggugaaaacccaucucuacuaaguggugugugccuguaguuccaguuacuugguccgugcuugugguuccagcuacucgguaggccgaggcaggagaauugcuugaaccugggaggcagagguuuuagugagcugggauugugccacugcacuccagccugggcaacagaggcaaaacuccaucucaaaaaaaaaaaaaaaaaaagauagagcacccuuagcugugugcuggcuggauaucaagccccuuccuuaggcauugucuuagcucuugccaaacuuuugccugugugucugguacaagcagccaguucucugcaggagcugacugggugccuccuucuuuguguuccucuuuacucuggagugcugggcccugguuuagcagaugucccccuccacccuugguucaaaugacugggacaaugaugagauccuuacaugggugcugguauugauaggaauaccuagacaguaggaaaaaaacaaauuacacagaguccugcccucaaacaagagcugauggagacccaggaacuggagaccaucuccuaaaccccuacuacuucugcccucuggugcacccuaucuuuuggcuuucuucccucuuucguacuucccuucuucccucucuuccauucacucuucccugcuccccucuggcagacccacucuguacuccucuugcuugucacugccacuaccacgaccaccaguugucucucugucagcagaugugccguguugccucucugcacaguaccaucccugcauuccacagaagacuugggcaagggugccugagagguacccagagacaaaucacguggcagccaggcagccccagagcaaagauauucagacagaugaaagucuccuuacccccauuucuuccaagaucagaacagcuugacauacuccuucauacacagugaugccaggaaggcaggggaggcgugggaagucuuccuucccaguaccugcaaaaugucugagcauuauguugauuuuuuuccuuuauuaaaauguacuguuuaaucuuauaagaacaauaugccuguuauuuuauagaaugucucuaaauuuggauuuguuuaagguuucuuuauucaaguuugauaagguucaaguuauagaagccugguagacuacugcagaagagauguuguagucucaguaaaucauaucaggggacacauaauguuuguuccaguauaggugauguuaacuuugaucaccuggucaaagugguaucuguaguuuucuccauuauaaaauuauuuuuccacuuuaaauuaauuaguaauuuauagggagguaauucaaaauauccuguucauuaaacuguuacccaccauuuuagaauccaguaaugaucuugccugaaccgauuauugcuguugauuacuauccuuuuuuuccauuuguuuguugguauuauucuaccacaagaaagagcuccuuuuuuuuuuuuuuuuuuuuuuuuuugagacgaagucuggcucugucgcccaggcuggagugcaguggcccgaccucggcucagugcaagcucugccucccggguucaugccauucuccugccucagccuccugaguagcugggacuacaggcacccgccaccaggcccggcuaauuuuuuguauguuuaguagagacgggguuucaccguguuagucaggacggucucuaucuccugaccuugugaucugccugccucggccucccaaagugcugggauuacaggcgugagccaccgcgccuggccgaaagagcuuuuuuaauguauuauuuauuugugucaggauagacucauugaugcguguuuuauucaguggguuauaauucuuuauuauguauucugauguugguguuuucccaguuuuagccaauggcauccccuuccaucuggauccuguguucuuuugacauggcuccauuauuuguuagcauuuccuuacuuucuggcacauaccacaacaaagauguucuaagcauaucuuauacuuucccugcuccagaccuggaaacauuucuucaaggagcaguguugcuuuugguggggaagguauuagaaaccaagauacaggugcuaggcuuauugcuaacaguguuauuuagcagacagauaguaaacacacacauauauacauaguguauagcuaaaucuauuucuuuugcuauccauauaaauaaagagauauauaucugaagcaucauguauuuauaaugacacuucccauuucaaccagcaccacagaguuuauucuaguuuuuccuuuuuccauauuuguaacuccccuggucacugagaaaccuggcucccauuuugaguuagguuucuuugugacacccaagugaagagcugaguaggcugauggcuuauaaggaucuggagcucagaagaggugcuuuggccuuauaggguaaugggaggaguagaggugauaauuuaagcucaggaaugcuguaccacacuuaccauguuagguaauaauguagagggcaggagggagcuaacuuuuaauugguaccuucuuggaaggcaaggcucuauguguagguaccguacagucuugguaaauauuugagugcguacuguguuucagacgcaguuccagguacuagugacacaggacagauaaguaucuugcucuccuucagguaccuuauagugagaggagguagaaauaaaauauuaugggauaguaauaguuguuaucuagagaauuaaacuacaaugagugacuggguggucagggaaaguguguuugaggagguuacauuuaacugagaucugaauggaaagagccaaccauucauucgguuaaggggaggaacauuagaggcagaaggccucuagugcaugggccaaaaggucugaaccuggcauauucuagcaacaggaagaguuggguguuuggaacauagcggccuggggaaaguggaggaaguugaggucagaguaggaguaggcaguacauuuguggaauauggagaaacuaaaacucagagaaguuaauuacugaacucaagaucccaucaaguaaauggcugggccgggcaugguggcuggugccuguaaucccagcacuuugggaggccaaggcgggcagaucaucugaggucaggaguccaagaucagucuggccaacauagugaaaccccaucucuacgaaaaauacaaaaauuagcugggugugguggcacauaccuguagucccagcuacucggaaggcugaggcacaagaauugcccgaacccaggagguggagguugcagugagucgagaucacgucacugcacuccagccugggcgacagagugagacucuuucucaaagaaaaaaagaaaaaaaaaagaaaaaaaaguaaguggugaaauuaggacucaaccgauucuuuuaaaaucuaaagccuauacuuucucaaagcccaaauuuuuccaaauuuuggaauggaugcagguagugaauguagguaaacugaaaaccuaugugguuuugagagggauugcugucacagaaauuaaguguggcccagagaaaacuaaaguuucucaaagcguguacaaggaguaaauaaugauuacuagcacagaaucagguaguaaacuugagggggaaauuugaaaccugggaguacuuucaggaaaaggcuagugacuagaauuuuuuuuaauaacauuuuuauuuauucaucaaaucuuuccuuaccacguaccaggcgcugaguuaggcccuagagauucauaucaugguaaaugaggaagacaugauccuugcccuuuggucauauauuaggguauucauaucgguacacccuugucaacaguggguuuaaacuuuuuuuuuguuuguuugccauuuugauaacuuuaauuacugguacuaugaaguuuuaaauguuauugaucaucuuuaugucuuuugguuaauuucaaguucagauucuguggcuuacuuuuaauuggaguucuuugaaacuuagaaguucuauaauaguuauuaccuuagaaacuauuuuuuagauuuggaaaauaagguggcauuccuaugauuuagugugaugauauuucuaaaauguacuccccuccugcuuccugccccuuuauugcuuuuaauaaaucugugucacuugcuggaauguggaugcaacugguagcuaacccaguuuuauagaaaauugccuugagcaguacugucucugcucccucuaccuguaccucaagcauuucagguggauguuacuuucaaaacuuaggucuagucaggacuuauaguagcaugauuaaauuauguucugcuuaagucaugguauacaagaaaaacucaucucauauccuuugcaauucuagcagugguauuucauucagcuguucugucuguauuaauuucuuacuuuuuguguucuggagguuagggagagagugaaaccccuuaucuuugauuuugcuguuuauuuucuaauaugcuguuucaguucauuuuuuuuuaaugugguacaauuccaaacuuuaaaaaaaauaauaguuuuauaccauugguaaaaugauagacacauuugaagucuucucuuaaguauauuuagcucuugaagacuuguuuuuaaaaugaccuauuuuauauucaguaugaaguuuuacauucucuugagggcugaaaaaucuauuuuuguuguauucuugaaacagucuuugauuagcuguggauccuuucccuuuuccuugcauuggggucuuuuuaaaacuuacacuuucacaacuuagguuaguggauaugcuuuaaugaaauggaagcaaccccuggacucuugucuuccaccuuccacccuuuugaucuuggcaaaucauuauuauguuugagccuguuuagcaagaugguguagagcuauaauucugugcuuaucagcuaugugccccugggcaagauguccuuucuugaguucuuuaucuguaaaauaagguaagaggguugucagaauuaaaugacagaaugcauguuuaggacugugucugacaagauguuauaaaggucauauaugaaaauggauguaaaagcaguaaguaaaugcuagguggauauauagguaugauagauaaauuuguaauccugauaaugagcauuuacuuuucacagcuaauauuuagaugccaaauaacuuauauuagccauuuuuuacugauacaggaaauaaaaauccauuguuuauacauuugauaaguuaucuuaaaaucaaauaauuuuccuuuuacagcuguucuacuaauaguuucuguuuauuuccuacaauacuaaaguguaaaugaauaccagcacuauauucugcaauuuaaaacugaacuucaccaucacgcugaggcagcuauauuaaauuuaaagcuggcucacuacuggguagugcaucuacgaagaaaggaaaguguuuucaauuauuaaaugaggaugauauuuuuagaugucaccaaaaucccaaauugauacauccacucuugaccucuuuccagaguccuauaucuccagcugcuuauuggauauuuccacuuggauauuuuugcuauuguuucaaacucaauaugucuaaaacugaguuuuugaucuugcuuuuagaauuggugcugccucugauuuucauuuuucuauuaaugauaucacuguuucccucauaacguaggcuuauuauugauuuccaucuugacccucuuucuuugcuuuauuccuggguacuuuuuguuugucuuuagcaguuagucucuuauguccuauacuuucuguuuucacuacugccuuugaacuucauuuccuuauaucuauaugguaaucuucuaucucugauuuuuauggccaucaauauuaaauaccagauuguuccaaaacgucagucuuaaugugacacuguccuguaaaacugucagcaccuccuuguuagcuaauauacaaaguccucguguuuaaaagaugaauauuucuuucaaguccucaucacgaaccucucccauuccagcuuugccucuuacugcuuucccacaugaacucuucucuccacccagauuguucaauuuggugucucuucacaucuuuuuucccuacucuuucucuccucccucuccuuacguuuagaaaggcucuuuuuuuucugacuaaaauucugccgauuccugcuauucuauuuuuuuuuuuuuuuugagauagaguuucacucuuguugcccaagcuggagugcaauggcgcgaucucacucucugcaaccucugccuccuagguucaagcaauucuacugucucaaccucccaaguagcugggauuacaggcaccugucaccaugccuagcuaauuuuguguuuuuaguagagagggguuucaucauauuggucaggcaggucuggaacuccugaccucaggugaucugcccacuucgaccucccaaagugcugggauuacgggcgugagccaccgcgcccagcugcagauuuuucgaaguaccaguuuugguuaguauuguggcauuauugagcuuauauuaaagcugccuauucaggaaacagcuaagaucagugaugggauggcuggcuucagaaccucacuuucuagagagaaggcaggugagggacuggcuaggucucaggacagagcuaucagguucuauaauugcagcuccauguuaaccucuaacucagaagcccuaccucugggggacauaccucauccuuguccugcuucgaugagagguauagagcccagguaagaaauggagaggaggaggaagagauacaggguagaauaggcaagaaaacuuguaaaacaaugagaaguauuuuguuucucucguuuguuuugguaauuuugcugcugucaaauacaaaugccuuugcuuaaguugauuugggagcagacauugggagagugggaguggacauuggaagaguaggacuuggcauucuuaaaggguaguggcuagcaggaaagagaaacuucggaggagauuuugguuuucuucccaucucccauuucuaaacuacuacuuauguuuuagucgaacuugucaguugggugcccaggaagucuuuuucagguaggauggggaguggucagugguaauguggcaauaucagugguuuacuaguguaagggauuuuuaagaguaguucucuccuaaacaauugcuauaauucuuuuucaguagugucagcaagcuaagcaugaagggagagacggcagaggucuugaggcaaagagauagaauaaguuaggcagucucuauucugcagcucauuagcuguaaaacugggcagaugauuuuguauucucagguggcaaggacuagcagucuccugaaauaccuauugugcauuuccauguugacagcuugccugugaggagcgucauugaaauuaguuuuuaggaaucuuauaguucauucuguagauuugacuaugaaugugggaauacuuucccaagagccacuagacucagaaagcuuuucuccuugucuuguagucccuuuuuggaauauacucagaaaguaucuucuguaaaggaaauuuguaucuuugucucauuccagaguauaugucaaaguuuaaugaaucaucuuuucaguuaaaggguuauugcuauauuuuuagagggaaucuuaaauucuaugacauaaauaauaauuauuaauuaaauucuauguuucuuuuauaaaaaucuuguaagagaauuuuuuccauuaaucuuuauagaaaaugugccagaggaacuucaagaaccauuuuacacagaucaguaugaccaggaacacaucaaaccaccuguuguuaauuugcuucuaucggcugaacuauacugucgugcugggagucucauucucaagagugaugcugcaaaaccccuuuugggccaugaugcuguaauccaggcuuuagcacagaaaggucuuuaugucacugaccaggaaaaauugguaacugaacgagaucuccacaagaaacccauacagauggugagucuuuauauacccaagauuauuuuaaguuugaaguguguacuuuugagugugaaugauauacuguaaaacagagggaaauguuuugaaauuggauuguauuuuugccuagaguuuacaacucaucuuuuucuuaaccuuguuuccaaaugaaggaagauuuuaacgauuuuggaauguuuggugccaucuaauaccuuggagaaacaacuacauaauuuccaacuaccuuaauguaauuuuaauugaaaacuuuuauuuuuuccguuguagagacuggcuagaagagauggaaaaugcauccuugacuuuaucauuaggaaagaguugagauuaauaagugcugauuuauggccgggcgcgguggcucacgccuguaaucccagcacuuugggaggccgaggcgggcagaucaccugaggucaggaguucaagaccagucuuaccaacauggagaaacccugucucuacuaaaaaugcaaaauuagccgggcaugguggugcaugccuguaaucccaguuacuugggaggcugaggcaggagaaucgcuugaacccaggagguggagguugcgguaagcugagaucaugccacugcacuccagccugggcaacaagagcaaaacucugucucaaaaaaaaaaaaaaaagcucauuuauguacuugaauaacuucuugguaaauuucugcauaucagauauuuucguuuauuugauagcuuugaacucauucuuguagacaacacacacagaaggccucuaagcuggccuggggccaucaugcaggaacucucucauaggcagucucaggaaacauaaaucuaaauguuuaaguucauuguaugcugguucaguccauuguacugcuuuagcuugaguuucacaaaauguggacaucaucaaggaugguauuagaaagaaaagugguuuuuccauacucgauuaaaucaaagaguaguaguuuugcuugggaggaagguaagguguauauguagaaaaguauauuauaaaauuuaugaaguuauguaauuuaggaagaaugaacaaaaaaauuaguuuauaaaaucuauuacuaaaugaggugaugaccuguuuuguuuucugguuuuuuuccuucuuuaaaguaacucuuuuaauauuucuaaguaauggaaaauaauguauugauuaguuaauggaauuuauagauuuacaauauaguuauuaacaauaacuagaauauugauuauccaguaugagauugucaucuuucauugauggcuccaaaaucaccuuauaguuacccucugacuuuggcauaccugcuuugcauacauaucauaugugaacaguuugcccauaccagggacaagcagaaucuacuuagguccuuaucagugucucauauucaucucccccagaaucauuccccuagcuggacacuccagcuugugauuacuucugcuuccguuguuugaaggcuaaguggauaguuagaaagcacauccaugacuuugugaagcaguguuuguuuaguugcuguucuuucagauacagauauauaugucauagauaaccuacuuauccuuagagugucuauuucagauccucuaauaagaaugaaacaaauuuaacauguuuucuacauuuuuuuccaguguaguuuguaugugugaaauacuuggacaauuaauuuuaaaaugagggguuugguagacugcugauuguguuacucauguuucuuucacacuuuauugauccugcugauagcuuugaauguauuuuaauaauauuuaaggaauggaguuuaaaugacuuagaaucuuuuuuuuuuucuuaguuggagucucacucuguugcccaggcuggagugcaguggugcgaucuuggcucacagcaaccucagccuucugguuucaagcaauucuugugccucagccucccaaguagcugagauuauaggcgugcaucaccaugcccagcuaauuuuuguacuuuuaguagaggcuggguuucaccauguuggccaggcuggucuugaacucuagacuucaagugauccucccaccucagccucucaauaugcugagauuacaggugcacggcaugggcaacauagaaucuuuaucucugguucuaacuucuauuuguggauuguuagaacuugagaacuucaggcugggugugguagcucacgccuguaaucccagcacuuugggagacaaaggcuggcggaucaccugaggucaggaguuugagacuagccuggcuaacauggcgaaaccccaucucuacugaaaauacaaaaauuagccagaugugguagugcgcgccuguagucccaguuacucgggaggcugaggcaggagaaucucuugaacccaggagguggaaguugcaguuagccgagauuccgcuacugcacuccagccagacugggcgacagagugagacuuugucuuaaaaaccaaccaaccaaagaacuugagaacuucauauuugaccuacaucaucuuaacccuuugcagugucacauuuaccaaccuguguuuuaauuguuuacuuucaacuuuuaucacaauuugauuuaaaguuuuccaguugcuguggcauuuugauugaugauauuuaauguaacuauuuuccugaaaccugcgugagaaaauuucucagauuacuaguaaaaaguuguuccuuaagaaacuauguuuuuggcugggcgugguggcucgcgccuguaaucccagcacuuuaggaggccaaggaggguggaucaugaggcuaggaguuugagaccagccuagccaacauggcgaaaccccaucucuacuaaaaauacaaaaauuagccaggugugguggcaggcaccuguaacccgaggucgggaggcugaggcaggagaaucgcuugaaccugggaggcggagguugcagugagccgagauugcgccacugcacuccagcccaggugacaagagcaagacuccgucucaaaaaaaaagaaagaaacuauuuuuuuaaagaguaaaguaagaguuaauguaaauuaacaguuuuuuuuuccugcuuuuugggaaguaucaugaaaaauaguguguuuaauugcacugaauauauugccccccacuuccacuucuaaauuauuuuuaauuugggauauuuuauuucuguaugccagccuuuuggggggaaaaaaaguguggugguagcaaaaguaucauccuaauuuuucaagaaauaauguuaguacuaauucuuuuucuucaaagucucaguauaaaaauuuccugugaaauaauauauaugaagacagaaaucuuuagaagaauuuacaccagacuguuaacuuugguuucuucugugaaaugggauuaaauaggauuggagaaauaaaugguaacuuucauaucuuauuugauguauuucugcacuauuaacauuuuuauaugauuuuacuguuuuaaaauuuaaaauguagagaagaaauuuaaauucaaauagaaauuaucauuaucugaaauaacaugccuuguaugcauacuaaauauuucugauaguuaaauuguuaaagagaaauaaguauccugcauuuagccuuuaagcagacauaggaaauaagaauaaauauugaagaccucucuaaaugguuaaauuccaaauaucccguaaauggcaauucaaaccuuuaagauaucuuuucuguaguuccuuuuaguaaucaaucuuuaaaaagaaaagauguggcugggcucaguggcacauaccuguaaucccagcacuuugggaggccaaggcgggugguucaccugaggugaggaguuugagaccagccuggccaacauagugaaaccccaucucuacuaaaaauacagaaauuagcugggcgugauggcaggcaccuguaaucccagcuacaugggagguugaggcaggagaaucacuugaaaccgggagaaggagauugcagucagccaagauugcaccauugcacucuggucugggcaacagagugagauuccaucucaaaaaaaacaaaaaaacaaaaaaacucaacguaacuucucaaaacaaaaacauuucucucaaucuccaccccaaaauuaauacuacaaucugcuuaucagucaaacuugccuuagucauacuucuuuauuuauuuauuuuuucgagacugaauuuugcucuugucacccaagcuggagugcagugacacaauuucagcucauugcaaccuccaccucccaaguucaagcaauucuccugccucagccucccgaguagcuggguaaauuacaggugcgccaccaugcccagcuaauuuuuguauuuuuaguagagaugggguuucaccauguuggccaggcuggucucgagcuccugaccuugugauccacucaccucggccucccaaagugcugggauuacaggugugagccaccgcacccggccauauguuauguucuauguauccagcugaccacugacaucuccgcuugaaugauguuugaacuaaaaaucuaaugaggaagaaaacugggaaaaaaaacuagacaguaugaaauaaguguucuaacuuuaagcaauagauacugagaucuuagagguggaugugaucaucucuauuagggaggaucagggaaggcaucacaggguagaaugauaaaugggauuucaguaguugggaaaagggaugggaugagaguaguaacuggguugaaggaauuguuugacucaagauugaacugugaagguauguuaaguauuauaaauuaaaauauugacugcauggagggauaaaugucagaugaggcuaaaaaauaauuuagagcuagaucaugaagagucuguaaguuagauaaugaggaggcuguaagucugaguuaaggauuuuuaacuuucuguggguuacagaaucauggaauagauuuucauacuauauuacaaaacacuuggaagcauugcaaacugaaccgcuauacugucagcuuaguuuaaauaauuauugcagucuguuaauucucagauuuuaucuauuguuuauuuaugagacuaucaaguagcucuuuuuuuuuuuuuuuuccugagacaggaucucacucuguugcccaggcuggagugcaguggcgcaaucacaacucacuguagccucgaccugcagggcucaggugacccucccaccucagccuccuggguagcugggucugcagacgugcaccaccccaccuggcuaauauuuuuuuauuauuuuuuuuguagagacagggucucccuauguugcccaggcugaucucaaacuccugggcuaugcugggauuacaggugugagcugggauuacaccuggucuaucagguagcucuuuucauuuaguuuacugugugccaugcagugugcuuacacuuuaacacucuaucuuacguaauuuaauucuuacaacaacuccaagaggaaaggaucaucccuuuucuauugaugaagaaacugaggcuuugagaauauaaggucacagagcaaguauaguuaaguagugaaggcaggauucugaacaucucugcuuuaacuauaaauccuauauucuuuuucgguuuuuuuucuuauuuuacuucucuuuuacaugauaacaggauaaauccuauguucuuaaccacuaaauuguauuuucgucuuugccuagggaauagguagaugggaaguaguaagguggaaggaaauagaaauggugugccaccuggaacucugccuggugguuuguuugaaaucuugguaauuugccuagguuucuuuccaaaguaauuuccccucucuguuccauuuacccacucuguuccuguauuaaagguuauguuaauuccauguaccuuaggaguaauuauagcaguuaaguagaaugacugcugacaggggaugaaguagaguugugacagagucuagguggacaugaguuaauugauacaguauuuaagaauaugcaggcagggcgugguggcucacaccuguaauuccagcacuuugggaggccaaggcagguggaucaccugaggucaggaguucgagaccagccuggccaacauggugaaaccccaucucuacuaaaaauacaaaaaaaaauuagcugggcaugguggcgcacuccuguaauaucagcuacuuggcacaugccuguaauaccagcuacuugggaggcugaggugagagaaucgcuugaaccugggaggcagagguugcagugagcugagauugcgccacugcacuccagccugggcaacagagugagacuccaucucaaaaaaaaaaaaaaaagaauaugcugaauaauucucuaguuaccauuauuuuugcuggauacacaaaauguauugagaacagagaagcugaucccaggaacuuuguguugucccucuuuuuuuuuuuuuuuuuuaaacauauuggucuuauuuggcaacuaugcuuaggaauuuccauugugucaccaucuguuggaacucaaguguaauuuacuuguguagaggcuuguuaaaaaaaauccuuucccuguuuaagaacaggauuauauaaauguaguauuguaauaguaggugagaagacauuaauuucuggucacccuuguauaugaguggcuugcaaauuuauaagccaaaccugucuuugaaaaauuaauuacauucucauagauguuguugaacaggguuuucuucuucaugcacagugcuagaacucaauuuucuguuuacuacucauguaccuaauaauguuccauuauuucuagguaacaucuauaccucuguuacaaauucacaauaucuuuugauaccuuacaaccauguuuaucauguuagaguaacucuuuauuugugaucauuuauuuggagcuccaaguuuacuuucucauagaaauaacuugaugaaugguacuuacuuuacuaggugaucucacaaagacucuuuuuaauaaaacugaauugucagaccauuuauuaauuuauuuaaggagcuucugcauuguccuuuguauuuucuaccaugauuacaaagaguuucauguucuucagugucucacuuucuagcgguggcuuauagaaaacuguccaauguuuuaggaguguaaaggcaccaaacucuguacuacacuucaacugaguuuugaaggaugcggaggaauuuaccacauagagaaaugaaggcuguguuguacgguauuguauuugggaguauaaugggauguuaaaagggagugugagagcauggugacccucaggucaaaggaagcagcuuaguuguggcguuagcacuagcugccuuuugaggggugauaagaaacgagaucacagaguuagauaggguuagggcaugaaugauguuuugugcuaugccaaguguuuacguuauccuggaagugaugggaacccuaguguaggguuuuaagccagagaggguaucaucagauuuguguuucagaaagucacugugguguauuguagaagagauaccacuuaggaggcuguugaaauagcuggaggccugaacuaaggugcaggccaugaagauuuauuaguaggguugagugggagagacuuuuuuuuuguuguuguuguuuugagauggagucuugcucugucaccaggcuggagugcaguggcgcgaucucggcucacugcaaccuccaucucccagguucaagcgauucuccugccucagccucccaaguagcugggacuacaggcgugugccaccacgccuggcuaauuuuuguauuuuuaguagagacaggguuucaccauguuagccaggauggucucgaccuccugaccucgugauccacccacccuggccucucaaagugcaggggauuacaggcaugagccacugugccuggcuggagagaccucguuaagguaggauugagaugauaccuugauuuaucaagaauugggagauuaggaagagaaaccagaacagggcuggcaaaaaauauuuuaucccuuaugucaacucuaauuaauuaauuaguaguuaacuacuggaaggugggaaaaacuagcuccuugguuuucacucuguuccuuugagagccucggggucuagauguucccuuccccauccuuuguuccuccuagugcuuuugaacucuuguauuuuuuaccuaauagugguaaaugacaaaaacaaguaaaggaacagcuuuauaaguuugaagucuugagcugauauugcuaaacuuacuauuuuugaugagaaagauaaaggcuguucuguaagacucauacuaaguuucucuuuucuucuuagaaaaagaguugaaaagaguuuuucccaacacaccaagcaacggacaccagugggguguccucuaauucaguuccaacauuaucuaccuggagauaguaucagaucagugucagaucccacagguugagggcuuaguccccaagacuaccccaccaccacaccagucacaaguccaggccuccgguacuucucacugaccggcuucaaguugggguucccaugacccccucuuuggguucaguuaauuugcuggagcaacucacagaacucagggaaacucuuacuuacauuuacugguuuauuauaagggauauugcaaaggauacaaaugaagacacguuuagggcaagguaugggagaaagggugcaccacccuccaggaaccucacugugcuuagcuguccagaagcucccugaauccucuucucaguuuuuugaagcuuuauaaucuuggcaucccuuuucccaggguauagggugggacugucucauagagggucuuaagacccacagucagaaaggcaggagaagauuagauuccugccuuggggcaggugaaaggagggcaggagauucuguuuccugaggccuaacacacccaagauuauaaugaaagacuauaacaagggcuuuagaaguuaugaaccaggaacuguagauggaaagcaauauauaucauaacaccacagugaucaaguagauagaugauucuccccuaucaugucuuggaagaugugaggugugggauuaaaaaagugaguguggaaacgggauaggaccgaagguacagaauuguagggaugacaugagggaugaggaaaauugaguacacuuuacaaauauuaugaauguaauguaugauauagguggugcccuauugaugaggaaauugaucuauaacugacuccaaaaggugaguuaacuugcccaaagucaaacagguaauaaacgauaauguuaggauuuaaacuugcaucugcugauuccaaagcccaugcuuauucuguuuacaccaugaggccuucccaaaccaaaacaaaaugucccccuacuauuucuuuuuuuuuuuuuugagacggagucucugucucccaagcuggagugcaguggcgccaucuuggcucacugcaagcucugccuccuggguucaugccauucucuugccucagucuccugaauagcugggacuacaggugcccgccaccacacccagcuaauuuuuuuguauuuuuaguagagaugguguuucauuguguuagccaggauggucucagucuccugaccuugugauccacccaccucggccucccaaagugcugggauuacaggcgugagccaccgcaccuggccuacuauuucuauaguacuuaauaguuuguaaaacauguauacguuauuauuauuauuuucugauaauaaccagagaaggcaaauagggcaguuauuaccaucucuuuuuucacaaguaaggaaacuuuacggauggguuuauuuaguagauacucgguucuuaguggaaagagguguagaaagaaaaaaugcauagaucaugaucacauggcuaggcuaguuaguaacagagcagagauagaucccaaucuucuuacuucuaacccagugcuuauucuacaaaugcauccugcagccauccuuuuuccuguccuuguggauuauaccauguauugauuccggaaagacuaacagagaauaugagcauggaguaggaugucaaacacugagaggcgauagcaaagaaggggagaggggaacagggcaggaaucccaagaauaggaauagaagggagaaaaggggauuguuuugcucaccugacuaaagcauuauuuucucauauaagagauauaucuuguuuagugaccaccgacaggaagauuuagaucuacaaaaauaauuuacuuugcaaaguaauuuuuuauuuaaaaaauguuuagaauuaauuuuacauuguuuuagaaaaauagaacuugaaguaacaaguuuucaagaacacaugugaaaugaaaaauaccauauucauuauaauguuuaauauaauguugauuauauuaaaaauuaucucguucuuaaguaaaauauacauucuccuuuacugauaacauauuuuauauuuuuuauauuguaccacauaucaugccugguacauaagggcuugauaaacaaaguguuaauuucuggucauaaagagauauuuuagacaaauuggggagguggauaauuccuuauuuuuccagagaccaugucuaugccucucacuuugcuuuuggccauugcugauugaucucaggauuaagaaaucagauguaagaugggcugacuagauuguuuucuggaaaacuggaaacccaaagggagggagaaugacuguacagugauggaaggugguuggaaccacccugucuuauagaagcagugcccuagggagaaaucugugagcuccugcugcugaaauaccggugcugcucaauuuccaugcuuucugagcuuaguguuuuggcucuuccuuagauucugugaacuacuuuaguguucccucaguaaauuacagcuaauuuaacaggguuagauucuguugccugccauuaaaagaacuguagcuaaacaauaaauaaauaaaaagccacccauugaccauuuuuacucacuugaggacagauuucauuacagaaguauaguuuuagagcugaaagagauccuagcaaucaucuggucucgaguuuugaaauucucuuaacuaugacucacaguuaggaaugcauuuuacuucaagauacccaccugguuuaccuaguuacacauguauuacagaaacaaaaguacuuauccuuguaacuuuauuuuuuuaagauucuauuugaaaaaaaaauauggguugugaccaacuaaauugacuuuaugcaugacccaugaauggguuauaaacccacauuuaaaaaauacuaauguaggcugggcacagugacucacaccuauaaucccagcacuuugggaggcugagauggguggaucacuugaggccaagaguuugagaccagccuggacaacauggcgaaaccccgucuuuacuaaacauacaaaaacuagccaagugugguggcauacgccuguaaucccagcuacuugggaggcugaggcaugggaauugcuugaacccaggaggcagagguugcagugagccaaggucaugccacugcacuccagccugugcgacagagggagacuaugucucaaaaaaauaaauaaaaauaaauaaauuaauuaaaaauacaaauguaguuaaauugcuuuaucuuauagagaagagugguaaaaugacaguguuacuagaaacuaaauaccauacccauguuuuucuuuaaaaauguauuuucauuuucaaauuaccaauagcaucuauuuguuugaaaagagcuauggaaauaauuuguuguacauacucuuacuuccuugaaguuugucuaaucucuaugguauacugcugccagauuaauuuuccugaaauaucacuuugauaucuagcuuauuuccuaauucaaaacuuuuaauuauuuuauuugacuuaaaaugccauauauauuuugguuucagauguauguccuuuuaaauuugucagauuuucagagcuagcaacuguaaguaugagggaagaaguugcugcaaacuuuguccauaaauuagauaauucacuuuugaauaguggaaguuuuauauuccuuuguuuguaaucuuauguacauaagagacaauucaaaguaacaaaagcuaagauacuuaaggaguugucugauauuacagaccugccagcaauaauuuuuaugaauauagaagaugaauuaagcauauauuaaccaugacuuuucauuuuuuauuuuuauuuauuuauuuauuuauuuugagacagucucccucuguugcccaggcuggagugcaguggugugaucucggcuuacugcaaccucugccucccagguucaggugauucucuugccucacccucccaaguagcugggacuacaagugcacaccaccaugccuggcuaguuuuuuuuguauuuuuaguagagacggcguuucgccauguuagccaggcuggucucgaacuccugaccucacaugauccgccugccucagccucccaaagugcugggacuacaggugugagcuaccauguccggccucaucuuuuaaaaagauaaaaagauuucuaugcauucacugcagauuaauaaauuuaaauagaugguauauuguaaguuagcgucagugucugggaccuggccuauuguggaguaauaauguucuccuaguuuaaauaucuaaaaaacuaauaguagacacacacauauaaauaauuggaguggcuuggugcgguggcucaggccuguaaucucaguacuuugggagacugaggugggcggauugcuggagcucaggaagucaaggcuacagugagccaugauugugccacugcacuucagccugggcaacagagcaagacucugucucaaaaaauaaaauaaaauaaaauaaaauaaaauaaaauaaaauaaaauaaaauaaaauaaaauaaaauaaauuauuggagcacaagguugagauguuuuaguagguuugguauuaaaacuacauauuuuucugauuugcagaauacaguauagugcuauagaacaguggacagucauggcaguugucuguggccauccauaccccaguguguguugagcagauugaugcuccaacacugccaugauauggaaccauuuuugcaauuuguuagguuauagcagugaagcagauuguuuuuaauuaaugucagugaugugauuuaguggaauaaaauagguggucauuaaaacaaaaacuuuaguaacuguuauuuuguugcuugcuuguuuuccgguaacugcauaaaugagcuucuguaauagaaaaaaaaaaaaucuuuacaaugcucagauuccuucucagccuguacuguuccauguuugaaacaguguuagaaugagcuguguuacaaagugcacuauguuagaagcugucccaggggcccgucuuuucaggaaguucuuuugcuauacuuggaggauugugagaauacugauuauuguuuuccugaagcuaaaacuguuaguuugugguuagcaaacaaguaaacaaauauuaaaaacguaacuagagaguggugaaagcugugaagaaaguaaaagcaggauaauacaagugaucugaaggaaucauguguuauuauaguuagaguggcuaggagcagucuuauacaggagauuauauuugagcagagauuugaaagaugaggagccauuuaggcaaagaucagaggcuaucgcauugccgacagagggaauaaauacgaagacccugaguuaguauauaauucacaaaauaaauaaacuucauggcuggaugauaaagguccuacuaagaauuuccuggagggaacaucuucaggaauuugaaaguguagagucacauuuauuuaccauauaauaugugugauaggaaguacuugacucauucaauaaguacuuuuugguuacgggauguaguaaugagaagacagaccaagccccugcuuucauggagcuacuauuuuaguaguaaaguugaccaguaaacaauuagacaaauuguaacaauugcaggaaaugguaaaugcugugaaaaaaauaaauuaguaaggagcuacaaggaguggaacaggcucuuuucauaggaggcuuucagggaaggccugucaacugaguugauauuugaacugagaccuaaauaccugaaggaacuggcagaugaucuggaaaaagaacauuccaggcaaaagaaauaguaagcuuacuggcucugauguaagaggaguuugguauguuucaggaacugaaagaaggccacugauuuugguagugagcaagauugauauggagagugauaagagaucugguugagaaaaagauuguagccaaagcaagugaagcucuauaagccagauuuuauugugaaugugcaaggaugucucuggaggauuuuaaggaggacaaugaguugaucugguuuauuuuuuuuucagaaucauuaaaugccauaauaauaauuuugguaaaauagaaaagcuuccuuuuucaugaauauccgaggcuuuuuuguuguuuguuuuuugagauggagucucacucuguugcccaggcuggagugcaguggcgcaaucucagcucacugcaaccucugccuuccagguucaagcaguuuuccugccucagucucccaaguagcugggacuacaggcacacgccaccacaccuggccaauuuuuggauuuuuaguagagaugagguuucaccauguugacccaggcuggucucgaacuccugaccucaggugauccaccccccucggccucccaaagugcugggauuaugggcaugagccacugugccuggccagaauguuuguauuuuaauguaguaacauuauaguaaaacaaaauaauuugggaaaagacuugauggcaaguauauaacuuuaguaaguacagagugcuaugccaauauaaaaucacuguuucaucaaggcaaaagcuuucaaggaucuuuaaaaacaaaaaaaaaaagaaaagaaaaaucacuguuucuugcauggugaaguagggagucaacaugaguaauaaucagauaagaacuuucagaagcuucuuuuuuauaccaaaacauuuugccaaucuuauuauuuuuuuaaaaauuuguuuuugguguugaaaaugcauagcuuuagauguuguaaucauaguauuuggucagggagcuuggaaacauuuuaauuguucuuccauccagccuucagguugcuuuguggagaaauacuugagagaacuaggcacagaaaaggcaaagcaagaccaagaaaacauuuuagcauuagcucagguuagguuccaaccccugaugcagaaaucugguaggugaaacuggaccaaguaaaagggcuguuuuuguccugagccagauuggccuagaaccaaguguagucauaaauguccuuuauuuuccuacgacaaccaaacauggaacucauucuuccaaaaauagggucaauguucauccugccuguuuuagaggaagaagaacuugaggguaagagagagagagaaaccugggcaggcuugugcacaggaagggcaggaaagagaguugacuggguguguuguugggugccuguaaucccaguacuugggagacggaggcaggagaaccacuugaaccugggagguggagguugcagugagccgagauugugccacugcacuccagccugggcaacagagugagacuccgucuuaaaaaaacaaaacaaaacaacaacaacaaaaaacccagacauucaugaaaaaggaagcuuuuuauuuuaccaaaauuauuauuauggcauuuaaugcuucugaaaaaaaguaaaccauugguggaagacuugggagaagagugagagaaaaggaggaaggagagacaaugagaaaggaaggaaaagaaggagcuggaauggggaggagacaguuuccagacaggugcuugccucaaggccccuuauguggaaaaucuucaaaggagagagaaggacaaaacaccuuucucagagcuccucuuaauaccuuauuuaauaaucauaaggaagagagaaugagagaaggaugaccaaccuuucuccugagggaguagguccugggcucaucaacacugcagccauaugggaagaggcaaagaaaaggccaugacucagugcugaccuuugacuccuuugaauauacuaaccuacaaaauguggggcccagucuguguuuuggagucauuuauucucuauccuagauauagaauaaagggaugggccccuuuauuccucauggugcuuugaagagagaaauuauuuccuuccccuugagccaacuuuguaaugaaaaggauuuagacuuuuucauuuuuugucuguauaguaaaguugcuucagaaaaacacaaugagaagaagcaugguagaacaucuugugaauaaccucaaaagaaagaauauugcauguaucucuaauugccuuuuuuuccucccugauaaaugaggagagauaaaucguauugaacaaaguacuaaaaagugcucaacaacacuuuuaucucuuuaaguuugucuuuuucuaacuucuaggagucauuuuuaggaaagauggaugccuguagauuucagcuuauuuuuauauaauggagccaaagugaaauucuucaaguucuuaauaggaaaaaaagguauacuuuacaguugugccacccagccaaggcuaacauauauucucuauauaugcuauaugugcauauauucuguaauauaaucuauauuaaaaagugugauuuuggaaauaaaaaauuagccgggcaugguggcaagugccuguagucccagcuacucgggaggcugagaugagaggauggcuugugccugggagguaaaggcugcaaugagcugugauuaugccacugcacccagcccagguuacagagcgagaaccugacuccagaaaaaaacuugugaggccaggcacaguggcucacacuuauaaucccagcacuuugggaggcuaaggccagaggaucacuugagcucaggaguucgagaccagccugggcaacauagugagaacuuguuaaagugugcuuuuuacagaaucaaaaaacaauuuuauauagaaucuuuuuauacagaaucaacuccacaaagagggggccauaauugucaucguauucccagugccuagucuagagaagauguugaaucauugaauaaauaagagguauuagcgaauguuuuaauuaagaauuaaauauauuuuuuaagaaaagaaagucauucagaauuauuacuaagagagugguggagguucuuuguuuuguuccucccccuugacauuugaauagaguaagcaguaauuauugaaauacguauuuauugaguugugagaauuaaguguuuugggggaggcuccugaaugccuggaguuuauacgagaaucuaaccaagugauuagaugguuuguuuucugcuuuaucauuuuaauauaacaaguaccuuuauaauuucaaauacucauagggaaaagaguguugacuuuuuguuucaguuaaccagugaucauuugacuuuccucucuaccuuugcuuuuugugucuagcuguguuguuuaaaauuuaacaaauaauuaaucauguuuaauauauaauaccugcauuuuuaccaguuuuuuucaugaagugaagcaugauugagauauaaauacuguagaucuauuuaauaccaaugauauauuuuagaaacuaaauccggcuacaguagauuuagguuguuccucauuuuuuuucauuauauauuaauaguuggauuguauugaucuagaaaucuuuuaauuauauguuaauuuggaauuuuauuggguuggguccaagccauuuuuuuugcaagagcagauaaaauccaaagaauagcuaugaccuacggcucuuggcguggggccuggcacaagacaaugaaugaggccaaucagauucuuugccucagagaccugaacaaaucguggaaggaauuugcuuguuagcaaauugggaaauuaagcagagucaugagguagaguuagggcuggaggagcugugagaaaccauggaguuaacgcuggggagggugccuggaaaagccucauaaccauuuuucccuauuaaugaauauaggucuauaccaugauuuuugaaggcugcacaauauucugugguaugaaaaguaccacaauuuauuugccccaaucccuuguugaugaauguguaggaccuccccacaccaaaggguuuuuaaucacaacaaugacaccaucagaguucgauuuuuaaaagauagaaaagacuauguaaccuagacuaagcaaacuagguauauauuguagugacuuuuacugacauaggaaaaagaggagagaaaggaauuggagugggggaaauggccaugguagagugcagagauaauacauucaguuugggacagguuuaggaugccuucaggacacccaggaaaagauaaccagggagauaugggcuugagauagagauuugggaaucagcugagaguagugguuauugacgucauggaaauugugaugcccagggagggcauguuucgaagugaaaagagaaggucagagauagaacuguuagaagacaaauauucaacuaaugugcagaaaauacuguggaggguagucaaagguguaggauauagaauugaacaacucuggcuaacaucugaaucuucuuguucuaugaaaugccuauuuuuuuuucugauuuuuuuuccauuuugcugguugaucauguuuuuggucuuauaucucagauugggaauuuuaacaauguguuuaauaacuauagaauaucaggauauguuaagagugaucuuauagauuuuucauaauuuugaaauaaaaauggaaaauucuuuaaacuuuuuuuaaauaaugaggcagacagguucagaaauuauuuggcuauuuugacauuuuaucauuugcaauaaauacuaugcauagguaccaugugucuauaauaagccuuuucuucuuauuaauagaguuuaugccauaccauuaguuuccuugucacuaaaagaauauaagaauauuauucaagaaagccugaaaacgcaaggaaacuaguuuuuugucuuuauuuuguuaaaaagcauuauuuauugaauuguuaauguuuagaauuuagauuuaaguaaugucugugauuuauuacaaauuaguguuuuaaaggauccuuaugugacauggucuaccaaaauuacagaggucgauguuuuaugugggcaguacuugucaacucuuugaaaagcugaugcugguaagguguugucagcugauacaguuaaaaaaacuuaacagucuuuuguaacccuuuagcaguaaagauugacaauuuuauguagguaggagcauuuagugagaauuaugacacccugucauuuuugcuuaauuugggggcaaggaaauucuagcauacuuguucauauauucaaacuuauuucaaguaaguauaaguucugguacccaccagaucuacaauuccugauaguuacacuuucugugcucuggccauauguauuuguagaggcagugagguguggguuagguaauguuuggucucuuaguuccaccucuaaggcaugcuaauaugguaguugcuugccagcagcauuggucuggaaaugggugacuucuagauaccugguagguuggaggaaagguguuacuacuucuuacugugcuguuugaguaucugccauagauauuuaugugcaaaucuugugaaacccccugcuguuucucagcuguaaguugucuuuguaguuuauaaaaaccugggauggcuacuuaacgagguggauaucaugacuuuuucuuuucuguuucucacagugcuugggaagugaagccugacugagugguagagguaaauuggggaacaguuacgauuaugucaaaaccuugugugguucaguuucguuuucuucuaauaaaacuagcgccaugaggcacuuuuuuuauacacacccagcugaaagaaaugugcugacaaacuuuuuuucagggaauuuuuugaguguuaauuggagcuguuacugaugguuauuuuuauaugauaaaguguauuucagugaauuuaauguaacuuguuuuagauuuuuagauuugaagcacaguuuuuggcucaggaccaaauaugccuggaaaacuuucaaaucuggaaagcuauaaaacacaaacauacuuugaaguacggcauaugugacuguuuaaaauauacuaggaaugucuuuauugguuagcaaaugaaagaacauagcuaucauuuuuauauuguuggcauaggguagcagcaauuauguugaguggugguggacaggccugagcugccuuauauaaauuaucauaaaaauaaguuugcccaggucacuaugguuaggacauuugaaaaauacguauguucuguacuuaaaucuugauuuauugaauauaaucgucuaguggguuuuuucauaaagccuauguuguauacuguuuuuuuguuguauguuuguuuuuguuuuuuuugagacagggucucccucuguugcucagcuugaagugcaguggcaucaucucggcucacuguauccucaaccucccgggcucaggugauccuccuaccucagccucccaaguagcugggauuacagggaugcucacuauacccggcuaauuuuuuuuguauuuuuuguagagacaggguuuugccauguugcccuggcugguuucgaacucuugggcucaagcgauccuccugccucggccucccaaauuaagaggauuacagguguaaaccacugccuguaaucucaugauuacaucauguguacucuugauaguuacuguuuuuuuccugcuuacaugucuuugauggcucauuggcaacuccauuauuagugaaccaggcacaugaagaaauuuccuaauuuauuuccuuuaaguguuaauugauauaacauuuuggggggaaaacauaaaaauaaaugauuacagugaaguuugaagauuaucuucagauuuuauucauuauuguaauaaaaugauucuguaggcuaaucugauggccauacagugacuguauaaugccuuaaguaauaaaaacacuaaaaaucuuuagagcauugggaaauuuuuagagcaguuugauauacaucucauuugaugccgugugugguaagaaaugaaguauuaucccacauuuaacagaugaagaagaugaggcugagugaaguccauugauguccuaaggucagaacuuacuuuuuaaaaaaucaacuuuacuaaggcauaauuuacauaaaauguacccauuuaaaguaauuugaacaguuuugacaaagguaugcacucuuguagauaccacuacaguugagauauagaacauaauaaccccccaaaauucccuugugccuuuuugcagucagcccgcagccccaccccacuucaggcauccauuaaucucaguucugucguuguagauuaauuuuugccuguucuagaauuucauauagaugaaagcaaacugcacgaacucuuuuuuuacuagauucuuuugcucauauuuuugagauucaucuauguugcuauguguaguuuauuccuuuuuauugcugaauauuccauucugugaauaccacaauuugcuuauucauuuaccugcugauggacuuugaugcuguuuccaguuuugauguguuagaaauaacgcagcuaugauuuguauuuagacauguauuuucauuucucucuuuuuuuuuuuuuuuuuuuuuuuuuugagacagggucuuacucugucauccaggcuagaguacaguggcaguggcuugaucacgggcucaaccuccugggcucaggugauucucccaccucugccucccaaguagcgugcacuaccacacccagcuaauuuuuuguagacauaggguuucacuguguugcccagccuggucuggaacuauuggaaucaagcaauucgccugccucggccucccaaaguacuggauuacaggccugagccacugcacccgaccuuauuuucauuucucuuggugggccauauguauguuugacuauuaagcuaucaagcaauuuuccaaagugguuguacuuucuauuucaccaccagcaaugucugagcguuccaguugcuccacuucuuugccaauacuuuugguauugucagucuuaauuguagacauucuaguguaaauuagauucuccuugugguuuuauuuugcauuucccugaggacuaauagaauuuaauguuuuuuguaugcuuacuggucauucauacaucuuuuaugaaaugucuguucaaaucuuuuucucagugucuuauugggguuuuuauuuucuuauuacuguaggaguuauuuauacugaauacaaguccuuugacaaauacaugcauugcagauaguuucuccuaaucugugguucacauuuucuuuucuuuucuucuuuugagacaaggccuugcucuguuguccaggcuggagugcaguggcaugaucacggcucacugcagccucgacuuccuagccucuaucaauccucccucuucagccuccuaaguagcugggacuauaggcgauugccaccauaccuggcuaauuaaaaaaaaaauuuuuuuuuguagaaacagggccucacuguguugcccagauaguuuugaacuccugggcucaaguaguccuccugccuuggccucccaaagugccgggauuacaggaaugaccaccaugcccagccugcguuucauuuucuucguggugucuuucaaggaauuuuaaauuuugaugaagaccaguuuacaauuuuuuucuuuuuuaguuagugcuuuuauguccuaagaaaucuuuucuugccuauauuaugguuguaaagauuuuuuuccccuauguuuucuucucgaaguuuacaguuuuagcuuuuucauuuagaacuaugauucauuuuggaucaguuuuuuuguauaguguggucgagguucauuuuacccuuuuuuuuuaacaagauuaucuaguuguuccaguaguauuuauugaagacuguugucuccucauugacugacgucgacaccugugucucuuccauugauuuagaugucuguuaggcugugccacacagucuugacuaauguagcuucauaauaagucuugaaacuuguuaguguaagccauccggcuuuguuguuuuuuaucaaaauuguuuucguuauucuagguucuuugcauuuccauauaaauuuuagaaucaacuugucaauuucuauuaaaaaaaaagcuugcuaggauuuagauuggaauuguguugaaucuauagaccauuuugggaagaauuaauaguuuaacaauuugugucuuccagugaaaacaugguuucucuucucauuuaaguauucuuuaauuuauuucaguaguguuuuauaguuuuuagcauaugagauucauaugcacuuuguugaaucuuucauauuuuugauuuggaauugcauuucagauuuaauucuuaaauuauuuauugcuaauauauagaaauacaauugaauuuugaacauuuuuuuuauccugugaccuugcuauauacauuuauuccuaguauguuuuuguggauuugucagaacuuucaacguaaacaaucauguugucugugaauaaacacaguuuuacuucuuccuuuccacuauguauguggucugcuccccgcuucuuauugcacugccaaacacuaacaguuaauguugaguaaaaguggugagaccagacauuuuugucuuauuccucaucuuaucaggaaucuguugaguucccauuguuaaaugugauauuaucuguaggauuuuugaagauguucuuuuucggguuaagggagugccuuucuguuccacguuugcuaagaaauauauguauguuuauguuuuuaaaaucaugaauaacugcuguauuuuucaaaugcuuuuucugccucuauuaagauaaucauauggcuguucucauuuauccuguuaauaggugaguuacguugauuucaaauauuaaacuggucuugaauuccuggaguuaaacucaguuggucacgguaaauuaucucuuuuauauauuguuagguuuaauuuguuaauauuuucucaaggguguuuacagccauguucgugagagauauuuuucuucucauuucuuugucuuguguuagcaucaggguaauacuguuuuuauauaaugaguugcaaaguguucccuacuccacuguuuucugaaagacuucacuuaggauuucuguaauuucuuccuuaaauguggggcagaauucacuagguaugccaccggggcuugauguuuucuuuuuuuuucuuuuguuuuuuuuuuuuuugagguggagucucacucugugcccaggcuggagugcaguggccugaucuuggcucacugcaaccucugccucccagguucaagcgauucuccuaucucagccuccgaaguagcugggauuacagguguccccccaccacaccuggguaauuuuuguauuuuuaguagagacaggguuucgccauguuugccaggccggucucgaacucgugaccucaagcaguccaucugccuuggccucccaaagugcugggauuauaggcgugagccaugugccuggcugauauuuucuuuuuuuugagacagagucuugcuccguuguccaggcuggagugcaguggcgugaucuuggcucacugcaaccucugccucccagguucaagugauucuugugccucagcuucccaaguagcugagauuaaaggcaugugccacuacuccuggcuaauuuuuuguauuuuuaguagagaaggggcuucauccauguuggucaggcuggucucaaacuccugaucucaaaugauccaccugccuuggccucccaaagugcugggauuacaggcgugagccacggcacccagccaauuuugguuauuuuauaucuuuuaagacauuuguccauuucaucuaaauaugucaauuuauugucauuaaguugguuauaauacucccuuauuaucuuuuuaauaucuauagaaccuguggugauaucccuuuuuacuuuccugguguuauuaauauauauggagguuuaucaauucuguuaaucuuuucuaaaaaccagcucuuuguuucaguuuuuuaaacuaauuuuugcuuguuuucuguuucauugauuucuguucuuuauuauuucuuuucuuuuucuuauuuuggcuuuuuaaaaaaaucuagcuucuuaagauguacucuuaggucauuaauuuuaaagcuuucuucuuuucugauacaagcacuuaaagccauaaauugcuuucuuuuuuuuuuuuuucuuugagauggagucuugcucugucgcccaggcuggagugcaguggcgcaaucucagcucgcugcagccuccgccucccggguucaagcguuucuccauccucagccuccugaguagcuggaauuauaggcgcccaccaccaugcccagcuaauguuuguauuuuuaguagagacgagguuuugccauguuggccaggcuggucuggaacucgaccucaggugauccaccaaccucagccuuuuaaagugcugggauuacaggcaugagccacugcacccagccuaagcaagauuuucgauguagaugaaauagccuuccuuuagaagaggaugccauauaggacuugcauagcuagagaggagaagucagugacuggcuucagugcuucaaaggacagguugacuguuuuguuaugggcuaugugggcuaauguagcuggugacuuuagaucgaagccagugcucauuuaccauucugaaaauccuagggcacuuaagaacuaugcuaaauugacuaugccugugcucuauaaguagaaaaacaaagccuggaugacagcacaucuauuuauagcaugguuuacuggauauuuuaagcccuuauugagaccugcucagaaaaaaaaaaaaaagauuccuuucaaaauaucacugcucguugacaaugcgcguggucacccaagagcugugauggagagggacaagggcaugaauguuuucaugccugcuaacacagcuucuguucuguggcccauggaucagggaguaauauugaauuucaagucuuuuuauuuaagaaauaacauuuucuaaguauauaucugcuauagauagugauuccucuguuggaucugggcaaaguaaauuuaaaaccuucugaaaaggauuuaccaaucuagaugccauucaugauucgugggaggagaucaaaauaucaacaugaacaggaguugggaagaaguugauuuccaacuuuuagggaugacuuuaagggguucaguacuucaguggcagaaguaucugcagaugugguagaaauaggaagagaacuauaauuagaagugaagcccggagauaggacugaauugcuguaaucucauuaucaaaauugucuggaugaggaguugcuucuuacagaugagcaaagugguuucuugugauggaucuauuccugguggggaugcugugaacauuguugaaaugacaacaaacaauggauuuacaguauuauauaucaaguuaguuggugaagcagcggcagaguuugauaggacugacuccacguuugaaagaaguucuacuguggguaaaaugcuaucaaauggcaucacauauuauagagaaauuuuuggugaaagaagagccaaucagcacgcaaguuuuguugucucaagaaauugccacagccauccccuccuucagcaaucaccacucugaucgaacaacauggaaccaagacccuccaccaucaaaaauacuguguuucauugaaggcuugggugauuguuagcauuuuuuagcaauacaauauuuuuaaauuaaguuagguacauugguuuuuuagacauaaugauauugcacucaauagauuacaguauaagcauaacuuuuauaugccuggggauauuaaaaaauugugugacccgguuuauuaugcuacuugcuuuauugcaauggaauggaauggaaccugcaauauauccaaggagugccuguaguuggaaucauaaagaauguagccuuuucacauugacuuuuuauuuaauaaugugcacuuaaauuuccucccauguauuuuuauaacuugauugcucacaucuuuuuagcacugaguaauauuuuguugucugaaugugcuacaguuuuaaaaauucauauaucaacugaagaaugucuugguugcuuccaaguuuuggcaauuaugaauaaagcuuacauaaucaucuguguuuagguuuuuauguggacauaaguuuucagcuccuauagguauauaccauggagugugauugcuggaucauagaguaauaauauguuuaguuuuguaagaaaucaccaaacucucuuccaaaguggcuguaucauuuuggauucccacuagcagugaaugaaaguuccuguuguuccacaggaacuuuccaguccaguauuugguguugucaguguuguggauuuagacguucuaauagguuuuaauuugcauuucccugauaauauaugacuuagaacaucuuuucuuuuuuucuuuuuuuuuuuuuuugagacggagucucacccuguugcccagacuggaagugcaauggcacaaucucggcucauugcaaccuccgccuccuggguucaagcaauucuccugccucagcuacccaaguagcugggauuacaggugccugccaccaugccuggcugacuuuuguauuuuuuuuuuuuuuuaguagagacggaguuucacuaugcuggccaggcuggucucgaaauccugaccucgggugauccgcccaccucagccucccaaagugcuggaaauacagucaugagcuacugugcccggccagaacaucuuuucauaugcuuacuugccaucuuuauaucuucuuuggugagguguuuguuaagguuguuggccuguuuuuuaauuggguuguuuucugaguuuuaagaguuuuuuguauauuuuggauaacaguccuuuaucagagaugucuuuugcaauuguuuucucccagucuguggcuuauguuuuucauucucuugacacccuuccgcagugcaaaauuuuuuauuuuaauaaaguccagcuuaucaauuauuuuuucauggauugugcauuugguuuuguaucuaagaagucauugccaagcccaauauuaucuaguuuuucuucuguuaucuucuagaaguuuuauaguuuuguuguacauuuaggucugugauucauuuugaguuaauuuuuaugaaggcuguaaagucugucuagagucuuuuuuuuuucauguggaugucugguuguucuagcaccauuuguuaaaaagacugucuuucuccacugcauugccuuauuugcuucuuugucagagaucaguugacuuuguucgugugcucuauauucuguuccggugaucuauuuguucuuuugccaguaccacauuguguugauuacugaaucucuguagugagcuuugaagguggguagcaucaguucucuaacuuuauucuucuccuucaauauuauuugcuauucuaggucuuuugccucuccauguaaacuuuagaucaauucaucaauaucuacaaaauaacuugcuggaauuuuuacugggauugcauugaaucuguagaucaaguugggaaaaaccgguaucuugaugauacugagucuuuuuauccaugaacauggacucuccauuuauuuaguucuuugauuuuguuaaucaguuuuauagcuuuccucacauagaucuuaugcauuuuuuuagauuuauacuuaguauuuauaauuugggggugcuaaugaaaaugguauuuuguuuuuaauuucaaauaccacuuguucauuguugguauauaggaauguguuuggcuuuuguauguuaaccuuguauccugcaaccuugcuauaauauggugguaaggugugggggagaggagaagcauucuauaguccuauaauuaggucucaggcuuuuagugagccuaugccucuggacuguggacuucauaaauguuucucagguuuuuuucuccuucuuuaggugggucaggaaggcuagaggggacaggauuugaauguuucccucucccaggucaguuaggcuuugauaguaccuuaacagauuaagcucugguuuaaccuaguuucuucugagggcaggccuuguuaagaagaauggagugcucuaguauauuuagaaauucucucuccccucccacuggaaccaugggggcagcggggcuggggggaaggguuggggacaguuucugauauuuauugugagaaccuguucaagccagagccugguugagcucuugaagguaaagcucccuauaacuugaucccuuggaguuuuaacucucagacuuguuuacucugaaccugcaacaauucaucaguuacaguuuaguuuuccuucuccagcacugguucccuuggcuguuucuguuugugagucuuugcucugguaaucugugacuucccuuugccugucugucucuccauccuuugggcuggugguuugccuuguguucucaccuuucuuucagaucuaccuagaauuguugauacuucauucuguucagcuuugugcuuguuguuagaacagagugacugcuaagguuuuuacaugcagaccagaaacuaaagucuucuuucuuuuacauuuuuuuguagugcacauuugcuagugacaucuuuagaucaauaaacauugagaaaaguuaucuuuauuuuaccuccuuuuuuuuuugagacggaguuuugcucuuguugcccaggcuggagugcaauggugccaucuuggcucacuguaaccuccgccucucagguucaagugauucuccagccucagccucccaaauagcugggauuacaggcacaugccaccaugccuggcuaauuuuuguauuuuuaguagggaugggguuucaccauguuggucaggcuggucucgaaucccugaccucaggugauccaccugccucggccucccaaaguucugggauuacaggcgugagccacugcauccggccuuuaccuccauuuuuguagguuauuuuugcugaguaagaugcauucugugucuuauggcuugcauuguuucugagagaagucagauguuauucuuaucagauuuccucuguauguaauguguaauuugauuuucuucagcugcuuuuaagauuucuuucuuuuuuuuucggaauuugguuauggugugccuuaauggauuuuucuuuguauuuaccccguuggggauuuuuaaagcuacucauauccuugaguuuauaguuuucaucaaaauuggaaaaauuucagccauuauuucucugaauauuaucccccaccauguuuuuuagacuccauuuguauaacugcuugcuauugucccacacacaggucaccgaugaggcucugaggcuuuguucauuuuuuuaaggccuuuuuucuuuuuaugcuuuaguuggauagcuugaaauaucacuggaaguugagaacaggaaaaucuguuauauuuacagucuuauuccuguggucccuuucaaagauguauucuguugcaguuagcaccugugauuguuauucuuuuccuuuaagacccucuuagagauuuacuuuuugugcgagcuaguuagauauguuaaaaauuaaauaaauaguaaggccaauauggugaagcccugucuccacuaaaaauacaaaaauuagcuggaugugguggcacgcgccuguaaucucaguuacucaggaggcugaggcagaagaaucgcuugaacccaggaggcagagguugcagugagccaagaacacgccacugcacuccacccugagugacaaagcaagacccugucuccaaaaaaaaaaauacuuacccaaaauaauuuuuuuauuuaacuaugccauaugaccugaguucuucuuuuuaagaauaugaacuuuaauuuccuuagaacuuuaaacauuccuaagaaagguagguuaaauugggaaaauuaggccacccauaauaguaagauuaguacuuccauuuaauauauuugagguaauccuaaaaacauuaaugagauaguuuuguugaauguucaauguguaagucaagcugauguauuuacauuuacaaaaguguuuauauuucauaaucugaaauaauuguugucuuaaguaguuuaccggaauacuacucagcaauaaaaagaaaugaacuauugauacauauaacagcuuguaugaauaugcauagacaugcuaaguuuaaaaaagccaaucccagccgggcgcaguggcucaagccuguaaucccagcacuuugagaguuugagaucgggaguuugagaccagccuggccaacauggugaaacccugucucuacuaaaaauauaaaaauuagcugguugugguggaaggcaccuguaaucccagcuacucgggaggcugaggcaggaaaauugcuugaacccgggaggaggagguugcagugagccgagauggcaccacugcgcuccagccuggaugacaaagcaagagacuccgucucgggcaguaggggugggggagaagacaaucccaaaaaguuacauacuguauaaaucccauuuauauaaacauucuugaaaugacaaaauuauagaaauggagaacagauuagugauugccagggguuggagagaaguagaugugacugggaaagggcaacaugaaggauccuguguuguaguguuuuguggcuuaauuauauccauaucaguauccugguugugauauuguacuaugguuuugcaagguguuaccauugggggaaacugggucuaugguaaaugggauguuucuguguucuuucucacaguuguguuugaacuuacaaugagcucaaaauaaaaaguuuaauaaaaagauguaugaggaaugaauuuuuaagaugaaaagaaaaugcuaccauguggagcagaaaugguuucagugucauuucucacugguagugagaaaguauggagugaucgaguacauuaucucuguaguggacagaccccaacaaugaucagcaguuugacuuuauaacauuucuaaaacucucugagcuucaguuuuccucaucuauaguaagcaaugauaauauugucugccuuauaaauaggugugaggauuaaauacaauaguggcugugaaguaucuaauguggugcuugaccuauaguaagaaagaucaguaaacguuagcaaucaucguugguuuuuauugaccuacuucuauuucuaggguguuuuuuuaauggauauuaguauauauguuaauuuaaauaacauguauaacugaguuacuaggaaaaauguuuacuuauauaugggaaaacaaaauaguaacaacuaaaagaaauacaauuauuuuucacuuuagaucauaaaauuucuuaagaguggauuugauuuuggaaggguugcugcagagaaagcugccuuguuuggauauuacugaugguaggacaguauucugagcuuaaaacacuuguauccuguugcucugcauauuuaugguauaauuaaaguggcuuauauuugcuuugaaaacccacuugaaggcauuuuauucuuaaggcuuuuuuuuuuauuuucaucuuuuauuucuuuuuggcuuauugaucccucuucaguuucuguaacuaauuguagcaacuggacucacaaacguuguuuaauuagcacuacauuaagguuguagacuuucuuauaaccaccugaugacguguguauuaaacaaacaaacauuuugaagugcauucuuuauaagguaaggcuugggaggaaagcugcccacaauuaaccuaggaauuaaaaagguaagcagaaacaacuuauucuguggauguaguaacagcuccuuuuuacuccagauauuacccaaagcuuacuuguaaacauaguuuucugggacaagaauauugagaucuguaaauucaucuucagaccuuagcugacuuagcuaugacauauauaaugaugcauguauaagaugugcuuacugauuucuguggaaaaaauacaagcuuuguuugcuucuaaauuauauuuucuucuauucuuaauuuugccaaaaguuuaaaaacuaagauaagauaaacauuuugccauacaguugacccuugaacaacaugaguuugaacugagcagacccacuuuauacacaguuuuuucaguaaguacaauagacccugcaaaucagcggguuuggcauaaccaaauaugacauaaccaaauauuccagacucacuuucuucuuucccuaucucugaccuggaaccagcuguuuucugugaagccuuggguuuauauuaauggggaauguuauuuagaaaccaugaucuggggauagauguauuuauugcugcuguuuuaguguuacugcuaggcccuuaacucaugacaaugccaggagaaauauguaaucaugaguucuuacugauaucuccauaggauucuuccauauuugaaucuuaaaaugagcaucugccccagggccccuucccagagguacgcauucccagcacaaugcaguucuuggcuagggucaaguuguauugccuccugugccugccuuaaucuggcucugcuggcugagauccaugucuaucuggauucaccagcagcacucaccauccaugcucuaauuagagucccaucugcauuuccacauuguaguuuugugcauuuuucaguauggcaaccuccagccauguugaugagucugccugggcaguccucauugccuccugguuauaaaguugugugacuuuugagugauucauccuaacccuauucuugacauaaaccauguuauuuuuacagcaugaaaugccuuguacuauuauugucacuccauuuuauaguugagguauugaagcacagagaaguuaaggaauuugccaaagaucaccuaguuaguaaguggcagaguugggauuaaaccuagguacucugcuuaaauggucuuugcuaaccuaugcugcuagacuauaggauuuauguggggaaguauuagaagaccugaaaagagugauuauuuuaagaucuugaagaauuuuaauauuauuuaaauaauccuggacuuguuggguaggcccugggaagucacugaaggcuuuugacuguagagugaugugauuggcaauguccuguagaaagguuaaucacuuguagcugugagggacugugaaagcaagauuccugauaguaugcuguucuugggcuucucucuagagaucuaaugagucagccucuaagguuugaugccagggaauuuaugaucuuuuugaugaucauccauauuuggaacgacugcucuaaacuguuuccuuuguuuacuauauugguuugacuacuaguaugccauuccuguauguguccauccaguacagccacauuuaaaugcccuuaauuugccauuugaagcuacauauaguccagaugaagucgaugagucugcucaggagacauaucuuucaucugucugggccuugcguuucaauagauauuugagcuauacucuuucuuauauauauuaaguuugcaauaaagcuuaauaucagcuuguuuuaacauuaucuuggaaacacuucuucauuggguagugugauuauuaccaaauguaagugacaagauguaaaccagauacucaucuacuuguauauaaacagaugaaagagaacucucaacuacuuccuugucucuaauauuugcuuccuaaaaauuugggcagaauuaaauagcaguuaaaucaguaucauugugcugauagucgcaugcuagucaucauacuuuuuugacuugcucugccuacuucauugacauaucuaaccagggagguccaaauaaaauaaaaauagcaguuuugugcgaucaguuguuuaagcauaugucauauuguuaagauuuugaaacucuucagagagguauuuugaaucucaugaaagucaccccucuugccagggcugccacaugcauaguuccaccuggguauagcagaguagcaguggcaccuuugguccugacuauguuuaauacagauuggguauaacagcaguacgucuggaacaacaaugccauaauccucuuguagguuacuacuuaacuauuugcuguucaauaguuaaacaaaauuuuuuguguuaaaaaaaaucaauugaccauagacauaugggcuuauuuauggacucuguuccauugaucucuguuuuuauaccaguaccguauuguguugauuauuguugcuuuguagaaaguuuuaaaaucaggaaguauaaguccuccuacuuuguucccuuucacgauugcuuuggcuguggugagucccuugagcuuuaauaugaauuuuaggaucaguuugucaguuucuauaaagaagcuaccugggauucugauagagaucacauuacuuuguauaccaauuuaggaaaguauugccauccuaggaguauguagucuuccauccaucaauaugggaugucuuucuguuuaucuuuaauuucuuucaacaauguuuuguaguuuucagagcauaaguuuuuuuuugucuuuuuuuuuuuuuauacuuuaaguuuuaggguacaugugcacauugugaagguuaguuacauauguauacaugugccaugcuggugcacugcacccacuaacucaucaucuagcauuagguauaucucccaaugcuaucccuccccucuccccccaccccacaacaguccccagagugugauauuccccuuccuguguccaugugaucucauuguucaauucccaccuaugagugagaauaugcgguguuugguuuuuuguucuugugauaguuuacugagaaugaugauuuccaauuucuuccaugucccuacaaaggacaugaacucaucauuuuuauggcugcauaguauuccauggcguguaugugccacauuuucuuaauccagucuaucauuguuggacauuuggguugguuccaagucuuugcuauugugaauaaugccgcaauaaacauacgugugcaugugucuuuauagcagaaugauuuauaguccuuuggguauauacccaguaaugggauggcugggucaaaugguauuuccaguucuagaucccugaggaaucgccacacugacuuccacaaugguugaacuaguuuacagucccaccaacaguguaaaaguguuccuauuucuccacauccucuccagcaccuguuauuuccugacuuuuuaaugauugccauucuaacuggugugagaugguaucucauugugguuuugauuugcauuucucugauggccagcgauggugagcauuuuuucauguguuuuuuggcugcauaaaugucuucuuuugagaagugucuguucauguccuucgcccacuuuuugaugggguuguuuguuuuuuucuuguaaauuuguuugaguucauuguagauucuggauauuagcccuuugucagaugaguagguugugaaaauuuucucccauuuuguagguugccuguucacucugaugguaguuucuuuugcugugcagaagcucuuuaguuuaauuagaucccauuugucaauuuuggcuuuuguugccauugcuuuugguguuuuagacaugaaguccuugcccaugccuauguccugaaugguaaugccuagguuuucuucuaggguuuuuaugguuuuaggucuaacguuuaagucuuuaauccaucuugaauugauuuuuguauaagguguaaggaagggauccaguuucagcuuucuacauauggcuagccaguuuucccagcaccauuuauuaaauagggaauccuuuccccauugcauguuuuugucagguuugucaaagaucagauaguuguagguaugcggcguuauuucugagggcucuguccuguuccauugaucuauaucucuguuuugguaccaguaccaugcuguuuugguuacuguagccuuguaguauaguuugaagucagguagugugaugccuccagcuuuguucuuuuggcuuaggauugacuuggcaaugcgggcucuuuuuugguuccauaugaacuuuaguuuuuuccaauucugugaagaaagucauugguagcuugauggggauggcauugaaucuauaaauuaccuugggcaguauggccauuuucacgauauugauucuucccacccaugagcauggaauguucuuccauuuguuuguauccucuuuuauuuccuugagcagugguuuguaguucuccuugaagagguccuucacaucccuuguaaguuggauuccuagguauuuuauucucuuugaagcaauugugaaugggaguucacucaugauuuggcucucuguuugucuguugcugguguauaagaaugcuugugauuuuuguacauugauuuuguauccugagacuuugcugaaguugcuuaucagcuuaaggagauuuugggcugagacgaugggguuuucuagauauacaaucaugucgucugcaaacagggacaauuugacuuccucuuuuccuaauugaauaccuuuuauuuccuucuccugccuaauugcccuggccagaacuuccaacacuauguugaauaggaguggugagagagggcaucccugucuugugccaguuuucaaagggaaugcuuccaguuuuugcccauucaguaugauauuggcuguggguuugucauagauagcucuuauuauuuugagauacaucccaucaauaccuaauuuauugagaguuuuuagcaugaagcguuguugaauuuugucaaaggccuuuucugcaucuauugagauaaucaugugguuuuugucuuuggcucuguuuauaugcuggauuacauuuauugauuugcguauauugaaccagccuugcaucccagggaugaagcugacuugaucgugguggauaagcuuuuugauguggugcuggauucaguuugccaguguuuuauugaggguuuucacauugauguucaucagggauauuggccugaaauuuucuuuuuuuguugugucuuugccagauuuugguaucaggaugaugcuggccucauaaaaagaguuauggagaagucccucuuuuucuguuguuuggaauaauuucagaaggaaugguaccagcuccucuuuguaccccugguagaauuuggcugugaauccgucuaguccugggguuuuuuuuuugguugguagacuuuuaauuacugccucaauuucagaacuuguuauuggucuguucagggauucgacuucuuccugguuuagucuugggagggaguauguguccaggaauuuauccauuucuucuagauuuucuaguuuauucgcauagagguguuuauaguauucucugauggcaguuuguauuucugugguaucaguggugauauccucuuuaucauuuuuuauuguaucuauuugauucuucucucuuuccuucuuuauuagucuggcuagcagucuaucuauuuuguuaaucuuuucagaaaaccagcuccuggauucauugauuuuuuugaaggcuuuuucaugucucuuucuccuucaguucugcucugaucguaguuauuucuugucuucugcuaaguuuugaauuuguuuguucuugcuucucuaguucuuuuaaaugugauguuagggugucgauuuuggaucuuuccugcuuucucuuguggguauuuagcacuauaaauuucacucuaaacacugcuuuagcuguguuccagagauucuaguacaugugucuuuguucucauugguuucaaagaacuuauuucugccuuaauuuuguuauuuacccaguagucauucaggagcagguuguucaguuuccauguaguuuagcgguuuugagugaguuucuuaaccuugaguccuaauuugauugcacuguggucugagagacuguuuguuaugauuuccauucuuuugcauuugcugaggaguguuuuacuuccaauuauguaaucaauuuuagaauaagugcaaugugguucugagaagaauguguauucuguugauuugggauggcgaauucuguagaugucuauuaggucugcuugguccagagcugaguucaaguccugaauauccuuguugauuuucuaucucguugaucuaauagugacagugggguguucaagucucccacuauuauugugugggagucuaagucucuuuguaggccucuaagaacuugcuuuaugaaucugggugcuccuguauugggugcauauauauuuaggauaguuaguucuucuuguugcauugaucccuuuaccauuauggaaugcccuucuuugucuuuuuuuaucuuuguugguuugacaucuguuuuaucagagacuaggauugcaacccuugcuuuuuuuuugcuuuccauuugcuugguaaaucuuccuccaucccuuuauuuuuagccuaugugugucuuugcacaugugaugggucuucugaauagagcacaccagugggucuugacucuauccaauuugucaaucuuugucuuuuaacuggggcauuuagcccauuuacauuuaagguuaauauuguuaugugugaauuuuauccugucauuaugaugcuagcugguuauuuugccuguuaguugaugcaguuucuucauagugucgauggucuuuacaauuugguauguuuuugcaguggcugguacugguuuuuccuauccacauuuagugcuuccuucaggagcucuuguaaggcaggccugguggugacaaaaaucucucaguauuugguugucuguaaaggauuuuauuucuccuucgcuuaugaagcuuaguuugacuggauaugaaauucugggaugaaaauucuuuucuuuaagaagguugaggccugacgcaguggcucacaccuguaauugcagcacuuugggaggccaagacgggcggaucacagggucgagagauugagaccauccuggccaacauugugaaaccccuucucuacuaaaaauacaaaaauuagcugggcaugguggugugugccuauagucccagcuacuugggaggcugaggcaggagaaucucuugaacccaggagguggagguugcggugagcugagaucgcgccacugcacuccagccuggagacagagcaagacuccaucucaaagaaaaaaaaaaaaauagaauguugaauauuggcccccacucucuucuggcuuguaggguuuccacguagagauccgcuguuaaucugaugggcuucccuuuguggguaaccugaccuuuugggugaaucugaugauuaugugucuugggguugcacuucucgaggaguaucuuugugguggucucuguauuucgugaauuugaauauuggccugucuuccuagguuaggaaguucuccuggaaaauauccugaagaguguuuuccaacuugguuccauucuccccaucacuuucagguguaccgaucaaacguagguuuggucuuuucacauagucccauauuucuuggaggcuuuguuuguuccuuuucguuguuuuuucucuaaucuugccuucaugcuuuauuuuauuaaguugauuuucaaucucugauauccuuucuaaauuaucugaagguuauuaaagcuuacaccaucuaaauuauauuuagaugaguuaccuauaagcuaaaagcuagagucagauggcaguaucuaagaugaacucuuaaguguaggugguauccuuguuuucuuuuucauaaucucuuuaacucgucuuaguaccuuauuuauuuauuuguucugggaaccacauuugagcuuugagaggcaggaggacagugcuugauguguuggcagcuaguaaccccuaguuuaacugaguugaggacaguaguaauacuaugguggcaauagcaagauuuuuaucucugcagccuuauaguacaacugucuugguuuaaaacuggauuuuauuuuaacuaaauucuguuuuaaaccaagauaguucuauauaagaaugucuuuggauuggaagccuugguuuuaguuuauucuugaauugucaauaucagaaguuuagaaauaguaauucaauggcaaaguauuauuacauaauaacaaaagauuuauugugaaauacuggggccaacauggaggaauggcaaguauacgagcuuugaccauagacagaccaggauuuugaauccuaguucuaacucuuacuaacucugugaccaaauguagauacucauccugagauuuccucauugauaaaaugacauaucaucucagcggaguugcaagugguguuuuacuuuuaucuccauguaaauuaaagauaaaugaaacuuaugaaaaaguguuuauauagauaaaugauauguaaaauauuuucuaaguuggaauaacuuugaaaaacuauagaguuuaauaugaauaugcaguauguaccauuuuagcagaauaacuaguaccucauguuugugauugauuaaaguauuuauuuccucuuaaauaccugugggcguacuugggcauaguaggcagucuagccacuuuauuaguccaaaaacuaaguucauuuuaggauuuuuuuuuaaguucuaugucuaaaucugauacaagaauaguaaaagccaugcaguaguagaucuuuuaucuuaauuuaugaggcuaaaaauuucuuauaacacugaaacccuuuccuuucuuuaauagguuuaaccuucauuucuaauacauaaauguaauuuauuuuugcuuagacuccacugguuggagaugauaaaaauauaacccuuguaacacagauauagaaccuaaugguggccuuuggaugauacuucagcucucacccaguaaagucccugggauuccacauuccccaaauccuuuucuuuucauugaaaugccaaguagcccuccugcuuuuucuuccauaaccagccuuccugcugcugcucuuagaugucaugcuaugcucugccaccuggugguugcaauguacacugcuguuucuguugcugccgcaguugccuccuacaaggugcagagguugggauuuaagucugcaggugugauguucaguguugugggcucuggaggcagauuucuaaguuugaaucccuacaucacugccuccuugcuguguaaccuuggacagguuauacaguuuucuuaucuguaaaauagguagaguaauagugcuuacccucacaggguuguuucauuaaauuaauacaaaugcugagaacauuacauacugaaaacaguacaugacagaaaacaguaaaaugccaaaaacaguaugugacacuuaacaguguuaguuauuguuauuauucugaucugaaugcuuuagguaagcaauuaaacguguauauuuuauuuggagcuaucauagcuccaaacugauugauuuuagccuugaguuuauuuuuuaauguugaucuuuucuaaauccauuguguauauacuuucuguuauacauaauuuuuaauuaucacuaucauauuguaaaguuaagaaguaaaaaaaaaaaaucacacuaaaauguaagaguucuuaaagugagugaauaucauauggaaauaaccacagcacaguaguggaauuuuuagaaauuuguuuuuuaauuugggaaguuaaucagugaaaugagcuuuguucugaaaauguaucccaauuuucgaaguaaacuauagauuuuauuuguguuuuuacauacuauaacaagguaauuucuaaguuuuacuuuuauucauucauuuucccuuucuguugugugugcgugugugucugugguauucaaacauuauuaugguaugauguucuguuuuucuuuuuuuuuuucuuugagacagagucuugcucuguugcccaggcuggagugcaguggugcgaccucggcucacugcaaccuccaccucccggguucaugccauucuccugccucagccuccugaguagcugagacuacagguguccgccaccacgccuggcuaauuuuuuguauuuuuaguagagacaggguuucaccguguuagccaggauggucucgaucuccugaccuugugaucugcccaccucggccucccaaagugcugggauuacaagcgugagccaccgcgccuggccagauguucuguuuuucuuguuucuugucuguuuccuuccuuuuucauauuuuuauguauauauauaaaacaguauuauagugugguauucuguuuuuuccacucaauuuuauauuguacacauuucccuuauuuuuaaauaguuuaauauaucauaaauuacucauuuugguuggauauuguuuucuuucuguuguauaauauuauaaugguuauuuuuuauuuauacagcguuuuuauccucucucauguguuuauagaacaaacugccaagaggagucuuaagaguacaugaaugauuuuguggcucuugaaauauuuucccacauuuuaauccaaaaaugccaugcuuuuuaaugcuguuaaacaggaauuuacuuucacccauaaaacauugucuaggaacaaaagugaaaaagacaggaucccugcucuccagggauggaguauaacggagaggauacauacagaugaaugacuaagagaaaggcugcaauauucugagugugaaggaagaacugggauaguuggacaguagcaguguggaaaauacuucuuagaggagauugaauaugaaaaugcgguuuuaauuugaaauaauuauugauccuacuuuuucuuucuugcauauuauguuugucauuucugaaacauauuuuuuugcuuugcaacaaaaugacuuaacuccugccaacugcaugauaugguagaaagagcacacagguuuggacaaauugcauaauugucuaaacuucaguuucugcacauauaaaacauaaaugauacuuccuuuagagacuuuugaggauuauagaaaguguuuuuuaucuauugucuccaggcuuauuucaaaaaauauuugaaaugaaagaguuaauauacuaauaaaguauuuagcacaguauauggcacauaaguuagacuuaguaaguaggagccacuguugguuuuaugauugccaguguuaagcauucugcuucuuacaaagcgucagcuuuccuauaaauacugcucaguuuucuagaagcuggaacugccaccuccuaaacgaucagaauucacuuccucaaccuccagaguaacccagcucuugagucuuuauaguaaccaaaaggcuagcuucuuucuuuccuuuccuuucuuuagccccugcuaguugccagauaccacguuagauguagggaauaggaagauaacugagauaauauccuacaacugucuaucuagagaaauagagucauaugcaggugacugugcacaugucagagaaaucagugguucucaacccuggcugcucauuagcaucaccuggggaagcuguuuaaaaauaccagugcugaugccguacuuuagauaauuuagaaauuaaugcaaacagaaacaauauucuguaggaaccuguacucauugauagguugagugagucauuuugauuggaaagagaacuggaaaaaucuucacaaucagaguaacauucaaaccaacgacaaaacuuagucuguauuguuaggaggacaacaagccagggcacaaaagcuugaaaacugguagcagauuggagaaggaaaugguagauucuaaggcuagacuaacaaagcagcuaauaagaaagaaagaaagaaacuuuaccucuuuuaaggaguuuagacuucguuauguagaaaaugagguagacuuuaugagagaaugauaugaugcaaucuccgauuuggaaaaaacagccgcuaguuuauaacauugucaaaaguaaauuccagauggaauuaaaguuauggaaaaaauagagaauaauauuucuauauuuugggguuggagaagaccuuuauaaacauguuaucaacuccaaagccauaaaggaaaacacugagauuaacagauuuuaccaaguaaauauuuaaaacucugcaacaaaagguacccuaaaguugaaagucuggagaaaaacuaggggaaaguauuugcuaccucaaugacagaagguuaaaaaguacuuaauauauaaugagcucuuacaaaucaguuaagaauaggcaaaagauuugagcagguagcuuuccaaagaagaaaugcaaaugguugcuaaagcacauaaaaggaugcucaucuucagugauaaucaggauuguaaagucaaacaagaguggggucuucuaaacuuucauguugauacagauuuuuaaaagugaauaauaucuaauguugucaaaaauguggagaaacaggcaggcugauaacguuggugggagauaaguugguguaaccuuucuagagaguagauuaaugguuaucuaucaaaacuuaaauugugguugcccuuggacccaguggccacaacuaagaauuaucccuggagaaauacaauguuguaacauuguugguaaugccaagcaguguaaauguguacauauuucauaggcauuaaacuuuuuuguaggaauauauaccagacugaagaaacugguggagggaggggcacuucauauacuacuguaauguuuuuuuuagaacuuccauauaauuguguguguguguguguguguguaucuaucuaucuaucuaucuaucuaucuaucuaucuaucuaucuaucuaugccaaaucuaucuaucugugccaaaggcuagaaguccuguucuggaugaauuagaugaggaagaaguuggaggcaggaaaaccaguuaaagaauuuuuuaccuuguucaagugugagaaauguuugggucugaauuggaacugugacaaucagaaugaggaagagggaagauuugaaagauagagaaucuauaaacuuguacuaugugggugagaagaaugaggaaagacugucaaagaugguucugaagucgguaaguuauauugcugaguaaaugaccaugacauuauaaaaaauaggaaaaacaagaaaagaagcaucuuuggaguagaagauaaugaguaucuuaaauauagauccucaauaaguauuugaacaauaaauuaguuugggucaguuagcucaucuuuagcauguacaauuuaugcuuucuuauuaaggcuggucuucuguaguuauucugcugcuuguuaggagaugucauuaacauuucaaaauauguaaaaagcaauuucuaaauauaauuuuuaaacuauuuguucuuguuuuauauuuucagagugcacauuuggccaugaucgauacccucaugauggcuuauacuguagaaauggucaguauagaaaaaguaauugcgugugcucagcaguauucagcuuuuuuucaagccacagaucugcccuaugauauugaggacgcugucauguacuggauaaauaagguaggauuauacucacuugaguaaaucgcaucucauagccagaaaacgugaaauucuaaauuauacauugccacuucauuacucuuuuuguuucaaaucaaagugcaaacuuaaguuguaaaauacacuuaaauuuuuuaguaaaaaagcuuaaaaugaugaaaauaguuuucuguauacuuagcaauauuuaugauuacucuuuuuuuuuuuuuuuuuuugagaaguagucucgcucugucacccaggcuggagugaaguggcaugaucucggcucacugcaaccuccgcccuucagguucuagcaauucucaugccucggccucccaaguagcugggauuacaggcguuugccaccacacccggcuaauuuuuguguuuuuaguggagacgaguuuucgccauguuggccaggcuggucuggaacuccuggccucacggugaucuacccaccuuggccucccaaagugcugcaauuacaggcgugagccaccacgccuggccaauauuuauaauuacucuuaaugauuaaucugguucauaccagauuaugaaaaaauucagaacacuccuaauagugaacuauacacaguggguguucaguaaauauuuuuugaauucauuucaagaaugaaauaauuuucuuacauuuccaguuaggggauucuuagguuugcuugaccaaguugcacaagauccuauugauuguggauuccucuucuuggaaauuuuuauggagcugugauuugugcuuugaagaugcuuaauuugucagcuuaucacucccuuugccaauuugaguaguuaauuugucuugauccacuuucauuuacaacugccagccaaaagaaaauuaaaccuuaucugaagacaagcacuaaacggauuuaaaagaaguuauaucuccagguauccuuucuugaaagcuggcaugaagcucguaauaaaaagcuaaauguaaaaaacacuauuacagcuaucuucauuauccauaauaucaguaucauuguagaaggacugcuuaauacuuugccucuggaguuccuuuauuucuucaucuuuaguaaucuuucccugacuccuccucagcuguagaaaaucacaguuacauucuagaccuauucaucuugagaaacuaugcaaccuucacaucccauuacagacuucccauucuugaacaguuucuccuaucuuccuaacccacuugcuuuaaauaauaauuuuuaaaauguugaaccucauuaugacuuauaaacuauugagccuauuaauuucucacaaucuuauuggacuucauauuuguccaucuugaacuuagauuuuuauaaguacucucaguucuuaugucuccccuucccucccuguuacucauuugguaacagcucagaugguuuagcuuaguuacccauuuuauuucuaaccugcauuugcagaggcaaauauugcuggagaaauuuacacaaggaaguugguuucacuuuaaguucauaagcacaaacuuccacugccaguccaacaaaugugucccuaaguuugcuuucccacgcuucaugacaacuguguuacccauuuuccucuaauucucggaccuucuguaacccuuucccuacuacugucagcuaaauuugccuuaucuuuucuugagaccagagaugggaaggcuuuaggugggaauuaucuucccuuuauacuagcaaaucuguaaacaguuuuggaucgcacucauugccuuucuuuuguccuacuguuacaaugaagaauuucccccuucacaucaaacgugaguuuucuacuacuugcucuagaacuuucuucccuuuuuuguggucauugguccuguacuucaguucuuacuuuuuaauguacauaagaauuaccugguguauuaguccauuuucuucuuguaacagaauaccugagccgggcucaguggcucacgccuguaaucccagcacuuugggaggccaaggcaggugggaggucaggaguucaagaccagccuggccaacauggcgaaacuccgucucuacuaaaaauacaaacauuagcugagcaugguggcagaugccaguaaucccagcuacucaggaggcugaggcaggagaaucacuugaaccugggaggcggagguugcagugagccgagaucgcgccagugcacuccggccugggugacagagcgagauccucucaaaauaauaauaaugauaauaauaauaacagaauaccugaaacugggugauuuauaaugaaaaggaauuuauuucuuauagcuauggaggcuaagagaucccaggugaagaggccacuggugagagcuuccugcuaaguggggacucugcagaguccugaggcagcacagggcaucaucacaugucugagcauguuagcucaggucugucuuccccgucuuacaaagcugcuagugauagcccguugauccauugaucugugaauugggucugcucucauaacccagucaccucuuaaaggucccaccuuucaguacugccacaguggagauuaaguuucaacaugaauuucagaggggggcaaauauucaaaccauagaaccugggaacguguuaaaauggcugaucugaaugaggaggugucuagggugaagcaggagagucugcauuucuaacaagcuccaggugauacuaaugcugcugguuugggaccacacuguuauuuguucacucccacauugucugacucuuccggucuauuggaucauucuuauaagaauacagauuugggccgggcgugguggcucacaccuguaaucccagcacuuugggaggcccaggcaggcggaucaccugagguugagaguucaagacuagccuggccaacauggugaaaccccguucugaaaauauaguaauuagcuggguaugguggcgggugccuguaaucccagcuacuugggaggcugaggcaggagaauugcuugaaccugggaggcggagguugcugugugccgagauggcgccacggcacuccagccugggugacagagcgagacuccaucucaaaaaaaaaaaaaaaagaauacagacuuggagacugggggcggugacucacgucuguaaucccacuacuuugggaggcugaggcugauggaucauuucaggucaggagucggagaccagccugaccaacauggcgaaacccugucucuacuaaaaauacagaaauuagcugggcgugguggcacgcgccuguagucccagcuacuugggaggcugagacaggagaaccacuugaaccugguagguggagguugcagcgacucgagauugcaccacugcacaccagccugggcaacaaagcaaaacuccaucucaaaaaaaaaccaaaaaacagacuugcucuagugucuuccauccuaagaaacaaaacuuccccauccaaauacaacccuauuucuccauacaacagacucucucaagaguuguuugcuauuucguuagccugcucuucucucucucucccauacccauuccuaacccgaaauuguuccugaguuggucaaaaaggcaaauccaaucaauauuuuucuguccuuaauuuaaacucaaucuuuacuucuaaagcaugaaccaucuuuuugaaguuucaguggaaaacccaagguguuuaccaagcccuccucuacuuggugggauuugaacaacaaacucugucuccccugugguggcaguuucuuuggcuucucagcaguuuuuucucccugcacuucuuagaaucuuuccuacacaugcacaguccagggcucagccaagaguugagggaaguuuauaugcagauuuugggccucccccauuacccuuccuagaauauuccuccucaguauccagcuacucuagcagugccagauuucccuugauuccuccugccaaccagacuacaguuuucuccuugaguucuagucacagugcacuguugaauugaggguaaggccauauaaacauggauuucacucaguguguuucuuucuuuccaaaguugaauucuuucuugcuucuacuugcucuugguugcucaccaguaccuccaacagaugcuuuauauauuuuguccagaguuuauaauugcucucugcggggauuagugugaugcaugcuauuccacuauuaccagaaccagaauucuacaaguaucuuuuuauagugcagcuuggaucaugccauucuuuugcucaaaacucuucagugacuucacuuuacccuuaaaauaaaauguaaaauuuaucguggccugcaagguaccaccuaaccugacccuguguacuccauuguaggcucauggccacuguuccccuuucucacuucuuugacuuccuucccgcuauaugcccuuucucaccucugaaccguugaaccucauguuuccuauuccugggcagcucagcucccagcuuucugcauggcuuagugcuucugcucuccgucagcuuggauagcacuuuuuccugacaaccuuaucuaaaugaagugccucuaucaaccccuuguuuucuauacccuaacacucuacuuuuuuucuuucauagcacuuuucagacuaauuacuuuucuuaaucauuuaauuuuuuaaaaucugucuuccucacuagaauagucuaugugaggauagguacaaugaacuuuuuauuucuagugccuacgaugaccuucuucuuuucaguuuuaguaucuagaccagcacaguguuugacaaagagauuauauuuaauaaacacuaaacuaauaaagagaaggauaguuuaagccauugaauuaagcuaggcacuuuagaacuuuggaaaucuacacaaaauuaaggaaaucacuuaacuaggaauguucagcaccuuuaugcagucauauccaccucauuccauuuucaaauuagguuuaaaacaauuugauucaaccugaacugcaguguauuuuuuuuccuugauccauucuaccagccccagcauuauuuuuuauucucgcauuaugacuuuacccuugccucucagauuuaguauauguuuucuccuucuggcucuuguuuuggcucguccuaacccaguugccuuuuuuccuggauaaugcauccacaaguauaaaaaaaccuaccaaagaaaaauggcaauaacauggcuaaaauaauuaucagcauaguggcuaaaaugaguuuaaacuuaaaaaagcaaaaucacagaagacaagauuauauugaaugauugaaucaugcagagguacacaaaaaucaugaauauauuaaccuuauauuauuuggcucuaccucuguuuccuaucucauuuugugacuucuuuggguucacuaugucauucuguuacuuaaacacgcaaguauuuuuccuaccacagggcuuuugcuuauguuuuucauucucucucuggaaugcucuuuccucuacuuuucccauagccagcuuguucucuuuaagaucucagcuuaaaguuacuucuuaaagaaauugucuuagucuguuuggguuguuauaacaaaaugccuuagccuagguaauuuauaaacagcagaaauucauugcucauaguucugaaagcugggaauucccagaucaaggugccagcagauucaguuuuuggucaggacuugcucucugcuucagaauggcagcuucuuguuguguccucacguggccgaaagggccacugugcuccuucaacccccuuuauaaaggaaccaaccccauaugcaagggcagagccucaugacuuaaucaugccccgaaaggcuacaccucuuaauauuaacacauuggggauuaaguuucaaauaugaacucuggggggcaaacauuuagaccaaagcgaaggccuugucugauauaaccaucuuuucuaaaauagaucuuccugcucccauuauuuucuacucacauuuuaauguauuuauagcauuuacaaaugguuuuuguuguuguucuaucuccccugcuucaugaggacaggaaucacuuuggcuuuguaguccauuguauaccuagccucuuaauacaguaucuggcacauaacuggcauucaguagauaucuguugaaugugcacauacaugagugaauggugguuuaaaauguuaauuugugaccacuuugcuuuuuggacagaaucagauaaaaaccucuuuaaaaaugaagguauuuccucaguggggaaaaaaauaaaaacaaggauauuuccaaacuggcagaucaauuacgacuaccugacaaugaauuagaaaguguuuguuuuuuaacuuaaagggaaugaggcugggucugguggcucaugucuguaaucccaacacuuucggaggcugaggcagguggauugcuugaguccaggaguuuaagaccaaucugggaaacaaggugaaacuugucucuaccaaaaacaaaacaaaaaacaaaaauuagcuaggcauggugguacacgccuguggucccagcuauucgagaggccgagacaggaggauugcuugagcccaggagacaaagguuguaguaagucgagaucacgccacugcacuccagccuggcugacagagugagacuguguuuccaaaaaaaaaaaaaaaaagguggcggggggaggggugggcggguggggaaugaaaauacuacaaaacaaacaaauagaaaacauuauaaacuuucccaggauuugguccugucuucuuccccuccccgaauugguaaagagaccaaaaugcuuaaagauacauggguguuauaaaacugcuuuguaacacaauguauuaccaugauagaaaauauggggcugggcaugguggcucaugccuuuaaucccagcacuuugggaggccgagguggguggaucaccugaggucaggaguuugagaccagccuggucaacauugugaaaccccaucucuacuagaaauauuuaaaaaauuagccgggcaugauggcgggcgccuguaaucccaguuacucaggagguugaggcaggagaauugcuugaacccaggagacggaggcugcagugagcugacacagugccacugcacuccagccugggcgacagugugagauugcaucccaaaaaaaaaaaaaaaaaaaaaaaaacaagaagaagauaugaaugauuuugucaacaugucacacuaaaacuacaacucuuccuguuaggaacaccuaaaaaugcuugauaaauauaauuagaaaaguuuauacugcagaguugaguuuaaaggaagaaaagggaauucuuaggugccagaaacaaaguggggacugaaaguuuugguggcuaauggcauuaauauuuucuacagugccaugauuaauaaauuugaacuuuuauugauuguuacuagagugaccuuaaaaucauuaacucaaaaccaaaaauuaucuaaagucuucucaagaaauaauuuaugcaccauguagacuuuuuuuuuuuuaaacuguuuuuggauuauggacugcuugaauaaucugaugagaaagaaauuaagcucucuccucaaaaaguuuucauaugcagaaauuuugcauguguuuuaacuguggcauuaugacugcccuaaacucccccaugaucauggauaugucugaaaucauaccuuaagaacuugauucacaguguuauuuauugauaacaacaacauuaauuuuagggaaaauaacuuucauuuacuaguucuaaaauagauuguaaaauuuuuacuugauauuaguuugcuuccuaagcauuaaaacugacauuaccaaguaccuuuuuucccuuagcgcuccaaccaguuccugacauacagugucugcucaacaacuauuugauaaauuaaugaauucuagaauaucaaauaaguacccauaaacuauuuuuuucugauugugaagcugaaauuuucuuuauuugagugagacugauauuugacaucagggcucugacuauaggcaucuuaauguguguuauuuuauuguuauauuugaauguaaauucaaaaaaagaauaaaaauucaaacugauauuuuuauauuuuaagguaaaugaacauuugaaagacauaauggaacaagaacaaaaacugaaagaacaucacacaguugaagcuccaggaggucaaaagguauuuauuucaaaaacaaaaaggugccuuuaugagacuguauauauguucacauauuuguauuauuuugggaaauguuaauuguguuuauuaaauuauuuuuuagugguguuaacuguacccuagaaagccauacuguaaacacuaaguaaauagaaguacaaaaugaagguuaauuggaugaugguguuuguaaaaaaauauauuaaugacuagaacucaaguucugagguucuuuugucaaaaauaacaguuugccuuucuuugguaaaauguguaaaacaacaaggaaacaauuuuaaauguucaggcuuuauaaugacaugcaaugcagcaagaccaacauuuaaaacaaaauucccagaauuucacugggugcgauggcucacgccuguaauaccagcacuuugggaggccaaggcaggcagaucaugagguuaggaguucaagaccagccugacaaacaugaugaagccccaucucugcuaaaaauacaaaaauuagcugggcauaguggcguguaccuguaaucccagccacucaggaggcaggagaaucgcuuaaacucaggaggcagagguugcagugagccgagaucaugccacugcacuccagccugggggacagagcgagacuccaucucaaacaaaaaaaauauauauauagggccaggcgugguggcucacaccuguaaucccagcacuuugggaggcugagacgggcggaucaccugaggucaggaguuugagaccagccugcccaacauaguaaaaccccgucucuacuaaaacuacaaaaaauuagccaggcgugguggccggugcuuguagucccagcuacucgggagacagaggcaggagaaucgcuugaacccaggaggcggagguugcagugagccaagaucaugccacugcacuccagccugggcaauaagagcaaaacuucaucucaaaaaaaaaaaauauauauauauauauauauguauauauauacacacacauauauaugcacacacauacacauguguauauguguguauauguacaugcacacauauauguguauauauacacacgcacauauauguguguacacacacacgcguguauauauguguguacacacacacgcguguauauauguguguacacacacacgcguguauauauguguguacacacacacgcguguguauguguguacacacacacgcguguguauguguguacacacacacgcguguguauguguguacacacacacgcguguguauguguguacacacacacgcguguguauguguguacacacacacgcguguguauguguauauaucuacacauauauacauauauguguacccacauacacacguauauauguguauacccacauacacacguguauguguauacacacacguauauauguguauacacacacacguauauauguauacacacacguguguguauauacacguauauauguguauauauacacauacacacauacacacacguguguguauauacacacacacacauguguguguguauacacacauacacacauauguguguguauauacacacauacacacauauguguguguauauacacacauauauauauauuuucccagaauuccaaaauguacaguaugguuguucugugaagaaagaagaaacauuaacauggauuuauucuuuuaaaaaucucaaacagacuuuuagaauuuucuucucugaaaauuuaguuguguguuugucauaugcuaagaccaaaagcauauuuucuaugauauaguauaucuuacgucuuuuaaaauguauuguaauuggaacccuuuaaacauguuguauaguauuagaauugagguauaagaaauuguaaucauucagaaacuuuaaucuccauuugguuuaaaguuucuucauuauuacacaguacuucuauuauuuugagcuuauucuuauuccacuauucacugaucucuccauaaaaagagaaagaagggaaaaaggaaggaaaagcgaagcuguucugucucuuaucaacuucaauagaaaaaucuuguggaggaccacguacaauuuugucugauuuugauguuuugggaucacaaugcuuucccccauuugguuaacugacuggcuccugaaaauacgauuugugcuuaauccuucauucuaacucuguugagguccuuuacccuaaagguagauuggaauggaauucuccuuuuuccccaucaccccagauuauguuucauuucccugcuuccagccaauuucuguccuugccucuucccuguuacgucccacagucuuuucuugucagcuuccuucccuuucucuuuuucauaaucauaggagcugaaacuuuugccuuggagauauguguaauccugccccucaauuuugcuccuggcuuuuuaucaguaauaagguugaaguggcaucauucuaaauuauaacacuaaugaaauuucucuauagaaaucuuguguauuauauauaaugguuaaauucuguaguauugcauacacauuaugaaccaaauggggauuuuauaugaugacagagggcccaagaaacauuuuuuuaaugaaaaaaaugccauuuguauuucaaacaaucaaauaaagugaucuugaagaaaaacuguauggaaucuagacauuguuguauuacauggcuuuuacuuuuucacagcacuuagcuccaugcaguugcacguauuaacuguacaacuaguauuuggugaaugggugacugagugaauaaagaaaugauugugcaauucauuuuuaaauauuugauuaguauacacuuguaguuuagcacauacauagcauuuaccccuucauuuucaaaugaauuuuauccuuuuccccccauuguuuuugaaaauugaaucuuugugaaaauaaggguuaauuuaacauaaucuuacuguagguucagguguugucauuaugaagaaacacacaaucacagaauaaacuagggaaaggaaucuuggucuguuaccuaacaaugggauuuuuggcauuugaacuguguacuugguuugacuggaaauauuaucauuccauucuugguuuuuaauucuguaaaagcaaaauucaugcuccuuuucuucuuuuacaaaugagagagaaaaugacuugcucuuuuuauugcuauacaguugguaagaaguugccacucuuuccaucuacuucagucagcuuuucuagugaggcguacucaggagccuagcccuguugccuauugcuuguccagcuauagacagagcccgugguauugaauaauaacauaucuuaccuuuuguccuugcccaacuacucuuaacucagauguccaguagaauuuguuuuaugaaauaucuuuuuauaaccauauucuugguaaaauauaugcacauguugaaggauacuuguacuauauauuauuaggguuggacugaaaugaaagauuucaaagguauuuguuuaggguauuagauccuccagugauguauuucugaucauuggauugggugguguccuaagagaaaggcauuuuaaauagugucauguccuaggaaaauguuuuguuuaaacaguuuacuaauguuauuuucucuuuuuuuuccaaguugcucauuuugcuucuaauacuucuuuugauuguaaauuagggugccuaauuaaauuugaaugccagagaaacaacaaauaauuuuuuuauaaguugcacaggugucuuguauugugugagcaucuuguauuuauuugcuaaaucuggaagccguacuugaacgauuucugaaguuuauagccaagaugacauuaaguccaacauucauucucuugaagaguuuguauaaaguacuaugguaaaaugaguauugcacauaaagucaggcuaguucugccacuaaauagcuucaugaccuuuacaaaggcacuugaccucucugggccuuggguuuguuuuuuuuuaaucuguaaaaauuagaagguuggauuaaaugguuucuaaauucuguaauuaaaaagaugcucaguuuuucccuucucgauauguuaguaaacaugagacaaaaacaaaagguuggcaaaaauaguaaauaguuaucauagacuuuucuauauguauauuacuaguagauuuaugcuaacuguaugcaugaaauaucuaggaguaccuucuagaggaugugggacuuuaacagggccuuaguagauuucaugauacuaggucauaaggaacaauauaaguagugacacuaagucacaagugaagucacaugugggaauuacugaguggaugaauuuggcagaaucaguuuugaaagagcuaugaauucaugaguuuguauucuaauacuaacuauauagagaaugaaguuuaauguuucucaaaaaauuuuuuuuuuuuuuuugagacggaguuuugcuccgucacccaggcuggagggcagaggcaugaucucggcucauugcaacuuuggccuccuggguucaagcaauucucgugccucagccucccuaguagcugggauuacaggugugcaccgccaugcccaccuaauuuuuuguguauuuuuaguggagaugggguuucgccaugugcuggucuugagcucccgacuucaggugaucccccaguuuggccucccaaagugcugggauuauagguaugagacaccaccccagccaauguuucucaaaguauuaaagauacauguuuacuuaauguggcauuugcuacuuuuuaaaaagaaauauuugugagguauuuugcaagggaguaggaauuaggugaaggaauuaccuuuggagaaaagacauccacagagcucuaauugcuuuucacuuuaagguguaucucaauauagacuacacuuucccccugugagagaguagguaaaugcuuauaccucuuugccugauuacuucagcccuuaugaauuucucccuugacuaaaauuccuuaacaguuacaaacuauaacccacuuuuuucucccucaaaugcuguuucuucaaauaguacuauuugagagaagggcuccgaaguaaaauacauuugggaaaugcugccuagucuaugccccuuuaagaauguugcaauccauuucaguacauuaaagucccagucaaagagacuguuuagccauuuuccaaacauuuuugaucuuugaacuguuuuauaaaugacuuuuacuagcaucccauagaauuaguguucuucagugcacaauuuagaaaacgguaauuuuuaacguauaauuuuguacuuaaguugucuauuuaauauguauauaaauauauaaaacauuuaauguucaaauauagcgcaucauucucagauacaucauuucauuugacucuuagauuuaccucgauuucuuuuauaccauuauuuuaguuaacugugaagacauagccugucuaaauuagauaauuuuuguuuugaauccuacccuuaagauucuguuuuauaauuauaaaucuauccauauguagccugcuucuucuucuucuuuuuuuuuuuuccuuuuggagacagggucucacucuauugcccaggcuggaaugaaguagcgagaucauggcucacugcagccuugaucuccugggcucaagcaaucuucccaccucagccucccaacuacuugggacuacaggcaugugccaccaugccuaucuaauuuuuuuacuuuuuguagagucagggucucaccauguugcccaggcugaucucaagcuccugagcucaagcaguccgccugccuugaccuccaaagugcugggauuacaggccuuuggccaauguguagucuucuguggucaaugcuaauucauuucuucuucuucuuuuuuuuaaaauguuuuuuacauuaauagggaugggguuucgccauguuggccaggcuggucucaaacucuuggccuccagcgauccacccgccucggccucccagagugcugggauuacaggcguaagccaccacacguggccauuucuuuuuuuuaucccuaauaucaacauaccuuuucucuuucauaauaauuuacuugcccuuacaggaaacacaacaaccuagaguacgucccuguucuauuauuaacucauuuauuauaguuaagagaacuuggcauuuuaaacauuuuuuugaauucagagaugguaccaugguuuuaaucuuuaccuaagaguaugauaaccauuagauuucucuaacaguuuuauaaauuaauaaucuugugcauuuggacacaagacccuauaaagacuuggauugguauagaucuaauauaacuuuuaaagaacuuuuauuuuauuuugaaauaauuacacccuuacaaaaaguugcaggaauaguaaaaagaauucucaaacucuguucagauucaucaguuuuucaacagauucaucaguuuuucaaacugaaaauuuccuuuaucauucugucucccucucucucucucucucgcucuacacacacacacacacacacacacacacacacacacguaaauuguucuaccacauuucaaagaagguugcauauaucaugccccuuuaccccuuaauacuucaauauauauuuccuaagaacaaggcaauucauuuccauaacgacaguacagguaauuuaaugucaguauaauacuguaucauuuauguucccauuuuaucauuaauuuauuucgcugucauaucccuagucuucuuuaaacugaagcaguucuuuagcuuuucuuuucuuuguggccuugacauuuuuaaagaaucgggcuauuuuaauagaauacuucucaauuuggcuuuuucuaauauuuccucauuauuagaugaagguugugcuuuucaggcuagaaugcuuuguaaauuguguccuuaucacaauguaauauccagaggcacaugauauccauuuaccccugcuagauaauguucauuuugaucaguugguuaagauauucucugguuucuugacuacaggguuacauuaguccucuuuuauccucagaggauauguuccaagacccccagugcauaccugaaaccucagauaguacuguaucuacacuuuguuuuuuccuauacagcaaugggcagguagcauauacagcauggaaugcuggacagagguaugauucccuucccagacuggauggaauaggacagcaugugguuucaucacacuccucagaacagcaugcaauuuaaaacuuaugaguuguuuauuucuggaauuuuucauucauuuucagacagugacugugaauaacugcagauacaaaacuauggguaagggggggacagcuauauuauguuuccguuuguaauagguaauuugagaggaguuacucuaccacuguaaauagccuaucuuucuugaaagcuuccccucauccuagauuuagcauucauugaauauaccuaccugaauuaauuuuacuaugauagucacaaauuuauaauuuucuaaccccuucauuuauuccauauuuauuaguuagcauucuguuauaagcaaguuuuucuucuuccacccaucuaccugucuauauaauauuucucuacuaucugaaugagcuuauggauauguaauggguuauaaucaguuuuuguccuuauguauuuacuuuuaaaauuauuacagaauuauuuuagauuuacaggaaaguuucaaagauaguacaacuucacccaguuuucucuaauguuaacaucuuacguaauuggagcccauuugugaacaguaagaaaguaacauugguacauuauuauugaguacacuacagacuuuauuuagauucuacugguuuuccacugauguccuuuuuaaauauuugucagguguuuuguaguguucuucaauuuggguuugucugauauuucucaugguuagacuggaguuacagguuuuuugagaagacuaccagagaggucauauaucauaucauauauuguaucacgggguacaugauaagaacaugauuuaacacuagugauauuaaccaugaucccuugguuaagguaguguuugucagguuucuccauuauaaauuuacugguuuucccuucuuauuuuuggaagugggucaccaccuccauccugcacuccaaaggagggaaauuaagcucacucccugaaagggagaauacuugcauauacuauuggggauucuucuguaaggaagauuugugucuucuuccccauuuauuuuuuauauucaaucauuuauuuauaucaguauggacucauguauacuuaauauuuuaugcuuugaguuacaaucuaauacugcguuguuuauuuuguugcucaaaauuuuacagcaucagccacugagagcuuuuugggguuggcuuugguaucucuuggauaugccccaauccuuuuguuuuuugagcacuuccuuacuuucuggcacuacagaaugcuccaggcucaucuuguucuuuccuugaccuaaaauuagcuauuucuuuauuuugaugcucaaauggucuuagauuuggccaacgggagucccuucagacugacuccugugcuuuugauaugcccccauucauccaucucuuuuuuuuuuuuuugccccuccuuauuuaauuucuagcucaacaagauguuucagauucauuuuguaguuuccuugccauaauccuaaaaucagccauuucuucaguaagucuuaauucuuuuuuauggaaaacaguauuuagcaacuguaaaaucugggcacuaaguggcucauugcuacaggaauaucauuacuucuaggcccuauuucaguagacagaguucagaaauaaaauuuuaaaaauacacaaacaugaguucauauauaaaccuccaauuccaaucaaacuccacagaguucuuccuggcuuccccuauuccaugcaggacuuccccuuccacagugagaacucaggcuuccaacagcauuaauauauuuuacuuauuugcucaguccuacaauacauauacaguaguuucagaauugcuauacucauaccaauaugaaaaauaaaccuacuggccgggcaugguggcucaagccuauaauccccgcacuuugggaggccgaggcggguggaucacuugaggucagaaguuugagaccagccuggccaacauggugaaaccccgucucuaccaaaaauacaaaaauuagccagguguguuggcaugcgcccguaaucccagcuacuugggaggcugaggcaggagaauugcuugagcccgggaggcggagguugcagugagccgagaucgugccaguguacuccagccuaggugacagagugagacucugucucaaauaaauaaauaaauaaauaaauuuaaaaaccuacuaagaagaauuuaagauuuguuugcaauuuuuuuuuagacuaauaguauauagucaaaguacaguguucuuaaguuguuucccucugcccccgccuucacugugguuauauuauuccuuugaaauacauuuguguuaauugguuucuguauucuuuccauuuuagcgaucuuuuuugacaccauccuuguuaacuuuuguuuuuugaauauguagaacauugacauaauuccaaaaaucagaacuauauaaaugguauacucagagaaguaucaaucccuccccuaucucuucuaccccuuacuuauuccacauguacucccucccagcccuucuaaauggaccaagcacguaugugcauguuuguuucuccuccuuucuagcacaaaacauaacauauuuauucuuuugcaguuugcucuuuucaguaacuguauauccuggaaauuacuccauacggucccuagagaucauucuuucuuucuuucuuucuuccuuuuuuuuuuuuuuugagacagagucuugcucugccacccaggcuggagugcaauggugcgaucucggcucacugcaaccucugccucccagguucaagcgauucuucugccucagccucccaaguaacugguacuacaggcgagcgccaccacaccuggcuaaucuuugcauuuuuuaguagacacgggguuucgccauguuggccaggcuggucucgaccuccugaccucgugaucuacccgccuuggccucccaaagugcugggauuacaggugugagcuacugugcccggccaaucauuauuucuuaaagcagcauagugcugccuugugaauaugugccauaguuucuucaacuauguaccuauguguaggcauuuaaguaguuuccaguaucuugcuauugcaaauugugcugcacagaauacuguuauauguggccuuuuguauuuuggauauguauuuucaagguaaauuuccuagaaguuggacugcuagauugaaggguaaaugcauacuguauguaguuuuguuaaauguugacgaaauccccuccaaaagagcuuguaccauuuuauauuccaucagcgauucggcauaacuuuuggaucugcaacagcuaggagauuaagucuaauggcugggcgugguggcucacacuuguaaucccagcacuuugggaggccuaggugggagguucacuugaggucaggagcucaagaccagccuggccaacauggugaaaccccgucucuaccaaaaaauacaaaaauuagccaagcaugguggugcaugccuguugucccagcuacuagggaggcugaggugggagaauugcuugaaccugggaggcagagguugcagugagcugagauagcuccgcugcccucuacccugggugacagagggagacugucucaaaaaaaaaaaaaaagauuaaaucuaacaaguuaacaagucaugcaguaacaagucacagccaugauuaacucccugaaggaccccaacucuuugaggucuccaauaaagaccacaccaaaccaauauccuccuggaacggccugagagcaccuagaaguaguucaggaauuauccuaccuugccagaauguuguagauacccagaggaagaguauuauuuggagaguauuaauggcaaguccuaaaacaacuagccaaaauucagggugagccaaacauguauuauaaagacaauugaaaggaauauuugaaauuagaacuauuccagaaaaucuggacugccuagguuggccccuuugucgguagaaacuuaauaaaaguuuuuucaccuguuauccauggguuuuaaaaaacccuuuguuucuugccuggugguccugauaaaaagaaaaaaaaaaucaaaaaaccuuuguccucgugguuauuuacaucuuaaaacaggauuugauguugcaguuugccuaauucuucccugaaaaccaaaaggauaguugcugaucacuucagaaauggcguuauucuucagcaaggaacuuaugcuauguauuugagcuuuuugaagcauacguauauaaguaugcauaguauauuuauuuguucuuuuaguacauuuacucuuuaguuaaauuuccuucacacagccaaucuguggguuuccuuuuuccgccaagaagauugcuguuaccaguuuagaucaauggagggccaagagaaaggccagagcagucugaauuaguaacaaaauccaauuauugcauauuuuacaagaaauauggaauaacuuuaaccguuaagagacuucuuuguacaccugcuguuaggaauaguccacaauaauuucuuguuaucaccauuuucuauuuaauggguucuucuagucuagaaaacaaaaaaauccuuguuuuuaaaauuucuguuacaaauuggaaacccugacacguuuucaguggcuuccugcucuuugguccugcucuuguacuuuuuguggcuauuauaacugcagcugccaaaaacguucaguuaaaugggagauuaaaauacauuccacaaaauuauugaggcuauucuuccuggugcuauaagaaaaauuuauuggaaauguuguuuauauguaggaagcugguauguuucugauucuucaggugacauuuuucuaauucuuaaaguucuugaaaauaccuuauuuauauuauuuuucuguuuauacggaaaaacuuucuacauaaaaauuuuggauaugaauuuuaauuuuggauaugaauuuuaacucagauucuauuuacuuugguucacuucaacaaacauuuauucagagccagaagcuguuuuagcagauacaaagauaaacaaacacaaaugauuaauucauguuaucugaaauuauggguuuauuauauucauuuuuuuaaagaagaaaauuagauucuuugggacagcccuagauaguaaauuuaauaacauuuauauucucuuugugugaguaguuacuugcuuuagacacuuacaaaaaucuuaacugguaacaauugccaacuagguuuuuuuccauuaauuaaaagaaacuuuuuauauagugaaggaaaugaucaucuugauauauucuacuauauuauuauuugcuuuauacuuguuuuuauugaaauuaucuuucuacuuugcuuuuuggggaauauugccuugucagacacagucuacuaauaccuaagaauuaugauugcaaaccuagcuguagaauauuuuuacuucccuuuugugauauagauuuauuuuuuaauaugacauaugauuccaaaacucagaaauaaaauuuuuugcugcuaaaguauacagcauauucuagguauccuacaaugaauaucuguauggggagaggagagagacaggagaagauaguggucuuuagcauuaggaacuuauguauuuuuaacuaaaauauuuauuaacauaugaaauguuaugagaacuauaaacuuggaacuccacuaucagaagcuuuacuauaauuuguuaauugaagauaauucugaugaauuuucccuuuaccuuuugcuuuccccuuuuuucccgcugcuuccucugaagucuccuuccaaaugguuuuggaaacugguuccaguaaguuugcucagcuacuucaguuugcucuccagaauuguaauuguagaaugguauuguuuaugucuugcuguuaaagucauuucauguaauucuguuagucauugaauagagauuggauuuuaaggucauguaaaauggaaagauaaaagauacagccaagguuuagaucagaaguucuaaaaauaauuuaaaggguaaacauccuguugcuaaucuugucaguauucacagacuaucaguaaguagguuaaaaaaaaaaaacuuaugggccaggugcgguggcucacaccuguaaucccagcacuuugggaggccaaggugggcagaucaugaggucaggaggucgagaccagccugaccaacauggaaaaaccccaucucuacuaaaaauacaaaauuagcugggcgugguggcgcaugccuguaaucccagcuacucgggaggcugaggcaggagaaucgcuugaaccagggaggcagagguugcagugagccgagaucgcgccauugcacuccagccugggcaacaagagugaaaccgucucaaaaacaaaaacaaaaacaaaaaucuuacuauguagcuucucauuaauuuaaauaauuuuaguaaauauuaauuugaauugcaugaauaaauugccugcauuuaaaaaucaucuuuguggcugagcaugguggcucacgcuuauaauccuaguacuuugagaggccaaggugggaggacugcuugagcccaggaguucaagaccaucuuggacaacauauugaacccccaucucuauuuuuaaaaaauuaucuuuuugacagaccuaguuccuuuucagcuugaauuauagaugacacuucacuuuuugugugauuaagaaagcagaagguuuucugugaccucaccaguagcggaccaaaaccauauuaaauucugauuugacuuaaagauugaucuuucagauuuaaauauggggauggguguguuaaaccacuuaagaacuauuuuacauccucgauaauaaaacucuaauuuagaaauauaccauaauggccgggugcgguggcucacgcgcauaaucccacacuuugagaggccaaggcagguggauccuuugaucccaggaguuugagaccagccugggcaacuuggcaaaaccucaucucuacaaaaaauagaaaaaugaggcaggcauaaugguacacauuugugguuucaccuacucaaaaggcugaggugggagaaucaccugagaccaggaggucgaggcugcagugagccaugauugugccacugcacuccagccuggguaacagagugagacgcuaucuccaaaaaaaauaauaauaauaaaauaaaaauaaaacaaacaacaaaaaaaaggagaagaaaauaaauauaccauaauguugaaauauaaaaauauaggggguucuuucuaaaugccaaacuucuuaguuugcagaaagaaagggcauguuuccaugcaauaaguuuauaaagcaaauagcauguucaaguacaaaagacucuuucaugaacugcggaugaaccuucugagugcuggacauaaucucaagauuuaaaguugguuuacuuaauauaucuucuagaauacaaucuuuaggaaaauguuuuggcaucccauucauaauucucugucuagucuaaaccauagauacuuauugcuaaugucauauaaagcugugugugugugugugugugugcacgugcacauacaugugccuguuugcacauaccuuguacaaaagugcuacuuugcaggagggaguagaacaaaucacauaauucaauucuuuguugcaugacccugggugcuuggcuuaguccaauucaggucauaggcugaaaacaaacuacuagucccagcccaauuuugaggauguccaagaggcagacuguuuuuaucccagauaaccaaagaaaagcauguaaggaucuggaacagauacuaauugugagaacgguagcuuaagccuagaagauaccgcuguacugguugauuucuuuuuucuuucuuccuuccucuucccuccccaugguugauuuuaagcuguuucuuagcugcaaagugaggaauuuucuaagaauuauguuaaaaucagaaucaauuaaagaauccauauaguaccugcaaguaauuuuuuucugaauauaguuacccccugaauuagggauguacucuuaaauacggagucuauuaugcacuaauuaacaagaaccuucagaaaucuuuaagaggaaaacauguuccaugaauuuuguccuuggguagccagugagagaaauccaggaauaaguaucuccuucuucauuaaugcugaugcuuuucugagagauagcauugaaaagaaaucuaacuucacuaccaaauguuguguucucuuucaguaaauuuuuauuuuucuauuuuuauucucacaaaaguguuuuaucuuauaauuauauuuuaauucuaaacuauagagaugaccaauuuagauggaauuagaagaaaaaauaguuugauaaccuuaaaaaaacuaccaguaauuuauguuauauauuuugcuagcaaaauacuuucguguguacauucacuaaaucuucagcauuauuuuacuuggcuuuagaagaguuaacagcuaauaauagcuaaccuuuauugauugcuugcugugugcccagcaggaugcauagcacuuuguguccaucaucuuacuuaaucuuccagugguucuaugaaguggguacuauuauuacgccaguuuacagaugggaaaaugagaaaugagaguuuaaguaacuuguccaagaucacaaaacuaguaaguggcagaaccaggaucugaaccaggaucugaauuuguucucuuaacuauuacagcaugucucauuuuuuagagaucuauuuuuaaaaauucuaucuagccacaccaaacaaucuuuaggaaacaaagguuucuucucuuuuucugagggggagcaagaacccguauacuugcucaauuauuaaugaaaucuaaguuggaaggguuuuuuuuuuuuucacuuucaaaguuguuaacuauuuguguuuccucaacauucagauaauaacccagaaugucuuggugauacuauuccaguuccucaaauuucuuuuaagaauaguauauucuuuuaccuucccccucauuuugauaacucuuucugcuugaauaguauucuugcucuucccguauaagaauuuucaguuuaaauuaagucugaauuaaaguagaugaauuuuauuaucuucaaaagagcagaacugauuauuuggauacaaaguguucaaaaucuguuuugugaugcuuuuauacuuaaauauuuaagccaaaugucaguuaguguaaauuagcaguauguuauauuaaguauugagcuucaaaacuauagcuauuguugccguguauuuaacuuugguaauaccuagcguuauuuagaaaaaaagaaauauuggugaguggucucauuucucaugauuuauuuuauuacugguacauuagaauuuacaguacugauuuuuuuccuaugcguuauuugguacuuauuuauuuucauguauuuuuuuuauaucguaggcucguuaucggaaagagcaaacauugcuuaagcaacugccuugcauuccauugguagaaaauuuguugaaggaugggacagauggcugugcauuagcugcccuuauucauuuuuacuguccugauguugucagauuagaggguaaguguuccauuguaauacuucugaacuguagacagauaguaaccaauauuuaagacaguauuauuuugcacuccagccuaggugacugagugggacccugucucaaaaaaaagacaauauuauuuaauaaguacugaagacuuuuuuuuaaaaauaaagaacauuuauauauaauucugagggagguaguucaaaaaaaaauagugcucgguuucuaagucuuaauguauaaugacuacuauauuuauaaauguauguuuguuaaccagaauuguguauuuguacuaauuacaagauggauaugaaauauuuauuaucaaauuaauccaaagucaccaccuugcucuuuucuuauuugaagauauuuguuugaaagaaacuaugucuuuggcugauagccuguauaaucugcagcugauucaagaauuuugccaagaauacuugaaccaguguugccauuucacucuggaagauaugcucuaugcugcuucauccauaaagguaaauuaaauuauucuuuuuuucccuuugcuuuguuaaaauauguuuuuuuaaaaaacaaacaaaaacaccgggaacaguggcucaugccuguaaucccaguacuuugggaggacaaggugggaggauugcuuaagccugggagguugaggcuucagugagcgaugaucgugccacugcacuccagccugggcaacagagcaagacccugucucacaaaauaaauaaauaaaauuuuaaaaauaaaaaauaaaccauagaacaagauauauaaaugaccuagcaacuuuaagcuuauagauuaacuauauuagucaaaagaacuuuugaagaaaguuuuuaauuuuuuucuccuuauuuuguuuuuuaauauacuauaagcuacaaguuucuuuuauagugcaaagccaaacuuaaagucauguacaaaauuggccaguuguagugacucgugccuguaaucccagcacuuugggaggaggaggugggcagauagcuugagcucaggaguucaagaccagacugggcaacauggugaaaccccaucccuacaauaaauacaaaaauuagcugggagugguggcaugugccuguguucccagcuacucgaaggcugagguaggaggauugcuugagucuggaaggcagagguugcggugagcugagaucgcgccacugcacccuagccugggcagcagagccaggcccugucucaaaaaaagaaaaaaaaaagucauguacaaaauugaucuauugucuuaauguuugcaaaauagagaauaagccauuaaauguuucuuacaaauagcaaugcuuacaaauaguaagauucuuuauaaauaaugaagcuuucuuuuucuuaaagaauuuuuaauuuuugaauuaaaaaauuaauugaaaaguaacauuauguacuauuuaacuaccauuaugcauaaauauaugauauguauaguuaaaugauaugguauccuugcguauuuuuauguguacaaugagucauugagcauuaaauugaaauuuaguuuguuuauucucacuagauuauauauaauuguucuguaguuaccagacuguuugaaauuugucacguuuauuguccuuugacuguaggcuaauguaugcugucagauuguguuaaaauaauaaaauuucacauggguaguauuauuuucuuaauuuuaaguugaauauauuuuauuuacauugauguuaaauguuaaaaauaauaaucauggcugagcaugguggcucacaccuguaaucucagcacuuugggaggcugaggugggcagaucacugaggcgaggaguucgagaccagccuggccaacauggugaaaccucacguuuacuaaaaauacaaacacuagccaggcguaguggcacgcaccuauaaucccagcuacuugggaggcugaggcaggagaaucacuugaaccugggaggcagagguugcagugagcugagauggcaccacugcauuccagccugggugacagaauaagacuaugucucaaaaaaaaaaaaucauuauuaucaucaucacgaauagauuuuugaaaaucauuccauuccauucccaaguuugaaaauuaaguuguguuaugaauacuguuauuuuuaauacuucaagaauuaugucuuauccuccagauguuauuuuaguaauguuaguguuguacuuuaugugagucaauaauauaaagucaauucagaaaucagaaauguuuucuaguugagucauauuaauuuaugaaauacugaacuacaauauaaaaacuucaggccuggugcgguggcucaugccuauaaucccagcacuuugggaggacaaggcaggaggaucgcuucaguccaggaguuugagaccggccugggcaacauagugagaccuuugucuuuacagaaaauaaaguuagccaggcgugauggcacacauguguaguaccagcuacucaggagguugauauuggaggauugcuugaaccuaggaggcugagacugcagugagcccugauugcaugacugcacuccaaacuuagugacaaaccaagacccugucaccaaaaacaaaacaaaaaccauaggggcuuucucuuuuaauuuuuaaagguuaaaaaagaguguuuaaaauaguaauuauuugaaguucaagauuugcuguuguuaaaaacauggugggaaucauauacaugcuauauaaacacaggcaacccccauguaugcaguuuuaguucugguaaaccauuuggaagcagacuggggaaacgaacuggguacaccuuugcuuuugaagaauuuuaggauuuguuugcagcuacucuagguuaccaagugucacaugugcaucauuagaacaaagcccuaauuuaagacacugaagaacuacagaaugcaaguguguaaaaguuauuaagaugaaaagaaaggagcguuaaacaaguuugucagcaaaauguaaaauggcaaaauuuggagauuauuauaacuuuuagaacauugcaggacccacacuaauguuugaaaaauauuuuagcgagagacuauuauaugcuagacacuguacugagccuggggauuuggucauuuauucauucaucggcagauauuuacugaguaucuccaugugccagacacuauucuuagcuuuggagguaaagcagagaacgaaauggcaggguaaacuauaaagccagugguaaagacauuucuaaaauaagccacugcuccugcugacccaaaguuguacccagucucuugugucugacacaucaaaaaaaauuuuuuucuaauugauguugaagguuuacacccuugccauucauaucagaaugaaagguaauaucauuuccauauauaucuuguaaugcuuuuucugguauuuucagguaauaacagaaauauuaauuucuguuaguaccagaaaaggcaucaacaugauaucuacauugucagcuaaaaauuuaaaugcuacuucuguaaucucaaaggaaaaaaacugucucacuaaauacauggagauauaagauugcauuuguuuaaguugguauaccuuggacuuccaauacauaauauacaguccugauguuuauaucaacuuugucuggguacgacccauauaaagauauuuucuuaaauuagguauauuuaaacuaugauuuucuacagaaagggcuuuggucacuuucuauguucuuuacuuauuacuaccacagcuuugacuucauuugaaucuuuuuuuuuuuaauucaaucuuauuuuaaacuuuuagcuuaagcucaaggguacauaugcagguuuguuacauagguaaacuugugucaugggaguuugugguacagauuuuuauuucgucacccagguauuaaccuuaauacccaucaguuauuucuccugauccucucccuccuuucaccuuccacucguggauaguuugcaguuucuguuguucucuuucugucccuguguuuucgucacauaagugagagcauguggugugugguuuuguuucugcauuaguuugcuaaggauaaugaccuccagcuccaucuguguuccuacaaaggacaugaucuuguucuuuuuuauggcugcauaguauuccauaguguauauguaccccauuuucuuuauccagucuagcgucaaugggcauuuaggaugauuccaugucuuggcuauuguuaauagugcugcagugaacauacacaugcaugugucuuuuugguggaaugauuuauguuccuuugggauauacccaguaaugggauugcuggguucaguaguauuucuguuuuuaggucuuugaggaauuaccacacuguuuuccacauugguugaacuaguuuacacuccuaccaacaguguguaaauguuccuuuuucucugcaacuuugucaacaccuauuauuuuuugacuuuuuaguaagagccauucuaaccggugugagaugguaucucauugugguuuugauuugcauuucucuaaugaucagugauauugggcuuuuuuucauaugcuuguuggccgcguguaugucuaugucuuuugaaaagugucuguucauguccuuugcccacuucuuaaugagauuauuuuuaucuuguaaauauguuuaagucccuuauagaugcuggauaugagaccuuggucagaugcauaguccgaaaaauuuucucccauucuauaagcucucuguucacacuguugauaguuucuuuugcugugcagaagcuuuguaguuuaauuagauccuauuugucaauuuuugcuuuuguugcaacuucuuuuggcaccuuugucaugaaaucuuugcccauuccuauguccagaaugguacugccuagauuuucuuccaggguuuuuauaguuuuggguuuauauuuaauucuuuaauccaucuugaguuaauuuuuuuauauaguguaaggaaagugucuguuuuccaucuucugaguauggcuagaccguuaucccagcaccauuuguugaauagggaguccuuccccauuguuugcuuuggucagcuuuuucaaagaucagaugguuguagauauguggccuuauuucugggcucucuguucuguuccauuuuuguaccaguaccaugcuguuuugguuacuguagcccuguaauauaguuugcagucagguaacaugaugccuccugcuuuguucuuuuugcuuaagauugccuuggguauucagguucuuuuuugguucaauaugauuuuuaaaauaguuuuuuuuaguucuaugaagaauaucauugguaguuuaauaagaauagcauugaaucuauacauugauuugggcaguauggcuauuuuaacaauauugauucuuccuguccaugagcauggaauguuuuuccauuuguuuguaucaucucugauuucuuugagcaguguauuguaguucuccuuguagagaucuuucacuucccugguuagcuguauuccuagguauuuuauucuuuuugugccaguugugaaugggauugcauuccugauuuggcucuuggcuuaacuguuguugguguauaggaauguuagugauuuuuguacauuaauuuuguauccugagacuuugcugaaguuguuuaucagcuuaaggagcuuuugggacaagaguauguagccuuaugaccaucuuaacuaaaagaaggaaagaagaagcuuuuaaaugaauuaaucuggcaucauuccugaaauauggugacagauuuauugcuguuuaaucgucaugaacucagaaagacauaaucuucauaaguuuuaauuacugggaaaauuauuucuuacucuacugacaucuuguggccaaauaguacaauuaauguuauuaggauggcuaucuuaccaaaguccuuaaaauauuaacuuauuuucuguucaacagauaauuauugagcacuuaagcaguauuuuuucaaaauauaaucagcuuucaguuaacuaggcuaguaaaauggaaccuagcaccaguacuuaaaaaccaauuuuauacuuuggcuuuagaaaguauaccauaaagauaaguauaaagaagaaauauaaaucacaauaaucuuacuaaucagaaauauugugucaauguuuugauguuuuacugacuguuuuuuuuaguacguagauucauucauuuguacauucauuuaauaaauauuuauugagcaccuaucaugugccagacacuguuuuaaacacugaagauauaaugaugagcauaaacuuugucuuuuuagacuuuaucaucuggaggguaagaugaggaaacuuggagaauguaguaauagauaaaucugggaagagaaaaagggacuguaccaaguagccucuuguaagccauaguaagauucccuuuaccucaagagcaauggaaagagaguugcauuuugaaaaguuuguuuucuuagcaagccaaagaaaaagcuauuguguuccaaacaaggcaaaaauguuugaaucagagcaguuaugauggagagaaguuggugaauuccagaaauauuuaggaugcaaaaucugcaugcuuuggugaugaauuggacaugggagaaagaaggugucaaggaugacuccuagguuucugguuugcacacugggauaguggugccauucagugagauaaggacugcaguaagaucacauuuguagggaaggucacuauuucaauuuuggacauaggccuuugagauauccaaaagaaaaugcucgguaggccacugcauauauaagugcagucaguacauuugagaaucauuuaguagcugauggacguaggcauggcaguguuucaaagaggggcgagaucaggaauaucaaaugcagcugagaggucaaguaagaugggaaaucuguuugauuuagcaacauauguacaucauuggugacuugagcaguugcuguuaggggaaugaugugacucagugccaagacugaaguagauuagagaguaaaagugaugaaauggaaaaugucaguagaggccugcuccuaaaagaaguuugugaagagguaaaaagauggugggaaugaggagaaacuagagaauaguuauugaguaaagguuuuguuucauuuauuuugaugggagggauuugagcauguuuaaaagccaaauaggaaggauucuguugacaggggaaggauacauauguaggagagaaaaguaggauuaagaauauaauggcauucacagcaauuuggauggaauuggagaccauuauucuaagugaaguaacucaggaauggaaaaccaaacaucauauguucucacucauaagugggagcuaagccauaaggaugcaaaggcauaagaaugauacaguggacuuuggggacucagggaaaaaagcaggagggaggugagggauaaaagaccacacauuggguacaguguacacugcuugggugaugggugcaccagaaucucagaaauuacuuaaagaacuuauucauguaaccaaacaccaccuguuccccuaaacaccuauuaaaauaagaaauaaauuuuuuaaaacuguaaaguuucugagaagucaagcagggaugagagccacugcauagccuuuacggauuauaagcauucuuauuacuuuuuuuagucacaaauuuuaauggcugcuucaauuaguauguaucuguauaucaacauucuaaaauucugagaauuuacaguaaaagcaaacaugaagguaaaguagaaaccuaccaaaugcucuucaccacugugcauuaucuucuguaauacuccagacucuuacacucagccaccuacaagacagguccacuuaaauguccagugaacaucucaaacaaugacucuagauuccuuucauuaccuguuucucccaguccuuucuaucucacuauuaguugcucgagacaaaaaccuaagagucaucacucuugauucuucucuuuucaucacuuucuuuuuauuuuuuuuuagagacagggucucacucugucacccaggcuggagugcaguggcacaaucagccaaauccugggcucaagcuguauuccugcccuagccucccaagcagcuaggaugacaggcacgugccaccaugcauagcuaauuuuuaaaauuuuuauagaggcaagcuauguugcccaggcuggucucaaccuccaggccucaagcaguccuuccuccucagccuccucaagcacugggauuacaggcaugagccacugcgcccagccucuuuucuucacuuucuacauacacgauagccuuccagaacuaucagaugagagaugauauuugaaagucaccaacuuaaauaugagaaaaccaagagaacgcaugaguucuaguggagagcauauagaguuuaaggauuauucauaauuagcaaguaggaagaaggcaagacauuagaaaauaaccauauccaggauaaucuuaaaaacuuuaauaugaaauaagaccuuauuaaacauuaauaaauuugauaguaacuauuuuauuaaaugccaaacacccaaaauuuagaaaacauauuauuuuaaauaguuaugaaaacagauuuuguaguuuuuaaaaauuuaccgaaugccuaaaauugaaauaauucuucaugcuuacagcuuuuauuuuauaugcauuuuaaaauauaaacuuguaguagaaaugugcuuuugaggacccuuaauccuuucucuuaauuuuaagccauuuaaaaaauuauuuacauuuuaaaauaguaauaauaaaagguaacauuguugacuuauugauaacuuuucaaaguuagguagauacauucauuguauaaauaauguuuuguacauuucaaaauuauuaaaaauuagcuauaaaaauuuaguuuugguguuauuuagcaccuguauuacuggugaguuuaacauuacugagcacauacauauaacuuuuuuuguuuaagacggagucuugcccugucacccaggcuggagugcaauggcaugaucuuggcucacugcaaccucugugucuuggguucaagcuauucuccuaccucagccucucaaguagcuaggauuacaggcacgcgccaccacacccggcuaguuuuuuguaucuuuaguagagacgggguuucaccuuguuggccaggcuggucucaaacuccugaccucgugaucugcccaccuuggccucccaaagugcugggguuacaggcgugagucaccacgcccggccaaauaaaguauuuuuuuaacacuacauccaguuacguuuuggagaaauuucuagggaucugaguagagcuuaguuauguuuugaaagugauaaccccucuuuagagugucagaugauugaauaacuuuuuaaguugcuuauauuuacuuuggaaugaaagugccuuauauauuaucucaguguucuacacaguuagagguauucaugccugcuagaucaauuggaccaccauuuuagaacuauagagcaaaugaucagcaagagguuuugaauaguuauaauuuuuacccacaagaguuaauauuccaucccauguuuaauagccuacuauagugaauauacuccagugaugaaugaaugagauuuaaaccuauauuuuaaaacaauaaaauucuguuuaucaugaaguuuuaccuaauguaggcuuucucuuaaauuuccuauauagaguaauuauuugguguucauggcggaacuguucuggugguuugaaguggugaagccgucuuuuguacagccucguguuguucguccacaaggagguaaucaaucuuuuuaauuuuaaauguuccuaugaacagaaaaaaauggaauguugauauaaccuuaccugguuacauuuuuagaaaucagccuauuauuuuuuuuuuagauuucagcuauuacacuugauagauucuccuaaccucuuaaaaugguuagaggagaagaaaaagaaaauggagggaauggcuuugaauuugaagucuuaugauguggaacuuuuagcuuuaacuguccauuucuuuucuuugcaucuuuuaucguuaucccagcuuuuauucccuuuuagauucuuaguuuuuaacauuguguuacccagaauccccacaaauuauuguuuggccuuaacccgcaacucgaauuugccauuaaacuauaaaaagguuuguauggauuuuuaaaccuaguggauuuuaugacuauuauaucaugaacuauugauuguacauaauaagaauaaaauuaguaagaaauaaggggguuacuguaaagaccccuagauauaaggaacaaaaaaucuuccuaaauuuucuguaaagcaaaauuucacauagcaaaaccaauuuucucuuggcucccauuauaaaacuagagguuuauuucuaggcugggugcgguggcucacgccuguaauccuagcacuuugagaggccuaggcggguggauuaccugaggucaggaguuugaaaccaggcugggcaacauggugaaacccugucucuacuaaaaauacaaaaauuagccgggcauguuggugcaugccuguaauuccagcuacucgggaggcugagacaguagaguuacuugaacccaggaggcagagguugcagugagcgagauugcaucacugcacuccagccugggugacagagaugagacaccaucucaaaaaaaaaagaaaaaaaaaaaaaacuagagguuuauuucuauagggggaaaaaugaucuuaaauuauaagcuuagcccacuaaagaacuuucuuccagcauaacuuauggaaacauuucugucugcuaccaauagcugcccuacccaacgcaacacaugaucauugugcaucccaacuacuuagcagcuuuccuuggcuccaaaguuuguuauuuuuguaacugcuaccguuaccugcaccuccccgcuaaacccccaaaaaauaaaagaagagaaagugaucaggaaggaggaaaaacauauguagccaaaggggaggcauagucuagugaguacaaugagguuacuucaggcagcccaccgcaucucaggcaaaaaucugugaaauaagcaauaauuagaguauugcuaagcuucuuaaggcagauucugaauaucgagucacuauauaacauuauauaacuucuuuacaugccuauaaaaaaauugagaugcuccccuaaguccauugaaugaagucagauauucuuaguaauuuucauaaccaauauuuguauaauuuuuaaaaauuauuaacaggguuuucacuacauugcuuucugugauuucaccugugaagcucacuauucaaaauaccaacagcuguugcaucagaucucaaagucaaaaaguaaauugagucuuccuccagaguuacuuacaaaaauaaaaguauaccagcagguuuaauuauuuucuaaagaaauucuguuuuucucuaauugaccaaaauaccagcuguuucauaaagaagcagagcugaccauauguaucugaaguucuaugaaagcuuucacaaaacuaaacgcucaaacuuauuuuuguuuuuuuuuuguuuguuuguuuuuguuuuguuuuguuuuguuuuguuuuugagauggagucucgcucuguugcccaggcuggagugcaguggcacaaucucggcucacugcaggcuccaucucccagguucacgccauucuccugccucagccuccugaguagcugggacaacaggcgccugccaccacgcccggcuaauuuuuuguauuuuuaguagaggugggguuucaccauguuagccaggauggucucaaucuccugaccucgugauccaccggccucagccucccagaguacugggauuacaggcgugaaccaccacacccagccacuuauuuuuguuuuaaauacauguauuuauuuuauguuaggcuuuuucccccuaauuauccuuaaucagaugaauuuuuuaauuuaagaaauuuuuggcugggcgugguggcuuacgccuguaaucccagcacuuugggagguugaggcgggcagaucacaaggucaagaguucgagaccagccuggccaauauggugaaacccugucucuacuaaaaauucaaaaauuagcugagcgugguggcgggugccuguagucccagcugcuugggaggcugaggcaggagaauugcuugaacccaagagguggagguugcagugagcugagaucgcgccauugcacuccagccugggugacagagcgagacuccgucuaaaaaaaaagaaagaaaauuuuuuuuaauuuugaaauuaagucugaauacuucaaaaagaucuuaaagaaacuugacccuuugaaaauuauuuaagaagaaaacuuuaugcuaugauuucucaauacguagaaagggaaauagaaguuaaauuuuguuauaaauuugcuuaugguccagaauuuuucauagaaauaugcuaauuugaggguguuuuuaaaaaucuuuuauuccagcugaaccuguaaaagauaugccuucaauuccugucuugaaugcugccaaaagaaaugucuuagauaguaguucugacuucccuucaagguaaacuccacaaugacuuuauuuucaccauuucuauucuauuuacuaauuaaauuacauaauauuauauuacauuaaauaagguuuuuaagaauuucaguuggauuuugaacuguuauaauuagcuuacccuauuaaagccuguuuuaacuuaaauauaaauugaaauauacacugaaaugaauguuuauguaccacacugaaaagaugggacaauauauucuaaguucccaauaaccaaccuaaaaccaaacuuuugaugcauaacuuguucauaauugagaacugucuaauagguaacucuuaggccuuggagggaaauuuugaaauucuauuaggacuuuuacauauuuuauuauuuuaaaaaucuuugaagguuuuuccugcuuuuuuuuuuucuuguuaggauagcuauugagagaucacaguguuacccacacaacggguggguuuggucucuuggcagaugacaguccaaagccacaaccaaggaggauuuaacaagacgaggauuuuauuacuugcagcaaguaaggaggacaccgggaauaauuccccaaagcagugccuccucaagcagaggugaaaauagggcuuuuaguaggcugguuaacuguaucauuguguguagagguggaguaaaggcaguaaaggcacagucaucagucaugcuucugcauacuggcauguauagaaaaugcggaauaagcuccuccuuggaugggauuuuuagugugguaaugguaauacauuuccgucucaggcaucucuacauccacccagcuuguguaguuuuuguuuuguaaugugggguugggcugcuuccuggaaauuucucaaacaauaaaaauuucaaggugcaacaguuacaagcagguaccuuuucacaguguguaccugaaaacccaaggacccuggguuacaacaauagaauauuuauuacaauauuaaaucuuuaauguuuuaguacauaguauuaggaacuaaacugaaagcaaaguaaaaauguccuaucauauuaauaccuagauaauccugacuucucacccagguauaugauagggacauuaguuuguuuaaaaauguauuucagcagcuccuauaagcagcuuuuuauuugaaucuauuagaaccuacaauuuauauugacuuuggacucccuaaucuaucugauuuuuuacguuaaaacuaaugucuuuuguggguuuuuggaaauucagacacauuaaaaauacauuucaaaaauuaugaguaaaacauucaaaguaauuucuguaugaauucuuggcuuaacacaaaaauaugaaauuuagcaggcauggugggucaauagugacauuuccuuccuugaagauuuagaaaacacucaguguucuaggucaucacucuugcucuauuaaaucuuuaaauuccacuuucaaaguggaggaaaguaaagcuuuccacucaaagauuagauuauuccauaauuauucuaggaaccuaaauggacagucucccacauuucugaaaaauguuuuaauucauguccucuggaaaacucaucucuuuucugucucucagacaucucagcagcucauuuuuccuauuuuucccagcagaaacucuuuuuauaaugcagauggaugucuacauucuuuuccuugaaaaguuauuguguagccauuauucuaggcuauucugaguuccuagucauccucucauuucuauaagucuccauaugguccauuguaguucuccaacacuguggaacuuuugagaaagaauugaaguauuuuuacccuuccugggaauaauguagccacaucucaaauguuagugaaccuaaauaaugauuuuaugagaaagaaaaaaacaaaggacgaagacagacaaagcaaaagauguuuucagcagcuacuccacacacuuggcuaccagcuguuggagauauacaaacagguccgugagcagagaggcugucaagguauuuuacuaggguuuauuauaccuauaguuuuuagagauuagauuugaccaaaguauuucaaauuggugaguuucauuuuacuuuuuuauauaucaguuuuuauguuuauaaaaaugaaaauaauucauaucucacaaagacauugagauguauaugaaaguacuucaaguuguuuggcuaaaagacauaaaauauauauagauacauacuguaaucacagccauucuuugguuuaaacaauauguuuccauauuuuuaaaauuuagguuguagaaugagaggugguaguguuguuucuaacuuaagacauucuaccuaaauuuauauuaaacagcuaaaauauaacauuuuaaauuuauuuuccauugcaguggggaaggagcuacauuuacacagucucaucaucauuugccuucuagguauucacguccccaggcucauucuucagccucagguaauauauuugaaaaagccuaggaaaauacucuuuuaaguagguuaccugggaaaugauugacaguaaauauaaauaaacaaauauccaggguuuuuuuguguguguguguguguguuuuuuuguuuguuuguuuguuuucugaaaaauggcuauuauaacacacuaaaagcauggucaguuucacugugguugcuuuucuugauaaaauuaucucuaauucuccuuauguaccuauuuaauuuguauugcuauuaaugaauccucaaauacaugaaaucuccuaaguugcuauaaguuaauuuuuuuacaugauuucaauggcuuuuucuuuuuugcauuugaaggaggaauuagaaggucuucaucuaugucuuauguugauggcuucauagggacauggcccaaagagaaaagguaaacaaagagaauuacuuuuaguguauucagauuauuaagaaaugcaaauugcaucugugucucucuuuuauugauaaccaaauugcuaaaacuuuuaauuaguuccuaaauuugaaaaaggcaguauaggcagaugauagagauguaaaagaggcuaacuuuaaaaaguagcuagauagcccuccccuuaccuugaagacaguaugauuaugagaacuggggaaagaaaggaaauguaauuucaaauaauucuuguuaaaugauacuaaaaaucauuucuaggauuuuuaaaggauuuuucucuuuaacuuuuuuuuagaucaucagugcauggcguaucauuugauauuucuuuugauaaagaagauaguguacagagauccacuccaaaccgaggaaucacucguucuauuaguaaugaaggacuuacucugaacaacagucauguaucuaaacacauuaggaaaaauuuguccuucaagccaauaaauggagaagaggaagcagagagcauugaagaagaacuuaauauagauucucacagugaccucaaaucuugugugccccuuaacacaaaugaacuaaauucuaaugagaauauucauuacaagcuuccaaauggagcuuuacaaaauagaauacuucuugacgaguuuggcaaucagaucgagacaccaagcauugaagaagcauuacaaauaauucaugauacugaaaaaucuccucauacaccucagccagaccaaauugcuaauggcuucuuucuucauagucaagaaaugaguaucuuaaauucaaauaucaaguuaaaucaaucuaguccugauaauguaacugauacgaaaggugccuugagucccauaacugacaauacugaaguagacacuggaauucacguuccuucagaagauauuccugaaacuauggacgaagauucuucguugagagauuauacuguaagcuuggacucugacauggaugaugcaucuaaauuucuucaggauuaugauauucgaacuggcaacaccagggaagcuuugaguccuuguccaaguacuguaaguaccaagucucagccaggcagcagugcuucuucuaguucuggaguuaaaaugaccagcuuugcugaacaaaaauucaggaaacugaaucauaccgauggaaaaaguaguggaagcaguucucaaaaaacuacaccagaaggcucugaacuuaauauuccucaugugguugcuugggcacaaauuccagaagaaacagggcuuccacagggacgggacacuacccagcuguuggccucugaaauggugcaucuuaggaugaaacuagaagaaaagaggcgugcuauagaagcccagaaaaagaaaauggaagcugcuuuuaccaaacagagacagaaaaugggaaggacagcauuccuuacuguagugaaaaagaaaggggaugggauaucuccucuacgagaggaagcggcgggugcagaagaugagaaaguauauacugaucgagcaaaagaaaaggaaucacaaaaaacugauggacaaaggagcaagucacuggcagauauaaaagagagcauggagaauccucaagccaaauggcuaaagucuccaacuacaccuauugauccugagaagcaguggaaccuggcaagccccucagaagaaacuuuaaaugaaggagagauuuuagaauauaccaaauccauugaaaaguuaaauucaucccugcauuuucuacaacaagaaaugcaacgcuugucacuucagcaggagauguuaaugcagaugagagagcaacaaucuugggugauuucaccuccacaacccucuccacagaaacagauucgagauuuuaagccuucuaagcaggcaggccugucaucagccauugcaccauucuccucagacuccccucguccuacucacccaucuccacagucuucuaacaggaaaagugcaucuuuuucuguuaaaagucaaaggacuccuaggccaaaugaguuaaaaauaacaccuuugaaucgaaccuugacaccuccucggucuguggauagccuuccucgguuaaggagguuuucaccaagucaaguuccuauucaaacuaggucauuuguauguuuuggggaugauggagaaccucaguuaaaggaauccaaaccuaaagaggaaguuaaaaaggaggaauuggaauccaaagggacuuuggaacagcguggacauaauccagaagaaaaggaaaucaaaccuuuugagucaacagucucugaaguccuaucacugccugucacagagacuguaugucugacaccaaaugaggaccaauugaaucaacccacagaacccccuccuaaacccguuuucccacccacugcuccaaaaaauguuaaucugauugaaguuucccucucagauuugaaacccccugaaaaggcugauguaccuguugaaaaauaugauggagaaagugauaaagaacaauuugaugaugaccagaaaguaugcuguggauucuuuuuuaagguguaguauuaaucugcauaguuuugggcaucuucauuagaugagugugguuguguuggauauuuuuuuuuucaguugacaugcuugcuucuuucaguagcagucccuuuugauacaaguucauccccauuaacuauaguaacauucaagcacacugugguuuccaguauggacucaaagcuguaauaaauccuuuuaucacauguuuagauguauuccuugguuuugcuccucuacugcucuuucucacucacaaaagccuuuuaaaaauuaagcuacucagaucucuucagagaaugauuccauuuugucucuuaaucauguaacacugccauuuuuuuuaacagaaugcuacuguagacacuaauagauauuaaaauuuacugccuagagacucuguuccuugcagaggaagggaaacaaaggggaagaaaaucauuaguauaaaacaggcaguaccucuguugcuucauuucuauuccauuuauuuacacaucuucaccaccccauuacucaucuguuggacuaugguuacagcuucuugacugggcugucugucuccaaucaugccauuccagucuucauacugcuacuaaaggugauaguuccaagagcauagcuccaauugagucucuuucuagucaaaaaucuugccuguugaauaaaguucaaacccuuuagcacaacauucagggacuuucacagaugaaccuaaaucuuuuugucuagcuucuuccccauaauuuuauuuuguauuguucuuuaagauuaacuucaagcuucaucuaaagccuuuuauaauuccuucagucgaggucaaauguuucaucauuuguguaucuauuguauccuuaaauauacucauaccuguccugugucccggaguuuucaacuguuuuguaugauuugcuuugucucuuagaccaugaccuccuagaggugcugcaucuuuuuauuuuuauuuauuuauuuauuuauuuuuugagacagagcuucgcucuuguugcccaggcuggaguacaauggcgcaaucucggcuuaccacaaccuccgccuccuggguucaggcgauucuccugccacagccucccuaguagcugguauuacaggcaugcaccacaaaauaaauuuuguauuuuuaguagagaugggguuucuccacguuggucaggcuggucucgaacucccaaccucaggugaucuacccgccucagccucccaaagugcugggauuacaggcaugagcccccgugcccagccaagguacugcaucuuuuuauccccauagcauaauaaagugucuggcaaacuacaauauauguaauuugauagaugaagacauaugaauguuugaacuaauugcuugaaugguaucuucugacuuucuccauucagaguuaaaucucucucuggguuuccauacaaagccuguuguuuguaccucuucuccuugugauuuuuuaggcuccuugaccugagguaccauauauuuuaauauauguaauaucugacacuauguugugaguauguuagacaccaaagaaauguuuauugaauuaagcauuggcagggacaguugacaaggagacauuaagacagugaaccacuucuacaacagcuuguuacuuugcugaauucugaagcauuuuggaagcccgcugagaacuagggcugucccuaaggauucagguagaaacuagggcaggcccaggaggccuauagauaaugaacuagcucucaaauuaaaaguacuguagaagggaaguauaaucauccccaucuuuucuucaauggaaaaauguucauuauaguucagaaccuaucaagcagacugucaguaccucaacuuaaaaucaugcagcaauaguuucauuuaugugcuacaacauuggguggcuaauuuugggauguuuuuacuugagguauuuuuacugagcuuauauuuuaaauaaaauuuaaaugcaauuuuaaaaauuggugggggaacuaccuacuguaaguuauuaaauuaggguuaaaaaaaauuugugcuuuuuuguuuuguuuuuaugguuguucuuugcaaaucucauagguuuugacagaguguaauuaaauaaguuugccuguccucuuuuuugauggaacuguuaccacuguaguuccguucuuccuucauaauuucucaaccacacccacauucagaaggguuguaauaguucaaacuuucaguuauaggacuaaccacaaaaugugacuacaacaauugaaaaugagaauauugguaccuaaaauguuugaucguuuucaaugaaauucguucuuaggaugaucaaaaagcagaaaaugauauggcaaugaaacgggcagcuuuguuggagaaaagauuaagaagggaaaaggaaacucagcuccggaaacaacaguuggaagcagaaauggagcauaagaaggaggaaacaagguaaaggaaauugcuggcccagugcuagaucugaacuuuaaugaugcaugggcauauuuagaaaaaguugguaaguacucaaagagguggucucucauuaauuuuuauuaacagauuucuuucagagaaguuuguaguauagauagacagcuggaucaaugcuauuuuuuggugcuuuguagaaaucaauuuauuuucccaaaguauugccuaauuuuauauuuuuaucuuaaguuuaaggcaucucaugggaaaguucucuagaaacauuaauuuaaauaauuauauguuuaaaaaacauuaaaauaacuuuccugggagauacacacacacacacacacacacacacacacgaccuaaauuaucucaaauaccuuuauuuuuauuuauuuauuugacucuuccuucccuccuuuauuuacuuauuuaugcuuaaucccaugucucagcagaaucgucaaguaccuuuuaaaugaaccauuuauucaccaaggugaugaaauagaauucuccuuucucauaucaaauacauaacucucuccuguaugguuugucuuugguaugcagaauaagaacuguaaccauuugauuucuuaggcguaaaacugaggaagaacgucagaagaaagaagaugagagagcacgcagagaauuuauuaggcaagaauauaugaggcggaaacaacugaaacuaauggaagauauggauacaguaauuaaaccccguccucaaguaguaaaacaaaaaaaacagcgaccaaaaucuauucacagagaucauauugaaucccccaaaacaccaauaaaggguccuccagguaacauagcuuauuaugaagagucuguucauaaaaaacaccagcuugauugguuugucauacuaacuugguuguacuuugaugugcaaaauuggauacacaguuugagauugugcaugcucccuuuuggaaaaccaaaaugagcaaaugaaguuuuuaauaaauuaaauguauuaugugugcaugcauauauucaguagaacaaaugugaaugcuaaaaaucaaaucuaaauauuaaucuauuagggaacugugcccucagauauaaucuccuugaacuauuaacugcccuuuacauacuuauaaauuuaaauaaauguuauaugcaugaaauguacaagaaacauguugguauaauaaggaaugcaagaucaagaguucacaagucccuccuucaagauagaaaugguugaaaauccaaacuuauaauaucuggaguugagagaauauauuuucuuuaaaagucaguauacauacucauuauuacuauuauuauuuuuugaaacggggucucagucuguugcccaggcuagagugcaguggugugaucauggcucacugcagccuccaccucccuggguucaggugauccucccaccucagccuccuggguaguugggacuacaggugagugccaccauacccagcuaacuuuuuuguauuuuuuguacagaugggguuucuucauguuguucaggcuggucucgaacucuugggcucaaguaaucugccugccuuggccucccaaaguguuaggauuacaggugugagucacugcgccuggccauacucuuauuuuuaaaaaaaucuuggggggcagggauaaauucguaaaaauaaaagaaaucuuuauuaaaaccaaaugccauggaaauuuuuuagagaauucucauaguuauacuaaaccugaggaaaaauaacauaauauugacuguuuaaagagaacucuguuuucaagccuguaaaacuaauugauauaauuuucuaccuagaauuuagauauuaugaaauuuuuuuuuguuauuguuuuuuucuuuaggaucacaguaucacgucucauauuaacacuuuccuuuuggaacgcaaguuaguuuuaucauuguuuccuaaaaguagguuccuugcuaauuuuaaauaaauuguguauauaugcaugcaagcauauuauguguuuaaaaguacagagaaaaggaaaagaaacuacagaagcucaauuuuuauaugcugguguuaucuaaugaacagacucuuugcuaguugcuccuuuuaaauuucugauuuuguuuuuauucaggaucaugaauuuaucguguuuuuucagucucuagccuuucuuuggcaucgcugaacacgggugauaacgagaguguacauucaggcaagaggacgccaagguaaaucuauaacguaugaauauuuuuacagaaaagaauauaguaccugcaauuauacaaacucuaaguaaaaauucuucaguguuuuuacauuuuauaaugaccaaaucauaaucacaaauuuuacuaaguuuugcugacuuaggacuguuagaguuucuguuaaaauaaauuauguaaagaggugucuauucaucuuucagugcuugucuuuuagaauuuagaauuauugacauugauaacauacuuuuuauaagcuaugaaacauuaacaguaauuauacaucaguaauugcuaacaugauuauuaaaucacagucaguagaaugagaguaccaacuucucuagucuauuaccaacuaagacaaaggaguuuuccccauuagaauaauuccaaaguggguugccuaugacuuaggaaggaucucuuuuguauuuucuuucucuaggauucuuucucuagauuagaagcuaaaagucaguauuuuauuacuuuauacuauaauaucauaucagaaaagaacauuucuagugacagucaucaucuuagaguucuuaucuuuguauuaccauccuuuguguuauuugccaguuuucacauugaaaaacauucacucuuucaacagauauuuauagaaugcuuacuauguucuaggaacuuggauguguagcugcgaauaagacaaacaauguuauauuauuuuuuauuauuaauuuuuuuuuuuugagacggagucuuucuccauugcccaggcuagagugcagugacacgaucucggcucacugcaaccccugccuccuggcuucaagugauucuucugccucagccuccugaguagcugggauuacaggcgcguaccaccaugcccagcuaauuuuuguauuuuugguagagacgggcuuucaccauauuggccaggcugaucucgaacuucugaccuugugaucuaccugccucggccucccaaagugcugggauuacaggcaugagccaccgcgcccggccuuaucauauuauuuuuaggccuuuagguugauuuugauuguuacuuucacguauacccucugggccccauuuuuucucuguuugagacauaaaacauauuuuauuuucuaauuagaucagagucuguagaaggcuucuuaucuccaagucguuguggcagucgaaauggagaaaaagacugggagaaugcaucaacaacuucuucaguggcuucuggaacagaauauacagguuagugucuauacauuuuuagagaaacauuugaauuuaacacacucauaaauggaggguguacuaaagaaaauuuuauuggcucaccuuugggucuuaaacauaggcaacuaauaaacagugaaugcagguggucacuuucagguaguucaguaaguuucuaaacaaaauuagugaugcuacuuauaucucaucccucuaaccaaugcuggccauuucuguguguaguuuggguccgaagaaguuuuagagaaguucuacauaguuccucaguacugaguaaaggcuagaauccaccaaguccucucccuaauacugggauuccagguauccagaauugugcaccuuuagcaaguauuaagaggcucuaaaagauaagaaugcauugaaucuaggaagguaucuagccucacauaucgccaccaaguccucuucuagcuucuagguaggcaugauuggaauaaaagcaaugaagaauagaauguggguuaaggacacuucuaaauaaaugaagcaggagagaaaucagaagaaaugucagcagcacguugagagguaagauaggaaggcaugggagaacauguauggggaagagcagagggaaaaggagaugccuccaucuauccaugauagaguggaaguggaaacccuagaaaggccuaaggagguuagaacuugcuagagacccacucuguggcuuuuaauacuaccuccuaccgccagucugacagccuuuaaggccugggauuugacaguauuuccauguuacucacucugcuucucuauguuaguucaguugaacaaucugaaaaagaaagcuuuuuuuugccuuuugaaaagacuuaaauuacucauggacccauucuacucuaagcuaaccaguaaccguauagauuuaagaaagaagguuaaauaggcaguaugacaguuauagcaauauuuuauuuuuaguacugcucucacaggguacuccaaaaggccauaggaacauccuccauaucucuggguggauaaaacaauguuuugguuggauugcagccaguaagaggccuuuaagcacagaauuuggucuucuauuacaauauuucagcaguguaggaacaauuacaucauuuuaaaauaguaguauuucugacuuaggaauguuauuuuuauuauuguuguuaaaucccuaccauaggaccaaagcucuacaaagaacccagugcaaaauccaauaagcacauaauacaaaaugcuuuagcucauugcuguuuggcuggaaaaguaaaugaaggucagaagaaaaaaauacuggagguaagcauguuugcaugaaaauuaaauuuggcaaacuguagaagucuuuuauccauucaagagaauguacucucaugggccuagacuuucaacagcauguaaaaagaucuguagcuagauguuuuaauuaucagauuuaguuuauuuucacauuagguucuggaagccugcagauuuuauuaaagacuagcaauaggcuuuaagauuugucauugaaauaauguuauaaaaugugacuaagaaacguaacauaauuauauaaacuuuauucagcaaaauaaaggguuuuuauucguguuguuauguuguuuuuguuuuuuauuuuaaaggaaauggagaaaucagaugccaacaacuucuuaaucuuguuccgggauucaggaugccaguucagaucuuuauacacuuauugcccagaaacugaagaaaucaauaaacugacugggauaggcccuaaaucuaucacuaaaaaaaugauugaaggacuuuacaaauauaauucugacaggaaacaguuuagccacauacccgcuaaaacuuuaucugccaguguugaugcaauuaccauucauagccauuuauggcagaccaaaagaccaguaacacccaaaaaacuuuuacccacuaaggcauagaaguugggaaauacuugcuucagaacauucaugguaaauuugcacuucaucuuuccugccuauagaaaaucuuucuaauugccaacaagacuuuuauuaauuaaaacuggacauuaagcucuguugucaugaacaacuggaauguaaaccacaguauuuuggagugcagaacauucucaauuaagugauaaguccaaaugaugaaggaaauguuuuaauucacaaauggagauuuguauguguuaucagguucaccugcuugauauuagauacauuaaagcacugaauuuucauggauauuaguuggauuuaucauugaaauaugguuaagauuacaaauuauguguuuuauuuguugcuuuuuuuuaaccuuuuaauguauauucuugucuucagaugguuugcuauuuuucucuccuggggguuuauucuaagauaccuuuguauuuuauuucauguggagaucaugaaaguaggaaauauaccuuuagaaguaacucgcaccuuucuuaugauguuaagagaaacacuaguguuuaguuuuacaguaacccucauauuuuaaugguguuacagcauuugcaaaaauuauucugcuaaguauuuacaacucuauuuauuauucacucaaguauuaacauucucuauuaaauaagaggagguguuguaaagagcugcuaguagguucgcuuuaaaccacaugagcuuaaccaagaauauguuaugagaaguugcugauuaaaucagugcuguuuuuacaccacuucuggccaacucagaauaauuuagauuguucuuuuaacaaaaaaggcuuucuaucucuuuuaaaguaagucacuuuauaaguuggcagaagugaaugacacuuugagaguagucuuucaaucugaagauguaagacuuccugaaacaaguucucaagaagucuuuacauuauauuuauaacucauauaaaaauuauauuuagaauuuuuaaacauguacaaagggcuacauuuuaauuuuaaaauagcuucacauuauuuuacuuauauuggguuuuucuucauuuuaauccuuuucaaguggaauggcuuagaauaaguauacacuugaaaucuccucuacaugaucuuuguucuuuaacaguguauaccagaggguuaguuggggaaaaacuucauucucaggaaaagacuugaaugauuaugugacccuguuauauuucaguguugugacaaauguguaaacuagcgggggaagacaguauuguaucauaaaugagaugcguaguuuguuuucuuucaugggaaguagagauaaaaauauauacauuucucuaauugaguuguuuagagaaagaacuaaugucucauaugauguauuuacuuauuuuaaaaaaaagaauaggaaugagaugucccugagcuguacuuuucuauuauuauaaggccuuuaggcaucagugcaucuggguuaucaacauuuucucaaaugcugucaauauuuuacuguaauuuauguucuuauauuuauguauauuuguuaaaacuguaaaaaaauuucacagauuuuuuuccaauaccugugcaagauacauguguagcucaaaacuauuugugaucuacuguuugcauguaagagaccaggauauguaacucuuauauuuuaaguguauacauauuguguauauaacauauggauauuaaaaauggggaauugcacauuuuaccuuuuggacaguaauuucuaucacaguuagaaggaaaugauagucaaauacacguuuagauuaaaacuaguuuaaaaaauuauaaaugaaucuaaucaaaaugugaauaguagucaaaaggauaauuuaauaagcauuuuacguuacuaaauuuguucauuucaauauuaacuaaauuucccucaucaaagcaaucuuugugauauuacuucgcuauuaaauaaagaaaauuggaugcaagacaauggagaaacuuuaaaacuaaacaggaccacccuuuauucuuaaauuuguguguguccaacaguugaauugaaugucuauaaggucuaaagguagaaugugaauauugccacagaguucauugcucucaguauaagauuuuacuuuauuaaugcagaaggaauauggauauauuucuuuaagucugcagauuuuuuuauuauggugcagcuuuuuuuuaauuauguuuuuaaaauuauacaguugaaaaauaugccauuucauaaagucugaggauuuucgucaaccuuacugaaacacacuggugcuuucaucaucagaggucaaauuauuaugauaacuauuccauuaaguuugccaaacauuugucgugguuaccagugcagccugucaaauucugcuauuugacacagcuuuggaaagauuuaguucuugguuuuuccguuuuguauuagaaugacuguuacaguuuuauuuggcuguuuaaagccaaauucagcuauuuaauuaugguuucauggacacuguugagcaauguacaguguauggugugcuuaccuguccacucuagagcauugcuuacagguuuuuuguuuuuuaagaugcugugcuguaaaauacugucauacuugcuauuuccugguacaguguaguuuuuccccuuucauuugaauaaaagcauggcaccaa

SEQ ID NO: 191148 - RNA, 53554 nt, Homo sapiens
cccuguccugagcccaggcgcuucgcccugucccaccuagcucugagcagcgccccccagcacccugaaugcguccgcaggaccccgcgcucuacccgcaggccccgcacccccuagcucugggccgcgccucacaucccucccagagccgcaacaccccacccggcgggacgcccucgagcagccgcucguugcgggccugaagcgcagagcgccuauuggccagagcggccgagggcgggaaaaguggccaacggcugccucggcccucgggcugcugaggagauggcgucgggcuccaaggccucggugcccgcggacucauuccgcaccaucagcccggacaggcgaggcgagaaguccgccuccgcugucuccggggacacggcggccgcgaccacccugaagggcaccgcgaucccagugcggucggugguggccuccccucgcccggugaaggggaaagcgggccgggagacggccaggcugcggcuccagcgccugcccgcggcucaggccgaggacacgggagaggcggcggcggcggcggcggaggagccccugcugccagugccugaggaugaagaggaggcgcagccccugcccccagucugcgugucccguaugagggggauguggcgggacgagaaggugucgcuguauugcgacgaagugcugcaggacuguaaggugagcggauccgggacaggaagacuacggucggaagcucgucggaaccuggggacaggcaucuggggcuucccucuuaggcggauggggauccacagggcacaacgaaaacuugcguuucaaaaaaguaaauggagucaacauguauagagcguucaccuuguuagaggugcccgcguccugcccuagaggaguuaagguucgaguuuccgacaaaauucgucagguaacgggacagcccugagagagaauuuucugagagcuccuaaaaaaugaagauauauuggccuuaucauugcacaggcaugaaucuugguaccuuuauuuaacaguuuauguccaaacaugaguaagaucacuuagccuugacuuuuacacuagaaugcuagaaauuacuuuaaggguacuucccacucagcaguccacaaugcggcaugauauauauguguguguauauauauauauaaauguguguguguguguguguguguguauauauauauauauauauauauauauauauauauauauauauauuuuuuuuuuuuuuuuuuuuuuuuuuuuuuuuuuuuggagacggaguuucauucuuguugcccaugccggaaugcaguggggcaaucucggcucacacaaccuccgccucccggugcaagcaauucuccugccucagccucccgaguagcugggauuacaggcaugagccaccacgccuggcuaauuuuguauuuuuuuuuaguacagaugggguuucuccaguuggucaggcuggacucgaacucccgaccucagguaaucugcccgcuucggccucccaaaguguugggauuacaggcaugagccaccgugccugguggcaugacuuucuuuuauagaaaauacauaucugauaaaacggaauagagcaaauauuucauguuucuaaccuauuuuuuuaaguuguagcagaagaauuuguguaccugcauauucacugcagugauauuuauaaaaaguugaaaauuaagacauaaacaauaacuagcugucuuaucuaugaauuauucgagugaauagaucucuuuuaaguuuaauuuuuuguuggugauguuuuccacuagaugcgguuucaguuaaaaucuguaauuuuccaggucauucauuauuuaaggcuauauugguuccauuuuaaaauagaaaucaguaaaaaaaaaaaaaaccacuuaguuuaaaaucuauaauuucauauauuuauauguagauccauuuuuucucuuguuaggcagaagaugcugaugaaguuauggguaaauaccuaucagaaaaauuaaaguugaaagacaaauggcuuggagucuggaagacuaaucccaguguauucuuugugaaauaugaagaagcuucuaucccuuuuguugguauauugguugagguaaauaaauuuuauuugaucuuuguucuuuuugaaucaguucuuuuaaagacuaaaauaugacuuuauuauuuggagauugauacacaagaguugacacauuuuuacuucuguuuuaaguuuccgagaaaauuaauaguguaaaaagaagguuaggggaauauuagugccuguaaaccauuaucauuaaauggaaucuaguaguaucagacaauauuuauuagccuaguuuuugcucaacuaauguaaaaauaacaaaaaugcauuucuuauaaaauuagugauucagucuuuaacaaacuugggccuucuuuuucugucuuuucccuuuaaucuucauuuaucugaauuaagaaguuuaguucagaugaggaaaaaaaaagaaauggaucagaaaacuacugggaaaauuugaaauuuuuuuccuuugaaaaguacccuuuuuagggaggcugaggcaggagaauggugugaacccaggaggcggagcuugcagugagcugagaucaugccacugcacuccagccugggcaacagagugagacuccgucucaaaaaaaaaaaguacccuucuaguauaauaucuuccaagccuuuaucugauaagauuuuucuuuuuuuuuucuuuugaaacagaguuucguccugucgcccaggcuggagugcaguggugugaucucggcuacugcaaccucugccuccccgguucaagcgauucuccugccccagccucccgaguagcugggauuacaggcgcaugccaccaugcccagcuaauuuuuuguaucuuugguagagacgggguuuaacccuguuggccaggcuggucuugaacuccuaaccuugugaucuuuagcagagaagggguuucaccauguuggccagacuggucucgaacuccuggccucgugaucugccugacucagccucccaaagugcugggauuacaggcaugagucacugcacccggcccuaauaagauuuuucuuuguuaggccuguaggcuaaacauuguggcauguuugauucuguuaaaggucaauuauccuuauauagaaauuaauauuuauaaccacaaaugauacccuuaccccagauaguuaguuuaaaucuguauuuuuggauacaagaaaaacuuauguauguaacuuguuguauuauauacuacuugaaaacaauuuaaaaauauguguucuguggaaaagucagugucaguuuuacagauaaagaauggcggcugggcgugguggcucacgccuguagucccaacacuuugggaggccaagguaggugaaucacuugagcucaggaguuagagaccagccugagcaccauggugaaaccccaucucuaccagaaaaacaggcacacaccuguggucccagcuacucaggaggcugaggugggaggaucgcuugagccugggaggcagagguugcagugagccugggugacauagugaggccccaucucaaaaaaaaaaaaaaaaagaauaccauauuuucagucacagagauuacaaaggaauguaaaagauuauugggauuaguuaauuuuucaauaagacucuauuaguuaauauuucaguaauacuguuucuuuuccuuuuucuuuuuuuuucaagauaaggucuaacucuguugcccaggcuggagugcaguggugcaaucucagcucacugcaaccucuuccucuagguuucaagcaguccucccaccucagccuccugaguagcugugacugcaggcguguaccaccacacccggcuaauuuuuguguuuuuaguaaaaacgggauuucacuauguuggccaggcuggucucgaacccccgaccucaagugauccacccaccucagucucccaaagugcugggauuacaggcagagccaccaugcccagccaguaguacucuguuuuguagagguuugcucaucuucagacuuugaguagcuuugccgagaucuuucacaacuucucuggauuuuuuucaucuggauaaaaaugguuuucaucuggcuuuaugacuuuuuuuuuuuuaguauaaguuuguggguuuuuuuucaaucagguuuuauguggaagcuuaacauuaaagcagaacauuucugauugaaauggaugauggugucuuagcagcucucuccauaccucaugauagccccuauacuccauaaaacuuuucaagaucucuaaaguuccauggaaacucaguggauuagguaaccuuaaaguucuaucaauuucuaagguuuuaccugcaauacauugauuauuuaaucugucccugccuugcuuuagaauuugugagggucuaguaauguccucuaaauguuagaaagacaggaugaagcauaagaacagaggaaaaagcaaaacaguauauuggcagauucuaauucuuuuguggcagaaaaacaagugagaauggcucuugggaccucuuaagauagugcugcacaauucauauuguuguuuuaucugacucugcuucuuuagucuuacuucaguugaaguauuaauaaugcuauauaauacucuuuguucugaugucacaauaauuuauuccuaugggccccugaucgcuuuuucuuuagaugcuguauuaguuuucuauugcugccacaacaaauuaccacacucaguggcucaaagaauacaaauuuauuaucuuacaacucuguaggucagaagucugacaugggccuaacugagcuaaaaucaagguguaugcaaggcugcauaccuuuauggaggcugugugggagaaucuguuuccuggccuuuuuuaaccucuagaagcagccugcauucuguggcuuguggcccucuuccuucaucuucaaugugcuucucacacugcaucuuucugcuucacugcaggcuaaaaaggcaguccccuuuuaauagacucgugauuagaaugggcccaacuggguaauccaagaugaccuccacaucucaaugucuuuaguuguaaucacaucugugaaguccauuuugccauguaagguaacauauucacagauuaggauuagggaauggacgucuuugggggccauuauuaugccuaucaugaauucauacaauaaccaaccaacaaacaaaaaacuuagaaacauaguguugacuccugaacagugcagggcccugcacagucaaaaauccguguauaacuuuugacuucccaaauacuuaacuaauagccuacuguugacuggaagccuugcugauaucguauacaguugauuaacauauuuuguaugucauaaauaugauaaacacuauauucuuacaauaaaguaagcuagagaaaagaaaauguuauuaagaaaauuguaaaggcagggcacagaggucugugcuuguaguccuagcauuuugggagcccaaggcaggaggaucgcuuaaagucagaacuuugagacuaaccugggcaacauagcaagaccucaucucuacugaaaauuuuaaaaugaacugggugguggugcacaccuauaguccucucuacaugggaggcugaggugagaggaucacuugagcccagaaauuugagagcaagacccugucucauaaaagaaaaaucauaaggaagagaaaaauauauuuacuauucauuauauagaaauagaucaucauaaagaucuucauuucuguugucuucaugcuuaauaggcugaggagaaggaggaagaggaagaagaggaguugguccugcugucacuaggguagcagaggcagaagaaaauacgcauauaaguggacccauccaguuggaacauguguuguucaagggucaacuguauuugaugggaaggaaaucuagcauauccuuaauuuugguuauaaaaugguccagaaauuaagaaaacuuuuuuauaacuucuguacaaagcaguuuagcaaaauauaucaagaacuuuaaacuagcacuuuauuucuggaaaugucuucuaugaaaaucggaaauguggaaaaacauugcuucuuggccuuuugccuaagauccaaguguagaaaugcagaaaaagauuuagguguuaaggugaucauugugauuuuuuuuuuuuuuuuuuuuuugagacagagucucacucugucacccaggcuggaguaccauggcgcgaucucggcucacugcaaucuccagcucccagguucaagugauuuuccugccucagccuccugaguagcugggauuauaggcgcgagccaccaugcccggcuaauuuuuguauuuuuaguagagacgagguuucaccauguugccgaggcuggucucgaacucuugaccucaggugauccaccugccucagccucccaaagugcugagauuacaggcguaagccaccgugcccagccaccugggcuuuucuuugcaccauauauucuagaugggguacuagaagagcuaacaaccuggaaacaucaacguguaaaacagcaacaacaaaaagcagaaugaagacaggacaauuauugugcuugaagauagaaaaauagaaauuaucaaauccuaacaccauaaagaaaauagacuuaaaaggacagaaccucaggaacauguuggacuauaacaaaagaccuagcauucaugucuucagaguuccagaaggagagaagaaagagagagggcuaaaaaauauucaaagaauggcagaaaauuuaccaaauuuggcaaaagauauaaaccuacaaauuuaagaagccaaauugaggagcaugguuaagggugggaguacucccauugggaagaagggaauuacaugaaaauuugcugguacugaauguugggauccucuaucuucuaccuuccaacucugcuucuagaacacaggcagcuaaggcauaucacuccaggaaugagauuugaaauauuuuuguaugaucauaugcuaaaaaaaaaaaaagacuuaaugauacugauuuaccacagaaagagccuggguggaucaaccagugaagaggagaugaggaggagaagaaaggaagagagaagagagaugggggaagagguugguggcaagaacagaagaaagcaaauugucaaauuguaaagguuucucagaaccaaaggucauaaauuucuagacugaaagggcccacuuaguguccaacacauaaugaaauuugggaauacugggaccaaagagaagguccaauaagauuccagagaggaaaaagauagguuuauauaaagaaucaagagguagaauggcaucagacaucagaccuuuccuuuuuuuuuuuuuuuuuuaagacggagucuugcucuguugcccaggcuggagugcaguggugcagucuuggcucacugcaaccuccacuucccaggcucaagcaauucucaugccucagccucccgaguagcugagacugcaggcaugcgccaccauacccagcuaauuuuuguauuuuuaguagagaugggguuucacuauguuuaccaggcuggucuggaacucccggccucaagacauccucccaccucggccucccaaagugcugggauuacagauguaagccaccacacccaauccagacuuuucaaaaguaauucuuaguuuuaaaaagcuaugaaaauguauuuucaaaaauuuuagggaaagugauaucccacuguauaauuuuauaccuaggcacacuauaagucaaguguagaaaaaauacauuuucaaauaugugaggucucaaaaguuauguccaaugcacccuuucuuaggaaguuaauggaugucaucuacagucaagggaguaaaucaagaaauacgaagacaucagauucaaaauguagagaagccacaaccuaagagaaaaacaaagggaauuccugggaugauggcaaagugauaacagcuauguacauagcaggccuagagaaccacuucagaauagaacuggucagagaacucuggaagagugcuuuaaauaaaaugaaaccaguauuuuauuucaaacacaaucuauuggcuuugaacauauugaaaggagauuuuuacaacuuaaggaauuuggggcuaaauuaaugaaagccacguagaaaaugagcaaauggcugggcgcaguggcucacgccuguaauaccagcacuuugggaggccaagacggacggauugccugaggucaggaguucaagaccagccuggcuaacauggugaaaccccaucucuacuaaaaauacaaaaaauagccggaugugguggcgcacgccuguagucccagauacgugggaggcugaggcaggagaauugcuugaacccgggaggcagaggaguugcagugagcccgagaucacaccacugcacucuagccugggugacaaagaaaggcuccgucucaaaaaaaaaaaaaaaaaaaaagaaagaaagaaaaaagaaaaugagcaaaugaaaagcaauacaauuauugacugcugggaaaacguuuuuugcaggaaugaaaaaucagcucacaccauauggcucaccugugaaucacauuuuucaaacauauuaagauaaaugcugaauacuuaagauauaaccauauuggugaaugaaaggccaggaaagagugguuguauauuaaggaaaugaggcaaaaugaaagagauaacuaaauucuuaucuuucagaguuggaagucaauauccaaugccaaaacuggaaacaaaacuuuaaguagcaauauaagcauauuauuuaaagauaaagauauaaaugucaaaaaauaaucagcuaaaagaguuaaaaaugguugccucugaggagcaagaauuagagggugauagaagaccaucaaggaauucuauuuuucuuucuuuuuuuuuuuuuugagacugaguaucaucuacggccauaccacucugaacacgccccaucuugucugaucucggaagcuaagcagggucgggccugguuagugcuuggaugggagauggagucucgcucugucacucaggcuggagugcaguagcaugaucucggcucacugcaaccucugccuccuggguuccagcgauucuccugcccuagccuuccacguagcugggacuauaggugcacgccaccaugccuggcuaauuuuguauuuuuaguagagacaggguuucagcacguuggccaggcuggucucaaacuccugaccucaggugaucugccugccucggccucccggccucuuuuauuuauuuauuuauuuauuuauuuauuuauuuugagaaguagucuugcucuguugcccaggcuggagugcaguggcgcgaucucggcucacugcaaccuccaccucccagguucaagcuauucuccugccucagccuccugaguagcuggcauuacaggcacgcaccaccacuccaggcuaauuuuuguauuuuuuaguagagaugggguuucaccacguuggccaggcuugucuugaacuccugacaucaggugauccacccgccucggcuuccccaagugcugggauuacaggcgugagccaccgcacccagccugaacucuauuuuucauaacaaaccugguacagcuauuugauucuaaacuauaugcauguauaauacugaaaaaaaucaaaacuaggccaggccaggugcaguggcucacgccuguaaucccaguacuuugggaggcugaggcggguggaucaucugaggucgagaguuugagaccagccuggccaauauggugaaacccuaucucuacuaaaaauacaauaauuagccaggcugugguggugcaugccuguaaucccagcuacuugggaggcugaggcuggagaaucgcuugaaccugggaggcagagguugcagugagcugagauugcaccgcugcacuccagcuggggcaacagagugagacccugucucaaaaaaaaaaacaaaaacaaacacaaacaaacaaaaaaaacuaggccaggcaugguggcucauuccuguaaucccagcgcuuugagaggcugaggcagcaggaucacuggaggccaggaguucaagaccagccuaggcaacauagugagacccugucuguaccaaaaaaaaaaaaaaaaaaaaaaaaaaucaagaaugguggcacagguaguccuagcuaauugggaggcugagcagggaggauuguuugagcccaggaguucgaggcugcagugagcuaugaucgugccacugcacuuuagccugggcaacagagugaaacccuguuucuuaaaaaaaagagagagaacuaaaauauuaaaauauaaagcucaguaucauauuucguaaugacucuuuggaaauauauuuuuguccugucacaaauauggauugcagaucauuuauuaucuucaaacacccaguuuuaaguuguuauucuauuuucuaaguuuucuucugucccauaacugcuuugaagaacauaauuuauauuaaauuaguuauaaacuuuguauuucaaaguuugguuagugauuugaagauauuuccuguauuuaagugauuauuguuuuaugugcugaugauauaacacuuacugauauuuaaaauauuuuuugugacauaacucuaccgaaaaauaaagaauuucauuggcuguacuugaaaauuuuuagaacagauuuuggaaguguuuguguuaauacuaauuuugugccaacauuuuaaaauuuguauuaauguguaauuuauuaaauuuuuaaaaaacuaucaacuuugguucugaagcacugauuuucagacaagugcagggaaguaucacuauacuauggugaaauaagaugaauaaacaauauagcauguuguucaugaagcuaaaucaacuuaagaauuuuacucuuggugggucucaguagcucgggcggcgggaggaguggcagcggccaggcagcccaguuucgcggaggcucucggcgcgccacggcccgcaggcacccggcacgcgcccugccugccgccaggauacccaagaggaaggucagcuccgccgaaggggccgccaaggaagagcccaacaggagaucggggcgguugucagcuaagccuccugcaacaguggaagcgaagccgaaaaaggcagcagcgaaggauaaaucuucagacaaaaaagugcaaacaaaagggaaaaggggagcaaagggaaaacaggccgaaguggcuaaccaagaaacuaaagauuuaccugcagaaaauggggaaacgaaaacugaggagaguccagccucugaugaagcaggagagaaagaagccaagucugauuaauaccauauaccaugucuuaucaguggucccugucucccuucuuguacaauccagaggaauauuuuuaucaacuauuuuguaaaugcaaguuuuuuaguagcucuagaaacauuuuuaagaaggagggaaucccaccucaucccauuuuuuaaguguaaaugcuuuuuuuuaagaggugaaaucauuugcugguuguuuauuuuuugguacaaccagaaaauagugugggauauugaauuaugggaggcuuugacugucucagguaucagcuuaacauuccauaggugggggguuaguuuuuauauccuauaauacaaagcauauuaaauggcaguauggagucaguacugcauuuaaugucuugaacauuuuaaauuacuuccauucccauguuuuuuagaagaauuguuuccuaaagaaaaccacucuuugaucauggcucucccugucagaauugugugcacucuguaacaucuuugguugugguaguccuguuuuccuaauaacuuuguuauugugcugugaaagguuacaaauuugaauauguaguguaggugcuauucaguugugaacuggugggcuguauguaacagcugaccaacaugugaagauacugguacuuuauagccucuuaaagaaaauuugcuuccaaauuuuaagcuggaaagucacuggaauaacuuuaaaaaagaauuacaauaaauggcuuuuuagauuuuuguuacauaugucaagaauuguguacaaauugaaaugucugaacugauccuuaaccaauaaaaucucaauuuugaaaaaaaaaagaauuuuacucuuuauguccuuucuccuuuuuuuuuuuuuuuuuuugguguuugaguagccauucuucuaccaaugguguaauacagauagcagggcuuuuuuuuuuuaacaugcuuuuguuuguuuuuguuuuuuuguuauuaucauugucauuuuuauuauuuugcuacuuuauucagugcuuacugugugcuagaugcccacuggaagcuuauaauuaugauuuauuauauuuaacaugcuuuuauggcaaaauuuguugaaaaauuuuucgauaauauuagcugggcacaguggcauguuccuguagucccagguccugaggaggcugagguaagaggauggcuugagcccaggaauucaaggauuagugugcaaugauuacaccugugaauagccacugcacacuagccugagcaaccacaguaagacccugccauaugugugugugucacacacacacacacuguuuuaugaaaucucaaagucuggcaacucaaucuuagaaacaaauaauguaggagauacagaauuccuuucaugaaacugaaaaaaaauguauuuaagaaguaggguuuguaaaacuauugguaguauauuuaauauugaucuauaauuauucuguauguugauuguugaagaagucauaaauuuaaaagaagaaacuuuauaaugagcucauauaugagaaagaaauccugcgguuuacugauauuuauaacuauaucucuuaucucuuaugauauuuaucuuagguaacuugugaaccauaccaagacucaucaucucguuucaaaguuacuguuucuguugcugagcccuuuucuuccaacauugcaaauauuccaagagauuugguugaugagauuuuggaggaacuggaacacagugugccucuuuuggaaguguauccuguugagggacaagauacugauauacauguuauugcuuuggccuuggaaguugucagguauuagggccuuuacuuuugaaaauuaaauuuauuauauccaaaaguuaaugugaagguuuuguucauauaaucgcuuuacaagcacuuacugauuuaauuuucacucacuacugcuggauuaaauuuguccauuuuaaauuaacauauuguauuuguaacuuuuaguaaaaacauuuccuugcagaaacauuauauauggguaaugaaaaguuugcaauuuuuugaucuugcauuuuauaaaaauaaaauuuaaaggaauucuugaaauaaguaacauuaacuucuauucauauuuaagcaucuuaaauuuauuaacauucauuucucaaauuuaaaggcauuacaaauacuagauaucaucauucacauuaugauugcuucuuauaaguugauacaauuugagggaagcuauccacaaacaaaauacagaauauuuuuuggcauguuuuuguuuuucuaauguuuuccucccauacaaauuugguaguaucuuacauauuauuuauuuuuugagcaaauaauagccaaaaucuauaaaauuuagaaacaauuuuacagucccacucauuaucucauucacuguaaccuaaaauagaaugcagaucaucuaauuuuugaaguuuuaccuuuuaguucacucaaaggucauuuuaaaauauuuugcuuaagaauuaagauugagguagagaauucugacaucagaauauccauuuagcucuaaaucaguaguggcuguuuuugauuacugucaucuuaauuugguuuaucguagguuuuuuuaugacuuucuuuggagagacugggaugaugaagaaaguugugagaauuauacugcacuuauugaagaaagaauuaauuuguaaguauaguuuauaaacuuauaccgcacauuagaaaaaauaaacauuguaauuauguugauaauuuucagguggugugauauacaggauggaacaauaccugguccuaucgcacaacguuuuaaaaaaacuuuggagaaauauaaaaacaaacgugucgagcucauugaguaucagagcaauauuaaagaagauccaucugcagcagaggcuguugaaugcuggaaaaaauacuaugagauagucaugcucuguggauuacugaaaaugugggaagauuuacgccuccgguaauaauuugcucuauuucaaauagaagcaaaaguuuacaugguuauuauuuuaucauagcacuuaauuugugguauauguucugauuaaagugaaguauaaaauuagaugucuaauuuaugagguaagcacaagguacaacuaucaguauuagaaaauuguauuagcugaauucacugaaaucauuguuuuuuuugaccaaaagaacucauuaauccauuucuuuccuuaucuuucauuuuaacucuuuugauuuuggccaaagcauaagaaaggaagagguggaccuccucuauauauaauaugugaagcaaauaagauaacuggauuauagcuaaaagaguagcaagacauagacagagucugucuacauaacaguuuuuaaaagaagcacaaagacaggcuggacaugguggcccacaccuguaaucccaauacuuugggaggacaagguaggaggaucacuugaggccaagaguuugagaccagccuugggcagcauauugaggccccaucucuacaauaaacaaacagauuuuuaaaauuuagcuaggaauguaguggggugugccuguagucucagcuacuugggaggcugaggcaggaggaucacuugagccgaagaguuugaggcugcaguaagcaucgaucaugcuacugcacuccagccugggcaacagagcgagacccugucucuuuguuguuguuguuguuguuuguuuguuuuuuugacccugucucuuaaaagaaaaaaauaaaagaagaagcacaagcugggugcgguggcucacgccugucaucccagcacuuugggaggccgaggugggcagaucaccugaggucaggaguuugagaccagccucaacauggagaaaccccaucucuacuaaaaacacaaaauuagccgggcgugguggugcaugccuguaaucccagcuacucgggaggcugaggcaggagaauugcuugaaccugggaggcggagguugcggugagccgagaucacgccauugcacuccagccugggcaacaagagcgaaacuccaucucagaaagaaaaaauaagaagcacaaagacaagacgggggacaaaaacaaggaaacuagaggaauuugaagcuucugacaccuacagcuauaguacccauuaaacacaaccuagccagauuaauauaaaaccucacacuaaaggccuuuuaaccuguucuguuaccugauuugucauguugggcuuugaacaauaaauuauaaggcaugcuaaaaggcaagaaaaauaaaaacacuucagagaaacaaagcaaauaucacagagacucagguaugauuuuggaauucaucagucagagaauuuaaaauucaucaauagcugggauacaugaucuauugugggaagaaagaauuaauaaugaguuuaaagauuugucaauagaaacuucccaaacagaaaugcaaagaaaaaggaaugaaagaaacugaagagaacauucaagaacugugggacaguuucaaaagguguuaacauauguguaauuguaauaccagaagaagaaggaagagcaaauggaucagaagaaauacuugaauuaauaaugaugagaauuuuccaaaauuaaauacagacacaaaaccacagauccauaaagcucagagaacaccaaacaggauaaauaucaaagaaucaacaccuaggcauaucacauuuaaacugcaugaaacgacaaauaaagaaaaaauauccugaaggaagccaaaggaaaaaacccacauuaccuacuauagugaacaagaauuucucagaaggaacuaugaaaauaagaugagaguggagagaaauauucaaaauguugaaagaaccaccaaacuagaauucuguaucuagugaaauuauucuucaaaugugagcaagaaauacuugcucagacaaaacaaaacaaacaaaacugagaguuuaucauuaguaggccuguucugcaagaaagguuaaaggaaguucuucagggaaaagaaaaaugagaaaaacucaugucuacauauaguaaggaacaaugugggagaaggaauaaagguaaaauaaauuauuuuauuaucauuauuauuauuauuuuauuuauuuauuuuucugagacagggucuugcccugucacccaggcuggagugcagugacgugaucauggcucacugcagccucgacuucccaggcucaagugauccucucacuucagucuucugagcagcugggaccacaggugugugccaccaugccuggcuaauuuuuuuauuuuuauuuuuguggaggcagggucucacuauauugcccuugcugaucucaaacuccugggcucaagugauccucccaccucgaccuccaaagugcugagauuacaggugugacccacuguguccagccucuauuuuucuuauuguugauugaucuaaaagauagcuauuuaacauaauagugguaaugauucauuagguaauuaaagcucauggauuacugaaauaaaugaaacaauaucauaaaagaugggaggauagaauuggaauacucuguuauaugguaucugcaugacaugugaaguaguauaguguuauuugaaaguggacuuaaauuaguuaaaaauauauguugcaaucucuagggcaaauauuaauuuuuuaaaaaaagaaguauaauugauuuaagagaguagauacaauggaacaaaauaaaaugcuaaauuaaaacuagaagaggcaggucugggugugguggcucauaccuguaaucccagcauuuugggaggccaagguggguggaucaccugaggucaggaguccagaccagccuggccaacauggugaaaccccaucucuacuaaaaauaaaaaaauuagccaguuguggcggugcaugccuguaaucccagcuacucaggaggcugagacacgagaaucacuugaaccugugagguggagguugcaguaagcugagaucaugccacugcacuccagccugggugacagaauaagacucugucucaaaaaaaaaaaaaaaaaaaaaaacaaaaaacaaaaaagcaaccaaaacacuagaagaggcagaaaagaaagggaaaaaggaaacaaaggacaagugcaaccucuguauuaauagaaaccagcuacaauaugguaaauguuaauuaugucaaaauaacuguaaauguaaauggucuaaauaaaaaagcagagauuaugaaaauggauuuaagaaaacaauauccaacuauaugugaucuguaagaaacccacuuuauaaagguucagauauguucaaaguaaagggauggagaaagauauuucaugcucaugcuaauuaauaaaaaucugguguggcuauauuaauuucagaugaagcagccuuuaagaacuaggacaauuaucaggacaaaaagggacauuucaugaugauaaaggguuugguucuccaggaagauguaacaauuccuuaccauuccuauucaccuucauacuagaaguucuaaauaaugcaauaagacaagaaaaagaaacaaaaggccuacaaacuggaaaagaagaaauaaaucuaucuuuauuugcagaugacauaauugucuauguagaaaaucccaaagaaucaaaaaggaacaaaacuccugaaaccgauaaaugaguauagcaaguuuacaggaagcaagguuaauauucaaaaaucaacugcuuuuuuauauaccagcagugagcaauuuauuuuaaauuuuaaaaauuauugacaauagaaccaaaaaugugaaauacuuagguauauaccuaacaaaauauaggaccuauaaugcagaaagcuacaauacacugaugacaauaaauggagagauaucuuauguucuuggauuggaagacccaauauuuuaaaaaugucaguucuucccaacuugaucuguagauccagugcaaucccagugaaauucauagcaaaauauuuuguagauauuggcaaacuguuucuaaaacucauguggaaaggcaggaaaccuagaauagccaaaaaguagaaggacucauacuacucgauuuuaagacuuacuaugaagcuguaguaaucaagacaguaugguauaagucaaagaauagauuaauggaagagacagauagaacagugaaaggaaauagaguccauaaauagaguccuuauauaguccagauuagagaguccauaagauccacacauagaguagacugacuugacaaagggcaaaagaaauguaauagaaaaaggauauucucuucaacaaauggugcuggaauaauugaauaucuauauccaaaaacgugaaccuagauacagaccuuucacaaaaauuaacucaaagugguccauaaaccuaaacauaaaacucaaaacuauaagacucauaggaaauuauagauaaucuuguguuuggcaguggguuuuuagguaccacaacaauacuguauguuaugugagagaaaaaagucauaaguuggacuuuguuaaaauugaaaacugcucugaaaaauacacuauuaagagaaugaagaaacuagccacagauuaggagaaaauauuugcauaaugcauaucugauagacuuguaucuaaaauauacaaagagcucauaaaacucaaacauaacaaacaacccaauuaaaaaugggcaaagaucugaauagacaccuuaccgaagaagacacacagacagaaaaaagcauauaaagagaugcucaaccucauuugucauuaguaaguugcaaauuaaaacagcagugagaugccauuacauaccuauuagaaauggcuaaaauccaaaaagcugauaauauuaauugcuacugagaauguugagcaaaggaacucucauucuuuguugguuagaaugcaaaaugguacugccucuuuagagcacuguucggcaguuucuuacaaagugaaacauaguuuaaccauaggacucagcaguugcaauccuacuugguauuuacccaauuaauuugaaaacuuagguccacauaaaaaccuacacugaaauaaaaaggauuacaaaggaauaguauaaauaagccaacaaauuagauaaccaagaauaaaugaacagaugccuaguaagacacaaucuaccaaaaaugauucaagcagaaacauaaauucugacuggcucuauaacaaguuaaguagauugaauuagcaaaugaaaaacuacucacaaaggaaagucaaggacuagaugucuucacuggugaauugugacacacauuuaaagaagaaucaacacuaauucuucaaaaacucuuccagaaaauaaaagguaacaauuucccaacucauucugugagaccaauauacuacucugaauccaaaagcaaagacaucacaagaaaagaaaaccuacacgaauaucacuaaugaauauagauacaaaauccucaacaaaauacuaacaaauggaguccagcaacauauaaaaagaucagucacuaugacuaaggugagauuuaucccaggaauccaauguuguuuuaaaauacgaaaaucaaucaguauaauauauaauauuaauagaauaaaaaaacaagacacacagucaucucaauagacacagaaaaaucauaugacaaauuaacacccuuucaugauaaacacucuaaaaaaaacuuggaauagaaggcauuuuccucaaccuguuuaaggcuaucuaugaaaaacucacagcuagagucaucauuuuuuguggugaaagaagagauguuuuucccccuacaaucaggagcaugauaaggauauuuacucuugccacuuuuauucaaauuguacuggagguucuagccagagcaauuaggcaagaaaaagaaauaaaaagcauacagauuggaaaggaagaaguaaaguuaucucuauucacagaugacauggucuuguauauagaaaauccuauaaugaaauacugcucagcaauauaaagaaguaaauugcuggccaggugagguggcucaugccuguaaucccagcacuuugggaggcugaggcaggcagaucacaaggucaggaguucgagaccagccugaccaacauggugaaaccccgucucuacuaaaaauacagaaauuagccaggugugguggugugugccugcaaucccaacuacucaggaggcugaggcaggagaauugcucgaaccugggaggcagagguugcagugagcugagaucgcaccacugcacuccagccugggugacagagugagacucuguuuccaaaaaaaaaguaaauugcuaacacacacaauaacaauaacauggauggaucucaaaaauaggcugagugaaaaaagcagacacaaaagaaugcauaguauauuauucuacuuuaaaauuccauugagaggcugagcaggauggcucacgccuguaaucccagcacuuugggaggcugaagugggcagaucaccugaggucaagaguucgagacaagccuggccaguauggcaaaaccccaucucuaauaaaaauacaaaaauuagcaaggcaugguggugcaggccaguugucccagcuacuugggaggcugaggcaggagaauugcuugaacccgggaggcagagguugcagugagcugagaucgugccgcugagauugugccacugcauuccagccuuggcaacagagcgagacucugacucaaauaaauaaauaaauaaauaaauaaauaauaaaauuccauaaaaaauuccuagaaagguguggaacaacaggaauucucacuuauugcuggugggaaaaacaguauagucacuuuggaagacaguuuagaaguuccuuacaaaacuaaagaugcucuuaucauaugauccagcaaucauguuccuugauaauuacccacaugaguuggaaacuuauguucacacaaaaaccugcacaugguuguuuauagcaguuuuauucauaauugcugaaacuuggaagcaaccaaaauguccuucagcaggugaauguauaaauugugggacacccagacaaggaauguugggacacccagacaaggaauguuauucagcacuaaaaagaaaaagaccugucaagccaugacaagacauggaagaaacuuaaaugcauauuacuaagugaaagaagccaaucugaaaaggcuacauacuguaugacuccaacuauaugacauucuggaaagacaaaauuguggaggcaguaaaaaaaaaaaaaaaaaaaaaaaaaaaaaaucagugguucccaaguauuaagggagaggcagagcauagagaauucuaagggcagugaaacucuucuguauuauacuauaaugguggcuacaugucauuauacauuuguccaaacuccuauaauggacaacaccaagagucaacucugauguaaacuauggacuuugggugauaaugaugugucaauauagguucaucgguuguaacgaguguaccacucuggugccagauauugauaguggggcagguugugugugcggggggaacaagggauacacaggaacucucuucuuuuugaucaacuuugcugaaaaucugaaacugcucugaaaaauaaagccuauuaagaaaaauuugaaggaagggaaauacguaaugacagaaagcagaccaauguuuguucaggacugcaaagaugcaugaggaaacuuaccaguaugauggaaauuuuuuauaucuuuauuauugugauugaguuaaaaacauauauacauuugugaaaucucauggaauaguucacuuaaaaugaauaccuuguauguaaauuauaccuuaauaaaccugauuaaaaaacaccuauauauaccuuugauuuuaaaacuaggauagcaugauaaacuacugugguuuccugaauguuuaggaugucuuacuuuuggagcagcuaauuaacugguauauagcaaaaaaaaaaaguguaugaaugguucccuguuucucaagaucaagaccacuugcuuaaauagauauaaaaaugcugaguggguuugauuuugaaauguuuaacgaaacuuuuggaggauacugcuauauguuuaaauucaguuuuuaauaacuugcauagaaaauuauuagaaaguuuccugaaaucauaaguuuuacaaaaauauauaauaauugagauacagcucaaaaauauugguacuggccaggcucaugccuguaauccuagcacuuggggaggccaaggugggaggacugcuugaggccaggaguucaagaccagcuugggcaauguaaugagacccugccucuuaaaaaaaaaaaaaaaaaagccaggcaagguggcacaugccuguaguccuagcuacuggggaggcugaggugggaggauugcuugagcccaggaggucaaggcugcaguaagccauaauugcaccacugcacuccaggguaagacccugucuuuaauaaaaaaaaaaaaaaaaaaaaaaaauacauauauauauauauauauauacacacacacacacacacacacacacacacacacacacacacacacacacauauacuccagggcaagacccugucuuuaauaaaaaauauauauauauguauauauguguauauauauauauauauauauauauauauauauauauauauauacacacacacuaaagccacauccucuuagcauaaagcacuaaucaaagugcagcagagaaugcaaaagauuacacuaaagagauuacugguaaauccuuaucuauuggaaaaagagugucccuuuuggcugacaguaaugauaaaagccaacaguuauacugaaacuuuuuaucugacuuucuguuggagacacuuaaaugauagagauacgaacaggaaacauaaagaaaagcaggaagaagagaaagaacuaauuagaagugcugaauagcaaacaauauaaaaacaacuaagagagaagcuggaacaguucugcugggagaccaacagccaacuauuuuauggagauaauauccuuugaaacaaaacgauauauuaauugagcauaguaucuaaaauuauguauauucgaaaauauucugaugccucccugucacaggcauaacccaucuuugugugagucuacaacucaauggauuaugaaaguacaccccggaaauuuuucuacuguauuggaagguugagguagcugaggcaaugguugcagaggguugcaugcagauuuccagguacuaucaauuaaaaugaaaauauuuuagaguuuaaggauuuaaacaugcagugaucuaaaagaucugaaucauuacauugcucucaaguugcucauugcucucaaggaacuuauaauugaugaaaacauuucucaaagaugcuuaguaccaaguuuuuauuuacaaguaaggacaaggucagucuuuuucauguuaauuuaauuauaacuaaauauuuucaacuauagaguucauggaccuuucuuuccaagaauucugaggcguaggaaaggaaaaagagaauuuggaaagacuauaacacauauuguagcaaaaaugaugacuacugaaaugguaagaaauaaacuauucuuauuuguuauuuaaguauuagcuguguauaaucggaaaagaagcucccugaggguggaguccuugucuaaucauuaaugccuuauuuucucaacuaccuccagcucaguuauugccauauaauagauacuaaauaaauaaauggugacaacuauuuacugaguacuaaccuuguagccagguacuauguuaguugcuuggugaagaugagacauaaacgugagaaagacugcauuuaggggagacaaaauguugauccagacccacagucuuccuucuucacacauuugaaaauuucaagcaugguggaaauauggacacaaguauauaggcaguuacaauuaugacacagaaugauaaaugcuaugauaaggauauguacccgguacauguagaauggguacauaagacagaauuaggagucuggaaaugcugaauagaagaaauaacucagcugaauccugaaggaugaauauaaauuuauccagcucaagaacaaacaaauguucugagccaaagagcaaauauuuucauuucacuugaccucucaguagcguuucaaaucucucucauugaaauaaucucuuuccuuguuuuauguuaguauacuuucaagguuuucauucuuucuaguuacuuuuuuucucauguccucuaaaugcuugguacuugucuuuuuuaugcacuauauuaucccaaagugauuuagcuaaucuucucccauaacuucacuuauauauacagguacuuuuccagaauguauuugcauagcccaaacuuuugcucuaagccccaaaccuauguguccaacugccuauugcuuaugaccacuuaauugucucaccaguacaucaauuaauugucugcaauuaauuucauaaucuuaucccauugacuugcuuucauucuggaguucucuguuucaauaaaugguaccaucaucuacuugguugcuaauaacaauuuucugggaguuaucuuguucauauuucucaucacuuucauacacacucacuuuuuuccuucacucacccuacauccugggauaagcuguguuguuuccucugccugcugagccacuguucauccuucaggucuugauuuaaauauuuccacaggaaaaggccuucucaaccuuucauaauacauuagacugcuguauacaauuauaguaccuuguauuuuucccuauugacacuuuccuuuaucaugacuacauuuaacacuuuuguggcuauuuaaugucugucucuuucacuaguaugugagcuucuugagagcaaagaguauuuaccacucauccagucaccuagcaugaugcuugguacaugguaggugcccagcaauuuuuggugaaugaauaaauuaguguauguaacaagagagguuaguauauaugaggaaccgaaagaaggccaccaaggcuggugguuaacaucuaagagagugaugaaagauaaagcuggcauauuagauagucuugucugcuauucuaccaauuuuuauucuuuucaacaaaauuuaauuuuccuuuuaauuacuuauuggagcauauuauucaaucauguugauuauuccacuaacaucuuuauaaacaccuuuuaaaacaucuuuuuaaaaagguauaaaucuugcuuuuauccucagcuuuauuuugucauuuuuauuuuuacuucuccuuuucacuuuuaaauagguccuggcuuuauucacuuucuuauaugacagaaauuucuaugauuuuuuuuguucagugcuuugcaauucuguuuucauuuguguaauuauaccugaacuuuggaggccagaauaauuagagggagacuacugugaggagaaaguaucaucagcuuccaguuuacuuagaccuuggauuuuagauuuacuuuugagguucaugaaauauagcuugauaguaguauagcugugcauauaagcuuuuuuuuuuuuuuuuuuugagacggagucucgcucugucgcccaggcuggagugcaguggcgugaucucgccucacugcaagcuccgccucccggguucacgccauucuccugccucagccucccgaguagcugggacuacaggcgcccgccacuacgcccggcuaauuuuuuguauuuuuaguagagacgggguuucaccccguuagccaggauggucucgaucuccugaccucgugauccgcccuccucagccucccaaagugcugggauuacaggcgugagccaccgcgcccggcugcugugcauguaagcuuuaacaauuuccucaucuuugaagauucuugacugagaauucuugcucuauacccaccccuuagacgcaguuuauucaugcccaucaucuuauguuggugaucuuuacaagcagugcaguggaaaggcauggacuuuguaguuagauacccaauguucaaauacccugagaccacuuaauaaacaaucuuaggcaaagcgcauaaccucuaagccucaauuuccuuacuugcagaaugcuuuaaaaggagagagagagaguauauauauauauauauauauauauauauauauauauauauauauauauauauauauauauauagugcuaguuaagagcaugggcucuaaagacaaauugccuggauucuugguuuugccacuuacuaguuaggugauuuucaaccaauuauuuaacccaucuguaguuuaguuucucauauguaaaauugggauaauaauccuauguuucauauuuauagaguugcuguaaagauuaaaugaguuuauauuuguaauaugcuuagaauaaugcccagcacauaguaaaugcucaauaaauguuuaccacuuguuucaguuucugaacuaaaguuaaacauuagucauucucccagaucuaggagaaacagugguauucccauuguguaucauaggccuuuauccucuuguugaucacaggcuuuuccuucuuucaaucuggagacgguauagugugauguuggagaacauagacuuuaagaucauaaaaaccuggauuugauucacaguuuugcuucuuaauauuucuaugagauuaaacaaauuacaugguuucucuuauuuccucaucuguaaaagagaauaaugaagucugucccauagaguguuaggcuuaagugaaauaauuuauauaaaucuuuuagcaaaaugccuagcacauaaauaaaugucaacugauauuauuauuacuauuuugcaguuuauaucccaauaauauagccaucauuuuugccagauuuuuccugaagugcuacagaaggugauaaccaugucugaaaauauacgaaguacaaagaagaauuuaaucaguuuucuuccaucuguacuacugauucuguugccaucugccuccucagagacagugugcucucaguuauuccuucuuuuuuuugguaucuuuuuuccuuucuuaaaaaacuugaggugaaauuuacauagcaaaauuaacuguuuuaaagugauauucauugacauuuaguagggucacaaugcuguguacaucugucugguuccuaaccauuuucauuacccaaaaccagaaccccauaccuccauuuccccuuucccccaccuccugacaaccaacaaucugcugucucuguagauuuaugauucuggauauuucauauaaauggaaucauaaaauaucugaccuuuaugucuggcuucuuucaucuagcaugauguuuauaagguucauccacauuguagcauuuaucaguacuucauucauuuuucuggcugaauaauauccuuuuguauguauauacaaugaucugcuuauacauucaucaguugguggauaucugaguuguuucugccuuuugacuauuggggaaaguggggcugugaacaucugugugcaagaguuugucugacuacuuguuuucgauucuuugggguauauaccaaagacuagaauuacugggucauaugugcaacuuuaugaggaauugccaaacuguuuuucacaggggcugaaacauuucacauugucaucugcaaaguauuagaguuccaauuucuccaguccucaccaaaacuuuuaucuuuuuuuauuauuuauuuuuucucuuucuuuuauuuuuaaaauuacagugauccuagcgaaugugaagugguauuucauuguaguuuugauuuucauuuaacuaaugacuaaugauguugaagaugcugaacaucuuuccauggacuuguuggccauuuguguaucuuccuuggaguaacaucuauuaaauucauaucccauuuuguaauuggguuguuugucuucuuguuauugacuauaagaguuauuuauauauucugaauacuagacccuuauuagauauaugcucugcaaauuuuuaccccccauuccuuaggcuuuuucacuuccuuuugugcgcuuuauugccacuuaggggaugcuaggagcauugccuguccgugaucacugucauugcuguuaaccuuauucacuauuucauaugugaucccucuuccucccccuccuucuuucuuucuucacuucuuuccuuccuuuccuuccuuuccuucccuuccuucccuuccuucccuuucuucccuuccuucccuuccuccccuuccuccccuuccuuccuuucuuccuuccuuuccuucuuccuuuuuuuuucuuucuuucuuucuuucuuucuuucuuucuuucuuucuuccuuccuuccuuccuuccuuuccuuucuuucucucucucucuuugucuuucccuuccuuccuucuuuccuuccuuccuuccucccucccuuccucccuccuucccccaccccucucuucccuccuuccuuccuuccuuucuuucucucuuucuuucuuucuuucuuucuuucuuucuuucuuucuuucuuucuuucuuucuuucuuucuuucuuucuuucuuucuuucuuucuuccuuuccuuuccuuuccuuuccuuucuuuuguaguuggaucggaauagcacugcaucuguacauugcuuuggucagcauggucauuuuaacaacauugauucuuuuggcggggcgcgguggcucacaccuguaaucccagcacuuuggaaggccaaggcgggaggaucacgaggucaggagaucaagacuauccuggcuaacacggugaaacccgucucuacuaaaaauacaaaaaauuagccgggcauuguagugggcgccuguagucccagcuacucgggaggcugaggcaggagaauggcaugaacccaggaggcagagcuugcagugaacugagaucagccacugcacuccagccuggguggcagagcgagacuccgucucaaaaaaaaaaaaaaaaaaauugauucuucuuauucuugagcauggaauguuuuuccauuuguuuguguugucucuuauuucuuucaacagcauuuuguaguuuugcaauucuuguuguagagcuuuuucacuucccucguuagcuguauuccuagguauuuuauuuuguguguguggccauugugaaugggauuguguucuugauuuaguucuucagcuuggacauuguugguguauagaaaugcuauggauuuuuguacauugauuuuuguguccugaaacuuugcuaaaguuguuuaucagaucuagaagcuuuuggguagaggcuaugagguuuucuagguauaaaaucauauagucucuaaagagauaauuugacuuccccucuuccuauuuggaugccuuuuauuucugucuuuugccugauugcucuggcuaggacuuccaguacuguguugaaucgaagugguaagaguggguaucguugucuuguuguuuuucaaggggaacgcuuccagcuuuugcccauucaguaugauguuggcugugggcuugucauagauggcucuuguuaucuugagguauauuccuuaagugccuagcuuguugagaguuuuuaagaugaauagauguugaauuuauagaaagccuuuucagcaucuguugagaugaucaugugguuuuuguuuuuaguucuguuugugugcugaaucacauuuauugauuuuuguauguugaaccaaccuugcaucccaggaauaaagcuaauguuaucaugguggauuagcuuuuugacuaauggccacuuaggucauugaugugcuacuagauucaguuuguuaauauuuuguugaggauguuugcaucuguguucauuaggaauauuggcuugaaguuuacuuuuuuugaugcuucugccagguuuugguaucagaaucaugcuggccucaaagaaugaguuagggaggaauguuuuggaauaguuucagcaggauugguagcaacucuuauacgucugguagaauucagcuguaaauuugucucauucagggcuuuuucugauugguagguaggcucuuuauuacugauucaguuuuggaacucauuauuagucuguuuaugguuucaguuucuuccugguucaaucuugggagauuguguguuugcaggaauucauccaguuccuuuagauuuucuaguuuuugugcauagagguguuuguaauagccucugaggguuuuuuuguauuucuguggugucaguaguaauguccuuuuuguuguuucugguuauguuuauuuggauauucucucuuagucuagcuagcagucuaucuuauuuauucuuucaaaaaacaaagguuuuguugaucuuuuguaugguuuuucacaucucaaauucauucaguuccacucuaauuuugguuauuuuucuucuucuagcuuugggauugguuuacucuuauuuuucuaguuccuccaggugugauguuagguugucaauuugagaucuuucuaaccuuuugaugugagcgauuagcagaauaaacuuuccucuuaacacuaauuuagcugugucucagaguuucugguauguuauauccuuguucucauuaguuucaaauaauuuuuugauuuuuugauuucuguguuaauuucaguguuuacccaaaagucauucaggagcagauugcuuaauuuccaaguaauuguaugauuuugaaaggucuucuuaguauugauuucuuucuuuuuuuuuuuuuuuagauggagucucgcucugucacccaggcuggagugcaguggcaugaucuuggcucacugcaaccuccaccuuccagauucaagcgauucuccugccuuggccucccaaguagcuaggauuacaggcaugcaccaccaugccuggcuaauuuuuuguauuuuuaguagagaugggguuucaccauguuggccaggcuggucucaaacuccugaccucaagugaucugaccucaggcgaucuguagaugucuguuagguccauuuggucguguagaguucaggucucaaacaucuuucuuaauuuucugccucaauuaucugucuaauacugucagugggguguugaagucuugcaccacuguugugugguuaucuaagucuccugauagguuucuaagaacuuauuuuaugaaucugggugcuccagcauugggauuauauauauuuaagauaguuaauucuucuuguugaaucaaacccuuuaucauuauguaaugccauucuuugucuuuuuaaaaucauucuugguuuaggagucuauuuugucugaaauuaaaauaguaaccccugcuuuuuuugguuuuccauuugcuugguagauuuuucuccaucuuuuugcuuugagccuaugggugucauugcaugugaaauggauuucuuuuuuuuggaacugagucuugcucugucgccuaggcuggagugcaguggugugaucucagcucacugcauucucugccucuugccucagccucccaaguagcugggaucacaggcacguugccaccgcgccugguuaauuauuguauuuuuaguagagaugggguuuugccauguuggccaagcuggucucgaauuccugaccucaggugauccaccuuccuuggccucucaaagugcugggauuauaggugugagccaccacgcccugccugagauggauuucuugaagacagcauagaguugagucuuccuucuuuaucuaacuugccacuuugugccuuuuaaguauggcauauaacccauuuacuuucaagguuaauauuaauaugugcagauuugauccugucaaaacaaaccuaacaaaccuauuagcucguuguuaugcagacuugauagugcaguuacuuuauagugugaauggucuauguccuuaaguguguuuuuguggugguaaauaacagucuuucauuuccacguuuagcacucccuuaaggaccucuuguaaggucuggugguaaugaauuuucuuagcauuuucuuaccuucacuuaugaagcuuaguuuggguggauaugaaauucuugguuggaguuucuuuucuuuaagauugcugaauguaggcccccaaucucuucugacuuacaggauuucugcugaaagguccacuguuagcuugauaggauucccuuuguaggugaccugccucuccucucuagcugccuuuaauauuuuuucuuucacguugaccuugaagaaucugaugacuaugucuuggggauggucauuuuguauaguaucucauagggguacucugcuuuuucuggauuugaaugucaaccucucuggagagguugggaaauuuuuaguguacaguauccugaaauaugcuugcuugcuuucucucccucuguuuuagggaugccaaugagucguagguuuggucucuuuacauaaucccauauuugucagagguuuuguucauucuuuuuuauucuuuuuucuuuauuuuuguuggacuagucuucaagcucugagauucuuuccucagccuggucuauucugcuauuaauacuuccaauucuuggagugaguuuuucagcuccaucaguucaguuugauucuuucauaaagugacuguuucaucuuccagcucuuguauuguuuauuggauucauuagauucuuuggauuggguuucaacuuucuccuaaaucuugaugaucuuaguucauauccagauucuguauucugucugucauuucagccugguuaagaaccauugauggggaauuagugugguuguuuggcgguaagaagacacucuggcuuuuuaaguucccagaguucuugcacugcuuuuuucgcaucugcuugggccgauguuccuuugaaguugauguccuuuggaugggguuuuuuugcuuuuauauucuuugaugcgugugaggguuuuacugugguauaagguagguucagucaacuggcuucauuucuggaagaugucagggguccaauucuuaccucaguacuacugggcugcaugcgcaacccuggggggcugguaccaggcccacagcacagguuuguucucuggccucucaagguuaaucaccuccugcacuggaggggcugagguguucacagucugcugguaacaacacuucgauggugagugcuaaccaaagcccuuuguuggggcaguggcagcaggucugugcuccugcauaugugccaacaguggcagcggugcagcagggugugcauguaucagcaggggcagggugccagcgagggugggacugugguguuuguauguaugcauuagugcuagugguggcaggacaacaaagugugcaugcaugugugcugguaggggagggguggugacgucugccuguaugugugcacuuccaaagcagugggggaugaugugguagggggaggcuguguggaucccucuuucuugauuuaauauguuacaacaagcaagucauggccuccaacuuucagaucuuuaucaaguuugguaacaauaagaaacauggauccauaguuagaaaauucaauaaauguuaaaacaaacacccaguuugaucuuccucagugaacgaccauuccaguuuuaugcuuauaauugaaauuagcuuugacccauugaccugcccaaaauuaccuuaucccucaccuaguggucuaugcauggugccuaggcuuuuuuacauucuugauaaugucccuugaugccuuacaguuuuuaacuuugaggaaauucagcugcuuugguuuggauguuuuugccccacuccaaaacucaaguuuuggaaacuuaauccucaacacaacagaguugggagaugaagccuaaugggagguauuucaagaggauagggcccucacaaauggaucaaugccccuauaaaaaggaauuaugggagcugguucugccucuguuguucuucugccaugugaagacagaguuccucuccagaguucuugccuuuugccaugugaggauccaaguggcaggcaaggugccaucuuggaagagaauggccucaccaggcaccaaaccugccagugccuugaccuuagacuuccuagccuccagaacugugagcuaauaaauuuauuuuauaaauuacacagucuguagcauucuguuauacagcagcacagauagacuaaggcagaaauuuauuuuuucuuuuguuacucaugcuuuugugucauaccuuagaauccgcugccaaguucaagaucaugaagauuuacccuuaugguuuuuccuaagaguuuuaugguuuuagcucuuauauauagguuguuaaucaauuuugaguuaauuuuuguauaugguguuggguuuggguucagcuuuauccuuuugcauguagauacuuauuugucccaacaccauauguugaagagacuauucuuuccccauugaaugaucuuguaacccuuguugaaaaucacuugcccauaauuggguuuauuucuggauuuucaguucuaucccacuggucuauaugccuaucuuuaugccaguaccacacuauuuuauuacuguggcuuuguaguaaguuuuggaaucagaagagugaguccuccacuuuguucuuuuucaguauuguuuggcuguucagggucccuugcaauucauuauuaauuugaagaugagcauguucauuucuucaaaaaaaaggcuauugaaauucugauagggauuacauugaaucuguagaucaauguaaguaguauugcuauuuuagcaauauuaaaaucuuccaauccaugaacaugggauggcuuuucaucuauuugaccuucuuuaauuucuuugagcaaugguuuguaguuucaguauacaaguccuucaccuccuugguuuacauuauuucuaggcauuuuauuauuuugugugcuauuguaaauggaauuuucuuaauuuucuuuucagauuguucauuagugauauauaaaaacaaaacugauuuuguguucugauuuugcauccuucaacuuugcugaauuuguuuauuagcuaucauauguuuuuggugcauuccuuggagauauauauguguguauauauauguauauauauauguguauauauauguguauauauauguauauauauguguauauauauguauauauguguguauauauauguguauauauauguguauauauauacacacacacguauauauguguguguauauauacauauauauguguauauauacauauauauauagagagagagaggagaguauauauagggucaugucaucugcaaacaguaaguuuuacuuccuccuuuacaauuuggauacauuuuauuucuuuuugcauaguugcucuggcuaggacgucugguucaauguugaacagcaguggcaaaagugggcaucauugucuuuucugauacuuugggguguuauuggcagaauugcgucccuccaaaauucauauauugaaguccuuaccccaguacccuaaaauguaagcauauuuggagagcaaguguuuaaagagaugauuaaauuaaaaugaagccauuaggguuggcccuccuccagucugacugauauccuuaaaagaaaggaaauuuggacacagaaaaagacaucaggagugcaugugcacagaaggaugaccaugugaagagggagcaaaaccacaaccaccugcaagcugagagaggcucagaagaaaccaaaucuguugacacauugaucuugggcuuccauccuccagaacuguaagaaaauaaauuucuggccgggugcagugacucacgccuguaauccuagcacucugggaggccgagauggguggaucacuugaagucaggaguucaagaucagccuggccaacaugaugaaaccccaccucuacuaaaaauacagaaauuagcugggcauagcuuuuucugcaucaauugagauuauuguguaauuuauuuuuccccuucauucuauuaaugugguguguuaugauugauuuuuguauauuaaaucacucuugaauucuuggaauaaaucucacuucaucaucauguauaaccuuuuaaauauguuguugaguucaguuugcuaggauuuauugaggauuuuugcauuuauauucaaaaggaauauugcuguauaguuuucuuuucuucugguauuuuugucuagcuuuguuaucagauaaugcuugccugagaauuaggaaguguucucacagauuuuggaggaauuugggaaagauugguguuaauucuuuuuuuuuaacuuuuauuuuagguuuggggguacacgugaagauuuguuacauagguaaacucgugucauggggguuuguuauacauauuauuucaucacccagguauuaagaccaguacccaauaguuaucuuuucugcuccugucuuuccucccacccucuaccuucaaguagacaccagugucuguuguuuuccucuuugcauucauaaguuauuauuuaguguucaugguguuaauuuuugaaauguuugguagauuuaucaaugaagcuaucugaucuuggacuuuucuuuguugggagauuuuugcuuacugauuuuuuaaucucuuuacuguuacaggucuguucagauuuuauauuucuucuagagccaguuuugguaaacuguguguuucuaggaauuuguauacuuaauuuuuguugguaugaaaucagugcauuuguugguguacaauuguucauagguguacauauaaugauaguauaaucauagaauaucauuauaaauaauuuuuauuucuuuaaggucaguaguaauguaucuaccuucauaucugauuuuaguuguuugugccuccucuuucucuuagucuagcuaaacuuuugucaauuuuguugaucuuuucaaaaaauuaauuuuugauuuuguuuuuauuuuuccuauucucuauuucauugaacucuaaucuguaucguuuccuuuuacuguuggcuuuggguuuaauuugcuuuuucuaguuucuuaaguuguaaaauuagauugcugauuugagaucuuucuuuuuuaauguaggcauuuacugcuauaaauuucucucugagcucuguuuuuccugcauccuauaaauuuugguauguuguguuuucauuuucauuuaucucaaaguaucuucagauuuuccuuuuguuucaucuuugagccauuuguuauuuaagaauauguugucaggccgggcgcaguggcucacgccuguaaucccagcacuuugggaggccgagaggggcggaucacaaggucaggagauagagaccauccuggcuaacacggugaaaccccgucuccacuaaaaauacaaaaaauuagccgggcgugauggcgggcgccuguggucccagcuacucgagaggcugaggcaggagaauggcgugaacccgggagguggagcuugcagugagccgagaucgcgccacugcacuccagccugggcgacagagugagacuccgucucaaaaaaaaaaaaaaaaaagaauacguuguuuaauuuucacauaugucuaaauuuuucaguuuucuuuccauaauugacuucuacuuuaauuccauuguagucagagaagauguauuuauugagacuuguuuuguggccuaauagaugguauaucuuggagaauguuccauaugcauuccagaagaaugcauauccuuuuguguuggacuuggggggcaguguauauauguauguuaggucuaguuagauuauacuguuguucaaguccucuauuuccuuauuguucuucugucuagauguucuaguuauuuuugaaagugguauagaaaucuucaacuauuauuauaaaacuauuucuuacuucaauucugugaauguuuuacuucauacauuuugagaccuuguuguuugguuugcauaugcuuauugguacaucuucuugaugaauuaacucuuuuguuaauauauaauaccuuucuuugucucuagcaacaauuguguuauuaaagucuauuuuaucuaauguuaguguagccaccccagcucuuuuucaauuacuguuuguacagaauaucuuuuuauucuuucacuguuaaccuacuugugucuuugaaucuaaagugagauucuuuuuuuuuuuuuuuuuuuuuuuuuuuuuuuuuugagacagagucugccucuguugcccagaauggagugcaauggugcgaucucagcucacugcaacuuccgccucccagguucaagugauucuccugccucagccuccugaguagcugggauuaugcaccaccaugccuggcuaauuuuuguauuuuuaguaaagaugggguuucaccauguuggccaggcuggucucaaauuccugaccucaugauccgcccaccucgcccucccaaaggguugggauuacaggcaugagccaccacacccggccugaaaugagauucuuguaacaucauauaguuggauuauuuuucuuuauccuuucuaccugucuuuuuuaauuggugaucuuaauccauuuacauuuaaaauguuuacugauaaggaaggacuuacuucugucauuggcuacuguuuuuccuacaaguaauaucuuuuuuuuguuacgcagugcuuucaguaccaucuucuuuuguguuuuaugauuuuuuuuuuaguguaccauuuugauuuacuccacauuuccuuuuguauguauuuuuuaguuauauucuuggugauuaucaagggaauuguaauucacauccuacauuuauaacgauugaguuugaauugauaccaacuuugcuuuaauagcauacagcuccaucgucccuuuauguuguuauuguuacaaauuacaucuuuauacauuguuuccccauuagcauggauuuacaaggauuguuuuaggcaucgguaucuuaaauuauauaggaaacaaaaaaaggagucacaaaccaaaaauacaguaauacugccuuuauauuuacccuugauuuuaccuuuacuggaauuuuuuuauuucuuuauauggcuuugaguuacuucuguugucuauuucauuucagucugaaggacuccuuuagcauuucuuuuaggauaggccuaacuuuuuuuaucuagaaaugucaauuucuucuucauuuugaaaagguauuuuuucuagauauagaauuuuugguuguuuaucuuucagcacuuuuaaaucccacugcuuucuggcuuccaugguuucugaugagaaagcagccuuaaucuuauuaaagaucucuuauacuuaaugcauugcuucucucaugcugcuuguaagauucucuauuuaucuuuggauuguuuuuuaucauuauuauuuuuugagauggaguuuugcucuuguugcccaggcuggagugcaauggcaugaucuuggcucacugcaaccucugccucccagguucaagcaauucuccuaccucagccuccccaguagcugguaucacaggcauguggcaccacaucugguuaauuuuuguauuuuuaguagagaugggguuucgccauguuggccaagcuggucuggaacuccugaccucaggugaucagcugccuuggccucacaaagugcugguauuacaggugugagccacugugccccgccuaucuuuggauuuuaauuguuugauuauaauauuuguuaauguguguuucuuuguguuuaucuuacuuaaaguccauuacacuucuuggauauguagauucaugucuuuaaugaaauuugggauguuuucggccauuacguuuucaaguauuuuuucugccuuuguuaggaaaacacucaaaccauauuuucccucuguuuucacaacaaaacaagaauuaucaauacagaaaacuucugugaccccaaaauauguggggcuuucucccugccagcaaguaaucaaucaguucuccagcagaccccaacuggguguccuacaauucuauuucagcauacaguagauagugucacauucuacagguuggagacucagccuccaaaacugcuccucucccucagacaccagucacaagucuaggccuccagaacuucugacugacugacuucaaguugggguucucacaacuccuuuuuuggguuuaauuaguuuacuagagcagcucacaggacucagagaaacauuuauguuuaccaguuaauuuaauuaauuaauuaauuuuuugagauggagucuugcuaugucacccaggcuggagugcaguggugugaucucggcucacuguaaccuccaccuccuggguucaagcgauucuccugccucagccuccugaguagcugggauuacaggcgcacaccaccacacccagcuaauuuuuguauuuuuaguagagaagggguuucaccauauuggucagucuggucuugaacuccugaccuugugauccacccaccucagccucccaaagugcuaggauuacaggcgugagccacagugccuggccuauguuuaccaguuuauuauaaaggauauuacagucaagcacaguggcucaugccuguaaucccagcacuuugggaggccgaggcagguggaucacuugaggucaggaguuugagaccagccuggccaacauggcaaaaacccgucucuacuaaaaauacaaaaauuugcugggugugguggugcacaccuguaaucucagcuacuugggaggcugaggcaggagaaucacuugaacccaggaggcagagguugcaaugaaccgagauugcgccacugcacugcagccugggugacagagugagacugugucucaaaaaaaaaaaaauugauauuacaaaggauacagaugaaaagguguguaggggaagguaucagggaaaguacacagagcucccaugcccuccuccagguauaucauccuccaggaaauguuaugaggucagcuuucugaaggcucucugaaccuaguccucuuggguuucuuuggacaacuguguuaaaacaugauuggccucaaauuaugggguggaacccaguuuauuuauuuauguuuugucucuuuuuuucuuuuuuguggauaacagggucuugcuauauugcccaggcaggucucaaacuccugggcucaagcuaugcucccaccucugccucccuaagagcugggaguacaggcgugagccaccgugccuggcggaaucugguuuggaaugagggucuuaugacccacaaucagaaaagcacaggaauauuagaguccugcccuggggcaggugaaaggagagcaagagaagguuagagagauucuguuucaugaggccuaaagcacccaacauuauaacaaaaagcuguaauaaggacuguggaaguuaugagucaggaggugugaaugaaaacccauauauacauacaaaguaacagcacacccuuuucucucuuuccucuucuucugacacuuccuaauaaguauauuuauaugcuucauaauaucccacuggucccuuugaugcuguucauuuuuuucuauaguucuuuucuuucugaucucaggcuggauaauuucuauugugcuuucaucaagauugcugauuauuuuuucugcuugcucaaaucugcuguugaaccccucuagugaauuuuucacuucagcuaucacacuuuucaacuacagaauuucuauuuuguuuauauuuuuauugauauucuuuauuuguucagacauuguucuccugguugcuucuaguucuuuauuguuuccuuuagcucuuugugcacacuuaaaacaguagaguuaaagucuuugucuaguaaguccaaagucuuaucugggcuuccucagggauaguuucugucaauuuauuuuuccugugaaugggucaugguaucuuauuuuuuuuguaugucuugcaauuuuuuuguugaaagcuggacauuuuagauauuauaauaugguaacucuggaaauuggauucuacuccuccccaggguuuguuucgguuguuuaugacugcagcuguauguuuguuuaaugacuuuucuaaacuaauuugcaaaggcuguauuccuuuucuuuguggcacuugaagucuuuguuguguuaucucaguagauagugagugaucuaacagagauuuccuuaaauggcucagcuaaaaagaaaaaacaaggccaggugcaguggcuuacaccuguaaucccagcacuucgggaggcugaggcaggcagaucacuugaggccaagaguuugagaccagccuggccaacauggugaaaccccaccucuacuaaaaauacagaaauuagcugggcauaguggugcacaccuguaaucccagcuaguugggaggcugaggcaggagaaucgcuugaacccgggaggaagaggcugcagugagccaagauugucccacugcacuccagccugggugacagagccuggauccaucucaaaaaaaaaccacaacaacaaaaaaauagauaaauaacuagaaaaaaacaaaaacaaaaacucucccaguguuugcagauugucucugagcugaggcacuccuucagagcuaagccaggcugccuaaaacuuuguauuagcuuuugcuuccuguuugcacaaggcccaaagagcagccaaaggugcaagccuagguucuucuuggguaucuucugagcauacgucuagcccugcagugcaugugcauuucacuacugauuuccugguauaugggaagcccugauuccuuucaagcccuuauuccuccaaaaaucuuucucuucagccccucgucugaggaaucuugcuugucucuuucuguguucuuugcgcuaggcaucuauggggcaaagggaaagccacuccaaccugaggggugaaaaaaaauaucaucuuucuuugccagucugucagagaacuaccagauaggucagaauuuacaaccauaguauuuugagaacaaagccuauauugcacccuaccaccugguggccugcuggcaccagcaagcuacaccaggaaugugggcugccauuuccauugcugcugcagagcaggggauugggggaugguagguggguaagcaaaaaaaugccacacuuguuuacugaauuuuagcagccacuucauuaagcauuuccuuuguugcuguguuugauuuagguucuagagcucccaaaaguugauuccauaguuuuugccaacuuaauguuugcuucaguggaagagccauuacuucaccauuucugugcugucaucucuuccuugugucuuuaaccucuccucucuacucucuccuuccugaaugcagugagauauguucaauucuguucuauuuuaaauagcaaaacaauaucuaccuuaaacaccacaucucuguuucuuaccuugcagagaaaaacuacuugaaauauuuaucugcauuuauuuccacuucuucguauuuauuccucuacucacugugauccggcuucugucugcagaauaucacugaaaaugcuguuguggucacguagaaucucccucuggccaauugcaguagguacaacucagagauuaccaucuuguuaaucuuugagcagcauuugacacuaccaacuacauuugucccucaguauagacagagauuaguccacagacacuuggcauguauccaaauccguguguacucaaguccugcugucagcccugcagaacccauauauacaaaauucaaagucugcucuccauauacucagauuuucauccugcaaauacuguauuuugauguguguuugguugaaaaaaaucuguguauaaguuggucuaugcaguucaaacccauguuguucaagggucaacuguacuuccuccuuccaugacauccuagucuccugauuuuuuucuaccaccucuuugccuacuuuucaauauucuuugugagaucuuguguuuccgccaguuuguuaaauauuccucaguguucuguucuagguugcuaucuuucccucuuuacgcauucuuguagcuaauuucauccauuccugugcucaaauuaucauauaaguaaauaauucuaugaccuuaugucuagucagguccuauauucuagacccuuauauccauagucugcuggauaccucuaucuagugacuccacuggcacuucaaauuuauuggcaccaaaauuaaacucaucgucuuccucuaucacacuuuuuucucucuccuguguuucuuauuucagugaauaaaaaaaauauaaaugaggaggguuucagaguucuuacaaauuauuuauuuacagagguagucuugugcuaucugcuuccaauguauguaauaccugcacaaaugaguuuguagguugcugauuuaguaagguuuauaggaauuuuacauauaucuggaaaaaguguucacucucacuuaucaaauaaauggaaaugaaaaugaggugaggaggacuuuuguccguuaaaauggcaaauauuguacaaauuuuuuaaaaaucccauguuguuuuguuuaugacaaaacgagcauucuuaacccaaguuuuaauugauuaagcuuuucuggagaggaauuuggcaaaguauauccaagagucuuaaaauguuuauaccuuuugauucagcaauuuccugucuaguaauguuuccuaaagaaauaacuagagauauacauaaggaucuguuauaguauuuucauaauguugaaaacucauaaaccauccaaauaagagugagaaauucauaacaugaguuguaauauaucuguuugauacauuaguauguaauuguuaaaaguuaggcuuugaugugcuauucauaauagcaaagacagggaaucaaccgaggugcccauugaugguggauugaauaauguaaaugugguacauguacaccauggaauacuaugcagccauaaaaagaaugaaaucauguccuuugcaguggcguggaugcaccugaaggccauuauccuaagugaauuaaugcaggaacagaaaaccaaauacugcauguucucacuuacaagcaggagcuaaacacuaagcacacauggacacaaacaugagaacaauagacacugcuaacuacuggugcaggaggaagaagggaggggaugucuguugaaaaacuaccuaucggguacuaugcucaauaccuggaugcaauaaacgaacauaguaaacccugcacaugcacccccauaucuaaaauaaguugaaacuuuaaucauuaaaaaaauaggcuuugaaaaauuauuuaaagacauggggaaggugauauaaugacaaaaucagaauucaaaaguauauacaauauaugguaugauugauuggcauaugaauaaaugaauauaugcaugggaaauauacuagaaggaaauaucuauauaaaugaagguuuucuuuaguuaagaauuuacaaguuaauuuuucaauuuuuguuaugcuuucuuuuccauguuuuuauaacaaguaucacuuuuauaauaaaaaaaggcugggugcaguggcucacgccuguaaucccagcacuuugggagaccaaggcggguggaucacuugaggucaggaguucgagaccagccuggccaacauggugaaaccccgucuccacuaaaaauacaaaaauuagccgggugcaguggcacacaccuauagucccagcuacucgggaggcugaggcaggagaaucacuugaacccgggagguugcagugagccaagacugugccacugcacuccagccugggcgacagagcaagacuccaucucaaaauaguaauaauaauaacaauaauaauaauaauaauaagaauaagaaagauauaugcaugauaaugccauucucauugggaucaaagaacgauaggcauuuuuucagaauauauuuccaaauuuuauauuuggauuuauuauuuauuuauuuacuuuuuuuuuuuuuuugagacaguuucgcucuuguugcccaggcuggagugcaauggcaccaucuccgcuuacugcaaacucugccucccggguucaagcgauucuccugccuccaccucccuaguagcugggauuacaggcauguaccaccaugccuggcuaauuuuuauauuuuuaguagagacgggguuucaccauguuggucaggcuggucucgaacuccugaccucaagugauccacccaccuuggccucccaaaaugcugggauuacaggugugagucacugugcccggccaggauuuauauuuuauauuaaaaguccuucacacugcugggcaugauggcuucuaccuguaaucccagcacucugggaggcugaggugggugaucacuugagcugaggaguuugagaccagccugggcaauauagagaaaccccaccucuacaaaaaauacaaaaauuacccaggcauggcaaugugugccucuagucccagcuacucaggaggcugaggugggaggaucacuugagccugggagguuuaggcugcagugagccaugaucgugccacugcacuccagccugggcgagagaaugagacccugucucaaaauaaauaaauaaagcccuccagucuuuacgacacuaauaacaaauuuaucuccucuuuucuacucccaaugcauauuuuagaaucuuugauaaguauaauuuuguuuaucugggggccgggcacgguggcucaugcacuuugggaggccgaggcagguggaccaccugaggucaggaguucgagaccaaccuggcuaacauggcgaaacccugucucuacuaaaaauacaaaaguuaguugggugugguggcagacgccuguaaucccaacuacucgggaggcugaggugggagaauugguugaaccugggaggcagagguugcagugagcugagaucgugccauugcacaccaaccugggugacaagagugaaauucgaucucggaaaaaaaaaaaaaagaauuuuguucauuuacuaaaacuggagggucauuuugaguuaaagaaaacaaaaugauacauagggaagagcaugagaucuggugucauauugaacugcaucuaaagcuuggcuucacuacuaauuuugacaauucauuuaaucuugccaagguucaauuuccuuaaccuuauagcggggguaauaauacuuacguugccgggcacgguggcuuaugccuguaaucccagcaguuugggaggucgaggugggcggauugccugaggucaggaguuuaagagcagccuggccaacauggagaaaccccgucucuacuaaaaauacaaaaaauuagccagacgugguggugugcaccuguaaucccagcuacucaggaggcugaggcaagagaaucgcuugaauccgggaggcagggguugcagugagccgagaucgcagcauugcccuccagccugggcgacagagcgaaacuccgucucaaaauaauaauaauaauacgucaaggaacuguugcaaggcuuaaggagguaauauguaaaguucaaaauauggcacauagcuaauacccaguauuuaauaguuauaaaaugaugaacgauuguaaagaaacauuuuauuucaauauuaaucgaugaacugauacuuugagcauuuaauaaaugcuagucuuuaauaaaugauaagucuuuugggaaaaguacuuguccaguaaguaacugauuaaaaugacauguuucaguuuaaccuauuauugaaagcgcaaguguuuuauuucuuuuuagauaaaggauuuaucuucagacacacuucuccaacagcauggugauuuggauuuggcuuuggauaauuguuauaguggagauacaguaauaauuuuuccaggagaauaucaagcugcaaaucuugcuuuguugacagaugacaucauuauaaaggguuagcagggcauccuuuguaguuuuuuuuacagcaauguauacuggacaaauuguguauucuaaacaugcuuaauggaauuauuggaaauuacaauagaauuuauguuuuacaaaaauccuuuauguucauuuuauaauuaagacauguucgucauauuuucuauagcuccauuuauauuuuuuacccaaagcacuuuuuucuuaucuaucuuuacugcuuuucacaucacuuuacuaaggaaaacccagauguaaagcuauguuaaaauaugcucaucauuuucucaaaaaggcuaauaucacaugcuaacucaccaaaacagaaguagaaaagcagaauuuacuaaauuuauuuuagguccugaacauauuuagaaacuuucucucuuuuugacguugaaguaagaguauucucauugucuaaccaacaacaacaacaacaacaaaagcuggauauggugccucacgccuguaaucccagcacuuuggaaggcugaggcagguggauugcuagaguccuggaguuugagagcagucugggcaacauagugaaaccccaucucuacaaaaaauucaaaaguuagcuggaugugguggcacacaccuguagucccaguuacuugggaggcugaggugggacaaucacuugagcccagguugcagugagccauaaucaagccacugcacuccagccugggugaaagagcaagacugucucaaaaaaaaagaaaaagauuacacuauaguuauguauguacuauauauuauuuguuaaaaauaugugaagcugggcacugugcuaugcaccuguagucccaacuuacucaggaggugaggcaggaggaucacuugagcccaggaguucgagacuagccugggcaacauagcgagaaccaucucuaaaaaugcgcaugcgcacacacacacacacacacacacacacacacacacacacacacgcacacagggaaaaacuuuaguaacagcaguauuguugaaugacaauaaagggccuuaaaaugggagauuacugauuuaauguauuuuuaucccuaugaaucaggaguuggaaagagagaggaaauuaugauuacuucugaaccuucucgugacaguuuugugguguccaaagcugacaaugugaaacuaaugcaucuaucuuugauacaacaagggacgguugaugguaucguggugguggagucuggucacaugacucuagaaaacugcauauuaaaaugugaaggaacaggaguguguguucuuacaggggcugcuuugacaauuacagacagugaaauaacuggcgcccagguauuucauucuuuaaaaaguauggccuuauaugacuauagaugacagcuuugagugaucuuaauauacaaauaaaggguagcaauuucuucaucuuuuaguggaauucuaauuaaacuuaguaacugguagacaucaacaaaaugaguacuggagugucauaguacauuuaggaaaaaugaaaugcuagguccaaaguaaagaauauuuagcuuuguuuuauaagggugacuuuuuaaaaucuggaaaagaguggcuauaacauaaaucaugagucagucauuugauaguuuaaagaaauaagacauguaaguuaucagauguugcuguuagguguugugauuaguucuaacagcuucugaauaaucaggacauaaaaaacuugaggccaagcacagugguucacuccuguaaucccagcacuuuaggagcugagacgggaggaucacuugagcugaaguuugagaccagccugggcaacacagaaagaccuugucuuuaacaauaaauaaauaaauaauuaaaaauuaagagcuugagucuuuagauaacaaucacaaagaucauugaaggacuggagaacugaaugagaaaaagaauuaaaggaaguagaaaaauaagagcaucuuuuuaaagaauuuuuaaaauuuccacuaaaaugaagaaauauacuuuaguggcauuaagugggauuuacaguagauauaaauuuuuauaacuauugaaacaauugcuuaaagaguggacuccuuucuagagaaucauuuggguggaagaguaagauaauggauuauaugaccucaaccuucuaagucuaaugacucucuaacagauauuuaaauuuucaauauuuuuaaauauuaucuuuacaauuaacaguugcaugcaugaucacguauuugcacguaacucaauguuuauagugguaauacagaauuacgauuuucaagucuaaagauuuuggagagagguuuguguauauauuuuguagauaguuuuauuugcuuuuaauuuacagggugcugguguugaacuguauccuggaagcauagcuauuuuggaaagaaaugaaauucaucacuguaauaaccucagaaccaguaacaguucaaaaagcaccuuagguggaguuaauaugaagguauucucuuauuucuugauguagcauuguuauaagaauuguaaguaauuauaaguacuaaaauauuaguuuuagucuuaaaaggcagucuacauauuaucauugauuuggaaaagaauaguacaaguaauaaaauaugguuaaaugauagcugcugggaaauaaguuuagccuuauaauuuaauaauuuguacuuaaacucuuugcaaauaaccuugaauaugagaaaugggauagauuuuucucuuaaagacauuuuagaguuuucuuugaucagaucuguaauacauuuugguauuucaaauuacaaaguaaagcaaauuaagaauaauaauauauuaagaagcauuugaagucuuacuuucaaaguuguguuaaaugauuuaagcuaaccaauuaaaacauuaauagcaauaauuucuaggugaaaugucuuccauccuuucugcuucuauaaaucuugucuuucuaagucccucucuaggcuuguguaguuaaugaacuuuuauguuagugaaguuuuuucuagaacauucuaacucuuuguuuuaugaauguacauuuugucuccucaaauagauuacaaauuaucuaagggaaggaauuguauuauauauuacuaguagccucccacucucuguaugauucuggacacuaagucagauaauugguugaaaauaagguacaaggccaggcacaguggcucacaccuguaauccuagcacuuugggaggccgaggugagcagaucacgaggucaagagauugagaccauccuggcuaacauggugaaaccccaucucuacuaaaaauacaaaaaaaauuagccaaccgugguggcauaugccuguagucccagcuauucaguaggcugaggcaggagaaucacuugaacucgagagguggacguugcagugcaccacugcacuccagccugggugacagauugagacucugucucaaaaaaaaaaaaaaaaagaaaaaaaaagaaagaaaaaagaaaagaagguacaaaugguaaauagcaguuuuaaaaucuuugauuuaucuuuaaacauuuuuucuguucuuaaauauuuuucaguuuuucagugguccuugaauguuagcaugcaucagaaucauucuugcagaggcccacucugcuuucugauucaguaggccuaggguaaagccugagaauuuguuuuaguaauuuccuaggugaugcugauacugcugguuuaacucacacuuuaagaaucauauuccugauacucaaagugugagccauggaccagcagcauuggcaucaccugguaguuuguuagaaguggagaauuuugagccucacgccagaccuauuaaacaaaauguggucuuuaacaagcuccccagaugauauauacauacguuaaaauuugauaaacaugguuuauaaaaucugacaagaucuggccccugcuuucuccaacguaaucuccuuccaaucuuccucuuauacauuauauucgagccacacuggcuuuguuuguguucccagaaauuauuaaccuuguucuggcuguuaccuucaccugaagcacucuuuuuuuucuuuuuugagauggaguuuugcucuuguugcccaggcuggaguguaauggcgcgaucucagcucaccgcaaugucugcaucccagguucaagcgauuuuccugccucagccuucuagguagcugggauuacaggcaugcgccaccacgcccagcuaauuuuguauuuuuaguagagacgggguuucuccauguuggucaggcuggucucgaacuacugaccucaggugauccgcccgccucugccucccaaagugcugggauuacaggugugagccaccacgccugaccugaaacacucuuucuauagaucuuauuacuaucugaaugugguugucccucuucaaagaagccuuuaauguaaagaacacucaagugguaaccucuccccacccagucaugcuaucacauuaccuuauuuucuccaaaucacauauuauuugaaauuacuuauuuucauguuuauuauguuauaagagaucagcuucauggguuguauugccauacagaauuaguuguuuuuaucaauaacugauaaaaguaaauugaaaacuucauuaaauauuuucuuacacuuuuuuuuucuuuuucuuuuuguggagaauagggucuugcuauauugcccaggcaggucucgaacuccugggcucaagcuauccuucugccucugccuucuuaagagcugggauuacagggcaugagccaccgcaccuggcucauuuaauauuuuguuauuggcugggcaugguggcucacgcguguaauuccagcgcuuugggaagccaaggcggguggaucacgaggucaggagcucgagaccagccuggccaaaauauugaaaccccgucucuacuaaaaauacaaaaauuagccaggugugguggcacgcgccuuguagucccagcuacuugaguggcugaggcaggagaaucacuugaaccgggaggcggagguugcagugagccaagacugugucauugcacuccagccugggcaacaaagcaagacuccaucucaaaaaaaaaaauucuuauuaaauauuuuuuguaguuaauauuacguuaguuggugucaugaaaacaguacuuaacacuuguucaaaauugagagucuugguuguuuuaaaaaaucuguuaauccaagaauaaagucuaagcuaauuuuuauauguucauuacuucauuuuuuaaauaaaaucauugaaaaacuaauuuccucaaauaauuuaauagguucuuccagcacccaaauugaagaugacuaauaaucauauuuauagcaacaaaggcuauggaguaagcauucuucaaccaauggaacaguuuuuuaucguagcagaagaagcucucaacaaaagggcuucuucaggagauaaaaaagaugauaaaaugcucuucaaaguaaugcaaaaucugaaucuggaaaugaauaauaauaagauagaagcaaacgucaagggggauaucagaauagucacaaguuaaagcgucugaauugauguuaaaguuuuauauuucacaaauuuguuuaauacaugauucucauaccccacugaaaugguaguuucaauucaaagcuuaauuaaaaaauauuuaaauauca

SEQ ID NO: 191149 - RNA, 2500 nt, Homo sapiens
uucagaaacaaguuacuggauuuuauuauaccccaaaacaaggaagagagugggugcauuacuaaggcagugacucaguguucaggacuguuguugucacccagagagauucacaaaaccuccaaccuguccagcaauacauuuagaagaaacaggauuagggaagacucuggaagcaaagaaggcuuuauuaaacauaaccaugauccauagcuggaguauacauaggaaauuugguaacuuggauaaggcaaagucuuuucccuuuaggagccuguacuuuagugggugaggaagaaccuucugaaagaaaaugauuucagcagcaguauaaaagaaagugggucaccuguaugagcaaacuaacaaagcagauuuaauguaagugcccaagaguuccaaaacaagggaaucaguaagaguucuggagaaggccaccuuggggauacuuggugcgguguggggguggauguagguuuauucugggaaucgaauaacaugguaaauaugugacuguaggaugacuggcugugauuugcaaggaaaagaaauuugcaaagacccaagaaugguaucugcuaaauugcaugugcaaggguggucauggugaaaaggaaaguuugggcuagaauaagaguaauaaaaugagaagucagggaaguaccaagcauuugaaugcuauaaaaaugcuauagcaguugaauucuauacaaauuuaaauuauggaaauuugaaauguuauuaaguauuuaaaaagucucacuuuauauguaaaguuugaaaugaagccaauucuugaaagcugcggagagagaaggaggcaaagcgagcauaauuucagccuguaugaauuaauuauaaauucuaucaugcuauuuccacaugguggcaccacuuuggugagcacguaaaguacccacuuuucuuuaucaagaugagauuugaauggguccaguuuugaguugugagaagucuuuauucccucagguaaaaggcaaucccuugugccugaugacgcuaaugacagcauaacugcuagacucuguucuccucccuucacagcucuuccuuuuguugcauucucuucccccaguggcuuuucuugcacacuaagaagaaguguucuccucguccuuuucccucccucccgcaaaucccaucagcgucucuuucucaaucccucuccccuuaucuucucaguaauuagaggcucagggacagaaaaugcaccagcacgggcaugguggcaggcuccuguaauugcagcuacucgggaggcugaggcaggagaaucgcuugaacucgggaggcggagguugcacugagcugagauugugccauugcacuccaggcugggcaacagagcgagacucugucucaaaaaaaaaaaaaaagaaaagagaagaaaagaaaaugaaccagcagacgggaccaacugcuagccuucaaggccauuaccuuuaccaaggaggguaccaugcucguggcugaggagccaacaggaggaagaugagguggacgaugugccagccacuguaggcccugucucagggggagcucuuuggaaggaggagagccugguccucuuucucugacugcuccacuuccuguagcaacuuguagagggguccuggagugcuugcauaauauggagcuucuuugggcccagucagcuucaagcugggucugaaacaaugauaccaaaaggaagagaagccauagauucccaacaggaaugaggcauugaucaucacaugccagcagaagaagguggugacaaacaugaugucacugaugucaucguccugccauggguagccagagacgggucuguauagaauaaagccugccugcaucagccaggagcccaucaucagaaucagaaaggucuccaucagcuggagaugacacauguugggagcccacagcucugcagucaacaccagcaacagcaggaacaccaccaagaugagcagagaauaaacgugcagcuccaccccuucugaaucuuuaacaugugacaccaucagcagcaggagcucguagaugaucaggaccaggguaccuuuuucuaggcccacacaccucugaggcagcacauucuugcucaugaaguccacacagccauuaagagugaggaggaugaacauggugaggugcugccacucuuugggguacaugaaccuugauggcacuugcuuccucaugagcaccaucccgccaucaagacagagaaccacauaaaauguuaagagggagccagucacuaucuuuaguaauccuccauaggcuauuuuccacagccuggcacaucuuugcuuauuccugggagagcacaaaggauacaggagacaaccuuugaguaucaugcccuuggagaccacuguggccugauauaguccauaagagaaaagaaauagccccaguuaaaaauggccaauggacuuucccauggaauacaggccuguccgacugaagcgugaagagcaauacucaggac

SEQ ID NO: 191150 - RNA, 214671 nt, Homo sapiens
uucccgcgacuccgcucucaccgcuacacuaccacacaaacggccuccuucccccacccccgggggcccaucccgguggcgggcuccggagcucgggacugcuaauuucagcgaaacgauuaaaagacgccccuacagcugacggcacuuucucuccuccggcagggaaggacguccagcguagcgucgcccgcgcuuccccgccggcgcagagcaggccucacagaaucgcacgccgcuggcacgcacgccgccccgcccccacggcccagcgccagccgcgccccgcgcucgcacgcaucccggccucacugccccucgacuccuguuccguuggaggggccugaggcgagccugagcgcgcuguuggccggagggaagccggaggagaccgggucgacugggcagagcggcagagggucgaggagccugcucugcacgcccagggaguagaagugggcagggagcagggucacgugagggagcgcgccgcgacugagcuuggguccgacuggagcucaggcucgcgacccagacuggugggccaggccuccaagccggccuuacacccaauccaaggaggacagaccggacacagagggacggagcgagcaaggagacauggcuucaucauuccugcccgcgggggccaucaccggcgacagcgguggagagcugagcucaggggacgacuccggggagguggaguucccccauagcccugagaucgaggagaccaguugccuggccgagcuguuugagaaggcugccgcgcaccugcaaggccugauucagguggccagcagggagcagcucuuguaccuguaugccagguacaaacagguaaaguagcagggagaggguggaugggggagaaagacacggagccuucuuccucaacaacugauagcaagcauguaugguuaauagcuagguguaaugaagcuuguguauguguauuuuguuuuguuuuuuuuuuuuugaccaucugcuggggaugagcaucauccugaacguggaaaagauguuugcuuucuuaggagugauguuuauuuagcuggacacuggacauuguuuuuguguuuuuuucucugacuuauucagugaucuugcauuuuaccagcccaagaaccuuuacaaaaugaggauaaaauaagauauaucauucauuuacucuuucccagagggccacauggaaguaaauacgguaaaguuaauaaaacuauauagagauccaaaaagauaauaggauuguaauaaugugaugcagggcugggcgugguugcucacggcuguaaucccagcacuuugggaggccgaggcgggaggaucaccugaggucgggaguuggagaccagccugaccaacauggagaaaccccgucucuacuaaguuagccgagcgugguggcgcaugccuguaaucccagcuacucgggaggcugaggaggcggagguugcggugagcgaagauugugcgccauugcacuccagccugggcaacaagagcgaagaaacuccaccucaaauaauaauaauaauaauaaugugaugcaaugcaaaaugcaguauuacaacuuuuauugugauuuuuauaaaauccuaaauaucuuugauuuauguuuucguugaguaugucuuccuuucuguuugauacaaucuaaaaauuuuagagcuaugaacaccagaggaaauaaugcccuucuuuuacaguaaaggaaacugaaggccauagagaguaggcaccuuuccuagggucauacaaauacaucagucagaacuggauuguagcuccugacucagucuaaggcugugaacuuuaccuggaaauagggagguguauagacacguuuaauuuauaauucagggugacauugguugguaccagaaggaaaauaauugcuuuaucauaagcaacauauauuuguucagcagcuuuuaugugcaagacacuuggguauaaugccuacagagaaugcagagaagcaaaaacaucaugacacuuugcagagaagcaaaaacaucaugacacucacuuuuuuuuuuuuuuuuuuuuuuuacagagggucuggguuucaccacauuucccaggcuggucuugaacuccugagcucagacgauccaccugcccaaagugcugggauuacaggcaugagccacugcaccuggcugacacuuuuuuuuuuuuuuuuuugagauggaguuuugcuccuguugcccaggcuggagugcaguggcuggaucuuagcucacugcaaccucuaccuccccgguucaagcgauuguccugucccagccucccgaguagcugggauuacaggugccugccgccaugcccaacuaauuucuuguauuuuuagaagagacgggguuucaucauguucgccaggcuggucuugaacuccugaccuuaggugaucugccugccuuggccucccaaagugcugggauuacaggugugagccaccacgccccgccaacauuugcuuuaagagacuuaaaguacuugaggagucuagguuugaacauaccugaaaaauugcugacaagaguuaaauaacaguucaggaaaauuacagcucuuugaaacacuagaggaaaggaaauucuggauaauagccuauuuuguuuuauuaaaaauguguaaacuuuuuuucuuuuugccucuugacauaguuacguauuuuccccuguauuuguuaaaggaaaaauaaguugggggagagguccugcuguguucuuuuuuuuuuuuuuuuaacuaaaaaaguuuuuuuagagacaggaucuuguuucguugcucaggcuggagggcaguuacacacucauagcucacugcagccuugaagcuucuggcuucaagcgauccuccugcuuacgccuccugaaguacuguuauuacagacaugaucccgcaugcccagccccacuguguucuuaaacuggauguacugaguaaaaaugaaccuuguuuugaagguugauggucauuauuaugaauaucaguuaaugugaccugagagagaaagcuguaggaacaaaugguauaaauuauagugucgaaugaaaauuaccuccaaauuggccuuggaauuagcuuucuuggaaaaguuguagauaucuguuuucucuuuggucauuuguuauacuuuguccuaauaacauuagagugaaacuuuugauuauuuaacaaauauuuacugagaaucauauuuuaggaccuguaauaugucugaugauucucugggcaguaugagacuaauuuuccccaaauucccuagaaaauauuauuuuucguucuaggacauaucuuuguuuauugauauuggugucauuauuaaaauacuauauuucuaagucaucagugaacuguagucaccuaucgacuugggaaccauuuugucucagguauacucacuucauccagauaauaugaaggagggaugucccucauccuuucaagaacuugacuuuaugguguuuagagauauucuguaucugaaaauaaaauucugcauuguuagagaauaauaugcuuacuuauauaugacacugggccgcaguuuucaucaaucuccuaaauauuuuugacaaaauugugagauaguguuaagaauagcaucuuugauagaauaauaaaguuggaaguccaauaucauuucugcauauuggaucaaaauuuauaaaauaacguuuuguauucagaauagcacccuauuuuguaggcuggaugagguuguuggcaggaagauaauaaaaauaagcugaaauaugaaccuuauuuucucagggagaacucuaaacuuagcaucauagcuuuauuagucucagauaagccuauggcuucagaauaaucuuuuaauaaaguuuuaacaaaaucgaaugaacaauuuuuugguccuucuuuacaucagccuacacucucccuccuaaagauagcuaauugacagcugugaaaacuggagaguaaugaaaauuugugaauuccuguugacuucauaagauacuguuuaauaauacuuuuuuuuuuuuuuuugagacaguuuugcucugucauccaggcuggaaugcaguggcguaaucugggcucacuacaaccuccgccuccuagguucaagcuauucucuugccucagcuucccgaguagcugugauuacaggugucugccaccgcaccugauugauuuuuguauuuuuaguagagaugggguuucaccauguuggccaugguugaccaggcuggucuccugaucucaggugauccaccugccuuggccucccaaagugcugggauuacaggcaugagccaccgugccuuaauacuacuuuauuaaauauuaacccuugagucaagucuuacauuuugugugaugagaugggaaguacacacaaaguacuucugcugcauacugaauuauguuaacuauuuugaggaaaagcacuuguguaauuucugagucgcaaaaugaacuauauucuuuuccaauuuuacuuaacagaacaacucacagauaauuauaccuacucaaauuuggguauuuggcagguaguuucuuaaaaaugaacgaaauaagccugucacuucaaggaaaacaacucaaaguguuuguugccaguaauaacauuugaaccuucaagugaaaaugagaaauuuggaaaaucuauaucugccaccaugagcuugacagcuucccaguacuuaaaaacuuuuuuugaugagauaaguggugacagucaugaaugugaacguuugcuguuauaucaugaaaugugucaacauuugaaaagucuguguaacucaguaaaccauauuuucuaaauauuucauggaaugauguuacaaauuauguguugguaaaagaugccuuucaaagugcaagucagaccaauggauuucaguguuaacaguaugaaaaauucauugauaugaguucagauuccucguugcaacugaccuuaaacuaccaucuguuagguuuuggcauaguaucaaagaagaauaucuacaauuaucugaaaaugcugcuaaaauacuucucucucuuucuaacaacauaucugcgugaagccgaauuuucuucauauacuucaaccaaaacaacauauugcaguagacuggaugcagcauuagauaugcaaaugcaacuggcuucuacuaagcgagacauuaaaaaaauuaaaaaauguaaaacagugcuacuuuucucacuaauuuuuuuuagaauauguaguuauuuugcaugaaauguuauuuauguuaacaucuaauggguuuauuauuuuuaaaugaauuaauacacauuuuuuaaaugucccaguuuuaauuucuaaugugguaaauaucgauagauauaacccauauaaaugauggcucuuuaagauccuuaauuucugagaguauaaagggauuacaagacuaaaaaaauugaaaacugcugcccuaaguuccuuuuucauggucagagguggcuuaccaucaccacauguauauccuauccagagcaaagggaaaggggaagacaagcuccuuuucuuuuuaaggaagguauuuguaucacuuuuccacacauccaguccccagaaccuaggcagaaguuggauggccauguauaauguuuagccggaugaucauguguccagcugagacuucuguuacuauaggagaaauggagaacuauuggcauuuguuucugccacuggauagugucuggauaaaaaacaaaaauaguuauaauugcuauuuuuaugucuuaaaguuuguauaauuuaucucauuuauuauuucuaacagucugguaguucaugugauuuuagagaguccagaauugaagcccagacucuauuuagcauuuaagacagaaugauguaguaaagggauauugagcuuuggagucaaacacucuuugauuuaaauccggacuacuaauucaggauauacuaaugugugaacugagacaacccuccugagcuucucucuucauuuauaaaaugaguuugugauggcauaccuagcaggauuuuuuuuuuggcccauuugagauaaaauaugugaaguguuuggucuaucgugauuguucaagaaauguggcuccuucuuuuucacccuuucuucucucuauuccaucauaacagggcugcuucuauguaaguauacauuuuaauaacagcauagggccaugcaauuaaucgcuaagcaaaugauagaggugguaauuguuaugaauucagagguagaugagaucauuguagacugaaaggguucuuagaaucugaaauuugaguagaacuggaaggucgugcagcaucuugaaaagcugaggaaagaagaaaaggcauuucaggugaguggaguaacaagcaaaacccugaacuaggaauaccuaaggcagucaguagaucauucugguuagaugaaggcaucaguuagaguaaugggaaacagugggaaaaucccugagaaguagauagguucuguggaugaguuaagaacaguuacaggcucuauucuaauagaaagaugagacuuuacacaaaacuuucuaaacacaugguagaaaaagugaaaaguaccauaaaagauauauagaguaaaugcucuaagaguucauaaggaaggaagaugacuucuggcagugggaaucagggccuguauagugaauucugcacuugugugaauuucauuuaugcuuauucuuaaugaaaauuucacugugcaguuuaacuacaaaugucgguugaggauuaaaauuaaguauugaccucaaacaaaagaugauaagacuauuguagaaaaacggaauuguauuuuugagaacccaugaaauuuuuugcauggcuuuuggcauccaaauuuauauugaugaauuucauaauaggguacuuuaaaaguaguacacuguuuucccuggaauuuuggagaguuaaaaugcuaauagcguuaugagaaucagcaugaagaaacaguguuaugaauucugauaaauuaugaauucuaaaccuuauuaauuucauauuaaaaauucuuuuacuuuauacaugguaauaaagaguauuuaaucuauauugauaacuugucuuauauauagucuacuaacuucgaagugcaaccguuuaucacaguuuuucuguauuacaguauuagauaauaguuguuuuaugcaguaagccaaaguaggcuguauguaauguuugauucuguuugauuguuuuuguuugcuuuggcaaagaauguuaaauuuugcuauuccauauagaugcaaauauuuuccaaccuaugguuacugaauauacauaauacauuugaaaaggaaaaguuucccagacauuucuuugaaaaauaaguucuugauuuuccuucccucauuuaggucaaaguuggaaauuguaauacuccuaaaccaagcuucuuugauuuugaaggaaagcaaaaaugguaagaaauuccuggaaucuuuaaugagguuguuggaaauggcuuagguguuuaggaauuagaaagcagugagcugauuaaagaauuauuuuuauauuaaucucucucucugcuguagauuguacuaaugacaggcaauugggagagauuaaagaaaucuacuuuuagcuaagucuccugaaggauucuuaugcuagcauguuggaauauaagugguucacaacagacauacaugccuuacauuuuaauaccaugagagcuauugcuugagauuuuccuuuccugucauucaaccccuaauggaucaccacuucuccccucuggagggauuuuuggaagaaggccagaaugaugggaagggcagaagagcaggauaaauccccauuuuucacccaucuuccuugucccaguuuuaucucccugucucuugcuacuuacucuuguguuccuugccccacccaugccacaguaaauaacugcuuauaguacucuugggaagaagggaaaaauucagugaaaagccaaaaccagauacuaacuucucuuuuucucugaauauauaaaaaaaagaguauacuuuugcaaacuuuuuuaacuuauaauucagaaguucccccuugucauuuaugagaccuuaucuucucuuaccuugucuaagugaaagaagagaaauugcauacaacugggaaucuuaguuauagaagggaaggcuuuggagcaucagcccuggaauuaagguuagaagguagaguuagaaaagaaaaaagauaaaauaugguuauagagagaggaagugauaaaauauggguucuuacuuuacauucuagagcagucccacauaaaaucugguccccuggauacauuuccugccugccaacuguuuguuacccaacuguuaggagauacagagcuugaacccagauauaaaucacguaugucacuaaccacgcuguuuaguucagcugauuuuuuuuuguauaggacagucucagugaaggaagcagugcauugauuauauucuugcacaaguuuuuugguugaugauaaccagccaacauauuauuacuguucuaaagaauaccugauguuaacguugacagugaguuuuuuguuauaauuuaugaaauuuuauaccuuuauuuuuuucugugcuuugccuguuucuccauuguuuuuagcaauuaaaaaauuuagauuuuauagccaccauaauaauaguuuaugcaagaacaucaacgaaugauuaaauauuagaugauaaaauauuggggaacuguuagagaaaaacuauugaggaaaauuuuuguuaaaaugcuaggugaaaaacuauuggggagcaaaaccguggguuacaggcugacccaccauuuacuuuuuaauuaugagagagaaaccugacaguuacugccguuaccaaaccaugaaucuuauugaugaugggacagacuaacaucacgugcccccagugugaugcauugaaaagggcaugucaccuauauauuacucugcugaaauaauuuaacccaauucuaaucaugauuaaucauuuuuggcaagaacacuguagguaaggaaacaauuagacaaauucaaauugagggauauguuauaaaacaguuggacucuuaaaaaauaccaacaauguggaagacaaaaaagcugaagauacaugaaacucaaugcuguguguggaucuugauugguuccuggugugggagaagaaagccauaaaggacauuauugggacaaucaggaaaaucugaauguauagccucuauauuguauaauaguaauugaugauaaauuuccugaguuuguguaagcugaucuauuuagggaugaaguguuaugaugcguauaaguaauucuuaaggaauucagugaaaauaaauuuagaaaaccucagaaagauauuauauucaucauagaagcaggaagguagugaaaaaaugugggauugaguucuguuugacagcaaaucagggaaaucgagaaacacugguuggaauuuagaaagaauuggcagggaaaaaccaagaagaaggccuguccuggcagccuguugugggggcagggggguagaugacccaaaaggaagcucaggacuaaaauguugcuuuugccauuuauauuguaggaagucccuaacuuacucauuaguauucuuuaguugcuguuguuguuuuuuuuuuuuuuuuuuuuuuuuuuuuuuugagacagaauuuugcucuguugcccaggcuggagugugguggugccaucucagcuuacugcaaccucugccucccagguucaagcaauucuccugccucggccuccagaguagcuggacuacaggcgcacaccaccacgccuggcuaauuuuuguaucuuuaguagagaugggguuucaccauguuggccaggcuggucucaaacuccugaccucaggugguccaccugccucagccucccaaagugcugggauuacaggcgugagccaccaagccuggccaguauucuuauuucugcccucaccaucccuuacuuuugaagucccagacuaaguccccaggaucaguuacuagaagcuuauagaugagauaacagcagaaagggaagguggauuucuuguaucuuaguaagaaguuugaugcauuuuccuugggaauauuguuuuuuaugugaugauuaguuucuguacgaccaaaaugccauaagcacaguuaauuuaugagaauaaucucuauuagucuguagaucauauauccucaauaggggugaaauuuuguuugaggaaauuauaaaaucuuagauuacagugguuuguggucuuucaaaauuuaauagcuaugcauuguaucuguguuuuuaaaauuucacggggaggacgauuaggaaaaaaaaugucugaaaagacugcuuagguagggcaauaaggucuguauagcucuagaccaauguaaaugcaaaaagacagagcuucucuauccauagcuuauuaucucuauauucagagacccuugaaaugugcauacaguuuuuuuaauaauaagaaaaaugcuguuuguguuauuugcauaaugacaggccauuuuggauauuccauauuguagggaagcuuggaaagcacuuggugauucaagccccagccaagcaaugcaggaauauaucgcaguaguuaaaaaacuagauccagguuggaauccucagguaagacuuaaugauuauaaauaauacuuuccaaaaacuuaugauccuucucugaaauaaaugucuaaaacuaaacuuaguuuuaaguaacaugcuuaaaguuuuacuuucuugaaauauuuuaaaguuauuguaauauuuaucuaauaaaauaauugcuggccaggugugguggcucauaccuguaaucccagcacucugggaggccaagccaggugguucaccugagguaagaguucaagaccggccuggccagcauggugaaaucucaucucuacuaaaaauacaaaaauuagcuggacguggugguacacaccuguaaucccagcuacucaggaagcugaggcaggggaaucaauugaaccugggaggcugaggcugcagugagccaaaaucaggccacugcacuccagccugggugacagugugagacuccaucucagaaaaaugaaaaaaauuaauaauaauuacuuaaauaguaauauaaccagcuacugaugcugagaacuucucugaguugcagaguuuuugaaagcagaaaaauuugaauuacauaagaauuggaaagaguuuaacuugagauuaucaugcuggaaaaaagguuacucuuggauuucguuuuuaugaucacuuucuaugcaagggcaaaaugcuuauuagggauaaaagaugaauaagacaugauuucugccauuauguaguuuaaaguguaauagagaagauaaaacauaucaaaauauauaucuuuaauaguauaaaacaauaauaauguaaaugcuagggaauccagcaggaaaagggauugcuuuggacuuuggaagcauuggauauuguucacuuaaauauacccuguuuuucucauauacuuauuggagaacaucuagaaagaauuuaauaaaggugagguuacuauuuaagaauauuguuaaaugauuaacagguauuucagugagauagagguugcauuguaccauguaaaaaaugcaaauugaauuuuuuucaauaaaaauauuaaggccaaacauuuuagcaguuaaugaauuaaacaauuuucaguguuuuuguaauaauuacauaauuucauguguacauaguuguuacugguaugaaggaauuuguuccauuaaucauggaaucuuaaaaaucucagacuuguuaggaacuuuaaaagauuauauauuaugacauauuaaaaauguaucuuaagaguacaaagugggagugauaaccaacuuuggauaucuuuaaugauaugacugccuuuuagaagucauugaaaaauguccuuuuuuuuuuuuuuuuuuuuuauaugagacagagucucacucuaucacucagacuggagcacaguaguaggaucuuggcucaacguaaccuccaccucccagguucaagugauucucccacuucagccucugggacuauaggugcacaccacuacaccuggcuaauuuuuaaauuuuuuuucuuuuuuuuuuuuuuugagacagagucucacucugucgcccaggcuggagugcaguggcgcaaucucggcucacuguaagcucugccuccuggguucccgccauucuccugccucagccgccugaguagcugggacuacaggcguccaccaccacacccgguuaauuuuuuuauuuuuauuuuuaucuuuaguagagacgggguuucaccguguuagccaaguuggucucgaucuccugaccucgugaucugcccgccucggccucccaaagugcugggauuacaggggugagccacugcgccuggccucuuuuuuuuuuuuguagagauaggguuuugccauguuggccaggcugaucuugaacuccugaucucaugugauccacccgcuucggccucccaaagugcugggauuauaggcaugagaaauuuccuuauguuucugaugugcaugagucuucauuuucagaaauuuucuauuuuauuaucuuuuauaagacaccaaauaugcauacaaauauguuucucaagguucugagggcuuaaaaucugaaaaucagugcucaaaacaggugcccccugagcugaacucagccugaacaacuguugcacaauguuuagaaaugaaacaaaacuugaaugugagugccuuuaggcagaguauuuuucagguccagucacuguguucucauccuucccuguugauuuauacuacacuauuggugaugcuuggccuaugaaggcauuuuaguuuauaaauucugauaaaagacagaauuuaugauuucuuaccuucaguacuuuaguaaaauuuuguuaacuauuacucuuaaaaugcuugcaggccaagcacaguggcucacgccuguaaucccaacacuuugggaggcugaggcggguggaucaccugaggucaggaguucgaguccagccugaccaacauggugaaaucccgucucuacuaaaaaaaugcaaaaauuagccagcaaugguggcaagugccuguagucccagcuaugcgggagccugaggcaggagaaucgcuugaacccgggaggcagagguugcagugagccgagguugugccauugcacuccagccugggcgacagagcaagacuccaucucaaaaaaaaaaacgacuugcagauuccaaacagguguugaggaugguuuuuaaaaaugucuaaaucuaaccuauugaacauacacuugaguaaaccaagcagaaccaaaggcacuuucauauucuuuaauuaauuauuuaauacauuaaauaauaaacuuuaaaaaauuaauauauuuaauacauuaaauaacauuaaaagaauauauaacauacuauucuaaaaguauuuuaacauuggaauccaguuguaaggaggaauuuuauuuuuuauuuacauuuuaguuuuuaguuuaaacacugagcugguccccuuugacucauagcuuuuuuuuuugucuuuacuuuuaaacuguuaggaggcagaucauaaccuccaucucagaagagauuuggcauuuaguucauuaucuuuuagguuaaauaauaauuuucuuuugauauucuaaaaaauaaaauaaaauaagaacaacacucauucugaaugugcugaguuuuuuuuuauuuuuuugagauggagucucucucugucacccaggcuggagugcaguggcacaaucucagcuuacugcacccuccgccucccagguucaaacaauucuucugccucagccuccugaauagcuagcaugagccacugcaccuggccugaaugugcugaguucuuuacauguauugucuuuugauaucuucacaaaaagucuucacaguuagaaacuacuauaaucugcauuucaaaaacgaggaaauucagacacagacagauuuaguaacuugccuaaaauuagccagcuaaggccaggugugguggcucacuccuguaauuccuauaauuugggaggcugaggcaggaggaucacuugaggccaggaguuugagagcagccugggcaacaaagcaagaccccaucucuauuuuaaaaaaagaacaaaaaaauuagccaggcaugguggugugcccuguagucucagcuaccugggagacugaggugggagaauccauugaacguaggaguucaggguugcagucagcuaugauugcaccacugcacuccagucugggugacagagugagaccccaucucaaaaaaaaaaagccaacuaacaaaagauggcacuggauuuagaccuauauuuauaugaguccagagcccuguuguuaaccacucugcuaucuguucuacagcugauauuggaaauauaucuauaagguauaaacuuaaguguauguauacguguaaaaaauucaaggcagcuauuuuugucaaagcucugugguaccuugagguauaaaacaaugcuuuaaaauucaucuuuaaaaauaacuauguuuucuguuauguguuucaucuuaucucaagaauauguuguucaaugucuacuauaauuaaggcaauuauuuugccuuuguuuuggggggaggauaaguuuuuuuuuguuuuguuuuuacaguuucgaauaauauaaggaacuucuguaaggccuuuauccagauucacugcugguuauauuugcuuuaucauucucuuucuuuacacauagacacacauguauguaacacacacacacacacaacacacacacaaauacauuuuuuccgaauuguuugagauaaguuggagacaucauguuccuuuaucacugguucaggauuuuuuuccuaagaaaaagaaccuuuucuuaugcaguggucccuccuuaucaggggauacguuccaagacccccagugaguaccugaaacuguggcuaguacuaaccugauugcuaucaguuggaaaacauuucugugcaugucuucaauccacaaaguaaauguuuuugucuucuauacugaguacuuuuguugcauuauggcuguaacuuuuguaguuuaaggugugacaggaaaacuagcacaaguuuuuuuuucuucacaauuucuuggguagaagauuuguucuuacuauagaccuuaguaaccucagcauaugauuuuuuucuuuccuuaaguugagaacuuuuaccuuuucaccuaaaggaagcaauuuauggcuucucuuuggcacacugaauugccauuaucacaacucuuguacuuuggggccauuauuaaguaaaauaaugguuacuugaacacaaacaugguacugcagcagucgacagucgaucugauaaccuugaagggaacuaagugacuaaugggcagguagcauauacagugcgacuauacuggcuagacaaaaggaugauuuguguucuaggcgggaugcaguggguuggaguggagggcgugagauggugugaaauuucaucacacugcccagaauggugcacaguuuaaaacuuaggaaugguuuauuucucgaauuuuccauuuaauauuuuggguuggcaguggguaacugcaaugguggaaagugaaacuguggauaaaggagggcuacuguauaaguauacuauaaugaucaaaaucagcaauuuuaacauugauuuaguauuuucaagucuguaguccauauucaaauuuaucauuauaaugauaauguccuuaauaaugcccuucauaauuauucuucaaaugcugauccaucuucuaacgcagggucaugcaucguauuuaguugucauguaucuuuagucuccucuaauggagcaguuucucagccauuuuuuuuucccuuucuugcccaugauacuuuugcagauuacagaccaguuguuuuguagaaugucccuuauuuuggguuugccugguguuuccuuauaauuagauuuagauuauacauuuucaagaagaauaccacacaauuuuguccuccucaaugcaucagaccaggagguacaugauaucuguuugucccaauauugggauguuaacuuugaucacuuggguaagguggugucugccagacuucuuuacuaugaaguuccuauuuuucccuuuguaauuaaugggaaguuaauuccuuuuguaauuaauuaaugaguacuuuguggggaaacaguuugagacuauguaaauauccuuuuccuagucagauuucacccacuaguuuuaauauuugugaauuauuuuuuaacuccauaauuuugucuucauuuauuauuuagcauuccacuguaaggauggacuuucccuuucugcccauuuauucauuguugagaacuuuccucccauuuauuuauuuauucguugucaagaacugugaaaggucugagauuuuacucuaccuggaaccugguaaguuagccuguuacuguuucuuagaugcuggcagaaagcauaagacucuugggucagagccaaagggcuuuauuauccauggcauggcaaacuguaugagcuucauuugguuugcauugauuuuuuugugucccucacauugauuuuuuugugucccugcugugaccagcaggugguccuagcuggauucuuacauaugcaguguauugugcuauagggaaggagcacugaacuauggggauugaccacuuuuuuagcaagccugauuguugucaggggauagagauacguuaccucaucccugaagauggcuuccugcauacacaauccugagaaauggcccagguaaagaauggucagggccuggucuauugaacaagaauguguagggacacucggggcucauaguagauugccucucucaacauucauguauuuauaucaguuuagacucauggauuuuuauucagugggauauaaaaauccauuaaaaucauuuuuuuuuuuuuugcuacugggaguaccuucaagauggcuccuguauuuauauugguauaaacucauggauuuuucuuuuauucagugggguauaauucauuaaaagcauuuauuuggcuauuuggagcuuuuuaaagauggcuucuauguccuuuuugauacauccccaucauugagcauuuucuuacuucuuggcacaagacguuucaagcaguguuaguuuccuagggcuacuguaguaaaguaccacagacgagcacauugugguuuaaaacaacagaaaauuauucucucacaguuguggagguguuggaaagaagguguuaguagagccaugcucccugugaagguuguagagaagaaucauuucuugccucuuccagcuuaugguggccccaggcauuguuugacuuguggcagcccagcuccauucuuagccuuugucuucacauggcuuucuucccuauguuucuauauccaaaucucccucuccuuuuucugguagacacuaguaauugaauuuagggcccaccuuaauccaguaugaccucauuuuaacuuacaucugccaagauccuauuuccaauuaaggucucauugacagguacuugggauuaagauuugggcauaccuuuuugggggucacaauucaacucacuacacagauuuaucugauguuugcccugcccuaucccuggaauuggcugcuucucuuuaacucuuuaguagagaauaguauuuagaaaccaaggucuggaugcuaggguauguucauugcuacuggagugucauugcuucuaggcccucucagaagacagaucuaaaauuacauacccucaaauguauguaucuauagauacacacacuuuuuuuuuuuuuuugagacagagucucacucuguugcccaggcuggacagauuugcaguugugcaaucucggcucacugcaacccccgccuuccggguucaagcaauucucugccucagccuccugaguagcugguagcugggauuacaggcgcccaccaccacgcccagcuaauuuuuguauuuuuaguagagacgggguuucaccauguuggccaggcuggucuugaacuccugaccucaugauccacccgccucagccucccaaagugcugggauuaaaggugugagccaccgcgcccagccauacacacauuuuguauauacaugcauacauaacauauguauguauacguauacauacgugcguagauacacauguugaauacauauucauuguagacacagacguguauacauguauuaauacuuauauuacucugacacguguauauccuauaucaguauuuauauauuuaucuacuuguauacuaaaaaccauaaguuuauauucauaccuguaauuccaacccaacacuacaggguacaugauagccuucccucuuucauauuuguaacuccuuucuccaacagaacaacccugcucccaguauccucaauguaguuacucauuugcuuaagucuagaauauacagaaaguaguuucagaauuucuaaccuauaccacugugaaaagaaaauuuaccaauaaaguucucaauaggaaucuuacuuuguuuuuuggcaaaauuuauguauagugaaauguacaaacauuaaguguguaauucaaugaguuuugacaaauaauaaggcaguuuuguaaaaacuuuggugaaauuggaaaauaaccgcaccccagucaccuuguuuuuuuggcuacuacuaaauugacucugaucacauggaaguguaauaauuuucuuuagugugaaugcccugagccaugagguaacccuguucugaagugguuuccuugcuuguaaauaaauaauguugacauguaaagcaggaccaccaaacuguaagucuuguaguaauuuuaauguauuuuccacucuggacaaaaagauguguuuuuauuccugauaaauauuaauaguucuagaagaggacauuuuccaaauuaaagaauuagguauuuuuucauaauucccggguaguaucugauauuuuccauagcucuuuggagaagauucuuguucaagaugcauggguacuauuucuuuugaguccuauuauacaaaagcuuucaaguacuaauagcagaaugauuacauuugaguguauuugguaucuuagucauauacacuaggcaaaaacaaaaaagcagcccauuaaugacauuaaugaucucucuccagauaucacugauuaaaagauuaauaguauguauuuugcauauauaauuguauccuaaucuguaauagauuaccauuuuauauugaaccaaauauaaaaugaggcauuuuguucuuuuuucuaccauguauuaagguauuauugauacuagucagucauuuauuucacacauuaguuuuauacuuacugugugcaaguuguaguucuaggggcuggggauuuagcacugaacacagcagaacaaccccugcucuuaggaagcuuacagucggacagagauaaguaauaaaguaaauauuauaguaaauauuaauaauguauuaguaaaguuguagugucuuagaaagugauuagcacuguggagagaaagcagggaagaaggauagggcacacaggaggcagggguaccuucuuaauuuaaaauaagauggucaggagaggcucacugaaaagguaacauugagcauagauugaaauuaagugaaagaaugagccauacagggggaagaacauucuguauagaggaaacagcuagugcaagucucuaaaguaggaucaugccugacguacucuagaaacugcaauaaggacugaauguauaugagaacgagggguggagaaauagaaaaugaggcagaguugggcacaugguaauauagccugcuguaauaaggauuguggcuuuuacucugagaagcgaaauauacugauuguaaacuuguaaaaagacuuagguauuccuccacauuguccacuaaaugauauuuucaugaaaauaauagaggcuuauggaaacaaaaauucaaacaguguggaagaguauaaaaugaaacuuuuagaacaaguaccuugccccacacacucacacacuuucagucccauucccuagaaguaucuuuucacuugugacuguuucuguaauccucagagcuaccuccguaacacugagcucuaaauucuucuuuuaaaaaaguuuucuuugaaaauugaacguuugucugauauauagaugaagguuaacuuaguuucugcaauuccacuucucuuuuguccucuuccuccguuucuacucgcaucuaguaaaaccuuuagugaccaccagagggagcaaaguucaacauaaauaagaugcguuuuuauucucgggaauuucuaguguuuucuguguguuucagugauauuguuaauaccuugguucucucuugcuuuuuuuuuuuuaacuucuuagaucuuuaaaacuuuuauauuuacucgggaucuuauuauuaacuucauuucucuucaccucacugaucugaugauguuuagacuagcauccauuguuauuuguguguugaccauggagaaaaauagcauagaugggagaacugacacucuccuuucuuuaguuccagcagccaaauaagugguugucuagcuguccaguauccaucuagccuuuugcaaaauuggcugcuauucaucugugguuuuuguaacaucagcuaguuaucuuuuaccuauaaaaauuauugaaagauagauaaauuuauaccuguuguuuauacuuaccuaugaaggcagucauaauuuuuauaauuuauauuuaaaaaaauaacuaaacagauuuguuuuugacaaaaauuuaccuuugacuuuuuucuuguuauucauaucuaauuuuuguugacuauaagguauuaaauugagguucucuaggugccuuaugcuagagaauauuucuuuaaguuauauauuucucauguauuaaaacucucaucucagaaagaaauucaccugacuaucgaacuugauaguacuccauccagcccauagacucuucaaggcaaggaccgugucagauucgccuuuguguuacuauuuaccaccuacaaaguucagcacagggccauaccauagaggauaccuagauuauucuaauuuccuuauaauucucuuuuccaggguaaauaacaugaauccauuauauuucucucuuagaguguauuuccaaccuucugguucuucuuuuguuucuucaaguuccagggcauaacuuaugcucaguauaaggggaauacuuuauuuaauuuaauuagcauuuuuagagcauauagauauguaggaugcuauuagcaauuccugaaaaaagcuaccugggaauaaauagaaaacuuagcauuuuugguuaaagacuaacaguguugcugaagaaauuaaaauauacacagggaaagugaauuuugaauuaagauuugaguaugguaaaggccacuuuuaagguaauagaaauauuauaaagcacaaagucugcaugauuaaguauuuuuuugccccaaguuucagccuguguugaugauuuucaaaacugugucucuccuuaucauucuugcaguuuuaaccacagucuauauugauucuaaauuuauuuuuuagcccugaucuuuucugugauccugaucagggauuaggguuuuuagaccagggucacaaaaaaaaaaaaucaaaaacaagcgccuucaugggccaagccauuaacauaaaugaaugaagucgguuuugauuuauauagagagaaucacaagguugugguuugcagugaagugcaugcccuauuuaaagaggggaauuggauguuagcuccagccaguuauugccaugaaugcucaguagugccagaucugauauaaaaucuuguuuuuuuuuuguuuuuuuuuuugagacggagucucacucuguugucaggcuggaguacaguggugcgaucuccgcucacugcagacucugccucccggguuccagcaauucuccugccucagccuccuggauagcugggacuacaggcacaugccaccaugcccaguuaauuuuuguauuuucaguagagacaaggccucaccaugucgguuaggcuggucucgaacuccugaccucaagucauccacccaccucggccucccaaagugcuagauuacaggcaugagccaccgugcccagccugaaaucucauuuuuuaagugacaucuucugauuuuuuuuaaaguuaaacauaaugugagccuaaucaaguacuucuacaagcuccauuugacuugaagaacucugccuuuuuggcuuugaguuucaugugcuggaauacuuauugagcauuucuguuuaguguugcauuggcacuucagacucaacaggucuaaaauagaacuuaucaacugucuacccccuuacccugccuucagaugcuuucuucugcuucuuuccuuauuuaaugguauugccauauacugaguucauucaagugagaaaccuagcagugaucccugaaucuuuucuuacugcuuuuucuuagugaccuauuuaauuaguuaccaagugucacuaauuuuaucuuuuaaguaaucugcaucuaucacuuucuuucuaccccuacugccucuuucuuaauauaucaucaucucuugccuaggcuguugcaaugccuccuguauucuccuuguuuugaguguggucccucugaguucuguuuuccacauugcuucggacgugacuuaucugaauguauaucugaccauguuuaucccauuuaaaagugguuccccuuuacucacaggcuaaauuagcaugauauacaaaguccaccauaaucugguuuauauccacauuugagucccaccuuuuaucccucuucaucuuuuauuuuagauuccaguacuaucagacugcuuguauuuucugcuuguauuuucuuuuuuucuuugguuuugagacagggucuggcucuaucacccaggcuggagugcaguggugcgaucucugcucacugaacccucugccuucggggcucaagccauccucccaccucagccuccugaauaccugggacuacaggugcgugucaccacacccagcuaguuuuuuguauuuuuaauagggacaggguuucgccauguugcccaggccagucucgaacuccuggacucaagcaauccacccgccuccgccucaaagugcugggauuacaggcguaccugccauacugcuuguauuuuccuacaaauauaugggguaccugugaaauuuuguuacauguauauagugcuguacugaucaaaucagggcauuucggguaucuguacauuuuugucaaguguagucccucuacucugcuaucaaacauugaauuuauuccuucuuucuuacuguauguuuauacccuuuaacccacuucucuucauuuuccccucuucccccuacuugccccucccagucucuguuaugugucuuuccacucucuaccuccaugugaucaaauuuuuuagcucauauauauaaaugagaacaagugauauuugucuuuuugugucuggcuuauuucacuuaagauaaugaccucaaguuccauccauguugcugcaaauaacauuucauucuuuuuuauagcugcguaauauuucauuguguauauauaccacauuuuauuuauucauucauccgugauagacauuuagguugacuuuuuaucuuugccauugugaauagugcugcaauaagcaugcaaguauugauuucuuuagagaagaggcuuuaaaugagauugaugaauauuuuguuuguuuuuagagacaaggucuugcuguguugcccaggcuggagugcaguggugcaauccuagcucauugcagccucaaacuccugggcucaagugaucuucccaccuuggcguccugaguagcugggacuacaggugugugccaucacaccagcgaauuuucuuuuucuuuuucuuugguagagauggggucuugcauguugccugggcuggucuugaacaccugggcucaagugauccuccugccuuggccucucaaagugcugguguuacaggugugaaccacugugcccagccaaauggauaucugaaauaggcauuucucuaguauaaacuucuuuuuaaaaaagggauuuauaggcuggguguggugacucaugccuguaaucccagcacuuugggaggccaaggugggcagaucaucugaggucaggaguuugagaccagccugaccaacauggugaaaccccgucucuacuaaaaauacaaaaauuagccagcaauggugguacuguaaucccagcuacuugggaggcugaggcaggagaauugcuugaaccugggaggcagagguugcagugagccgagauugugccauugcacuccagccugggcgacacagcaugacuccgucucaaaaaaaaaaaaaaagagagauuuauagagcgggaaaauuuugcuucaggaacgaggcagaaaguccaaaauuccuugucuagguuguauuguucuaaguauuauaaauugaauuguuguuuaauucaguggacuauagagggcaguguuucacaguuuaaaguuacugauuuuucugugaaacuaaauacacuucaauuaugcuuauuuuguguauuucucuaauagacacacaauaaaaacuauaagauuagaaauuauuuuuuagcuguacuuaauaaauaaaaauacauuuuaauguaaaauuauaauaauuucaauaaagauaaucuuauuaucuuuacaucccaaaaugauguacuuuugggauaauagauuagaauuaaaaaugacuuuguuuucuuauucaauccauguaaguuaagaaaaauaagcaucauauggugaucuaaauuuauuagaaaauuuagagaaaauuaguauccugugcaacuaaaauuuucuuuugcaaaagaauuuuuuuuuuuuaaagagauggagucucacuauguugccuaggcuagaccugaacuccugggcucaaguuauccuccugccucauccuuccaaguagcugggacuacaggugcacacugccuugcccagcuugcagaagacuuuuuuaagacuucuuauuugugcauuagagcagaauaagcuuuuugcagauacaacaguuacacauuuuaguagauuaauugaauuaugauguuaaagcuauagcuaaaagaaauaaucuagaaauaguuucuuuccugauuuuaauaaaacauuucugacuuauuuuaguaaaaaaguaaccuguguguauuaguugggaauuaagaacuagaacugcauuuuaucuguuuuuuaaauuauaaggagauuauuuuuucuacugaaaaaaaaauucguucuaaugauaaacucuauuaugacauguuuuguuacuaggaacagagauugauuauauuuugggccaaauuuauuaaccuccauauagagguaauuuucaguacagaaaagcaugguguguuauuaaaaacauuuaauggucuauccuacugacuuuauaaagaguuaugcaauauuuaggaacuguaggauucuuaaugcuuguguguaugcucuuauauguguguauguguuuguuaguggucccuguuugugguuuaaaaauguauagcaguccucccugaucuauaguuuugcuuucugagggguuucagucaccugaggucaacggugguccaaaaauauuaaguggaaaauuccagaaguaaccaauugauaaguuuuaaauugcaugcccuguugugauaaaaucucuccugucccacuccauacaucccuuugucaagauguauccauuaccuguuccuguauaggaaaaaacauaguguauauagggcucuguagugucuacaguuucaggcaucuacuaggggucuuagaauacauaccccauggauaaggggguauaauguuauacaaagcauuauauuguguaauguuuugguuagcuucagaggggaacugguuaauagauauauaaucugauauauucauuggauauuuucacauuucuuccauccauguacuuguguuguuuuugaguuuucuuguuuuuuuuguuuguuuuuguuuuuugugcuuuuuuugagacagagucucacucuguugcccaggcugagcgcaauggcaugaucucagcucacugcaaccucugucucccggguucaagcaauucuccugccucagccucccgaguagcugggauuacaggugcccgccaccacgcccggcucauuuuuguauuuuucguagagacgggguuucaccauguugaccaggcuggucucaaacucccgaccucaggugauccgccugccuuggccuuccaaagugcugggauuauaggcgugagccacugugcccggcugaguuuucuuguuuuauuugccaauuguacuuuuaaauuuucuuuugugauacuugucaguugaggaaaagaagcauuguauuagccuauaugugugcauaggcaaaaaccuuugagugacaacuucauucuuuuuuuaaaaaaaaaaaauuuaacccauuuaugccuaguguuccauuauuggaaugcaaagcuugugggaguuauuuacauccuacugcucaaggucauugccaaggucugauuuucacaaaaaaaauuuucaaccuccggcauaaaugaguuaauaauauaacuuaaacagaacgugugaaugcuuuuuggcuucacauuccaucuuuaaauaacaccauaguuuugcaucagagaucucaaaugauuuuaccuggggauaaacuucuagucuuuucauugguauuggugggauuggguugcauuggaaccagauucagauuuugguaugugauaguuguuuguuuugcuauuuuccccuagccauaauauauaccugagugccuagacaugauaaauguuaucuuccaguugucccguuuuuccuuagguugaauuuuaauauauucaauaacaaauuuagugaaacucuuaauaauccauguuguugauuuaaguaaaagggaaaaugaaaagugccccaccaacucuuucuagguguuauagcauuuuccaucauaugguaaacacuaggucauuuuacuuuauuuuuuuacaugaauguucauagucgcuuuauuuauaauaaccccaaacuggaaaccaaaauuuccaucaacaggagaaggcuaaacaaauuaugguguaucuacagaauggaauacuaaauaggaccaaacuauugguauacauaacaugguggcucaugccuguaaucccagcacuucgggaggccaggaugggaggacugcuugagcauaagaguucaagaccagccugggcaauacagcaagaccucaucucuacaaaaauaaaaaauuagcugaguguggugguuuacaccuguggucccaguuacucaggagguugagaugggaggaucgcuugagcccaggagguugaggcuauagugaacucugaucaugccauggcacuccagccugggccacagagugggaccccaugucaaaaauaaauaaauaaauaaaauucuagaaaaugcaaacuacagugacagaaaccagaucagugguugcccggggauacaaaguaggaauaaacagcagggauuacaaaagggacacaaggaaacuuuccgagaugguggauauauauguucaucaucucgacuguggcagugguuucaccaauauacgucaaaacucaucaaacuguacaauuuaaauaugcacaguuauuauaugucaauuauauuucauuuaggcuguuaaaauaacaccaccuuucacugucaaaacuaucucaguuugaaugcugguaauauucuauuucuugaucuggaugcuggcuuaauggauuuuuaaaucuggguguugauuucauauuuauucaguuugugaaaacccacuuaaaauauguacauuuuucuauauacauguuaacuucaacuccuuuccucuccacaaaaagccugaaagaaucccugaaagggacauguagaaaaugucccaguuggacaguaaauuauagggagacaacacuggaucauuuuaaauguagauccugaaagucuguugauuuggauuugaaauccagugaaggaggauauuuuuuuauucuccauuuguuuuaaaaauacacugguacaaaaguaggugaaauuauauaacacagacuuaaugaauguauuauuucuauucuaauauauucgauagcuaaaaaguuuuuagguaaaaagccagaaagauucuauuagucucaauuaguccuuuuaacagucuuguagagaaaauaauuccccucuuacagaugaggaagcuaaggaucagagagguuaaguaacccagcccauagccagaauguccaaaagcaaaauuucaggccuaggcuugcuuaacuuagauaccugaauuauuuucuccacaugacauuacacauuuuagaagauuuuuuuuuuuagcuuuucagauauauuuuauguuuuauguuguauuucuuuaaauaucagcuauuuggccauauuuuauuggaggcuggugcucuuuucuagggcugcauacccuuuuaaaagcaaguaugaauuucaccuauauuuaagcuauucuaauauaccucucauuuuauaacuuuuuaaagagcaauauacuccagauguguuucaggauggcuuuauagcuuucugugcuaccuugacaacauagugcuaucucuucuuguauuucucccugcguauaagugaauauuagcagaauuaugaauaaauuggaaauuguaaaugaauagaaaaguggucuuuaauucaguaagaauugguagucuuuggaaguauuuugaaauacuacuuuuagauuuacagggaggcaaaaucucaacauggaaugaauauuauaauuucauaauuuuaacccuauuauguauaagauugacuauggguguguguauguauguacauauauauacagguguuaauauggacguuacuuuuuaguacaaguaaaagguuauaagaaauauuuuaaucaagugaauccagaacuuauuuuggugguggugaugguuucauuuguauguuuauguguguguguauaugugcauauguguggguuuaaucucucugugcuacuguuauuauguaccauucaauaucaguaacuauagcaaagggaguuugaugguauuagcaauaacuuagacacaguaaaaagcugaaaaacagcaaaauuguauauacauauauuacugacuuguauuccaaacaauccuaucuauauugccucaauuuuuuaaaauguguggacaauuuaucucuuuuuacaguuuuugaaauucuuaacauuuugggauauuaaaauuuuguguuacaaaguuagauagagacauuuuaaaguuuauuucuuuccccaucgcccuccccuccacuccugccaaauuugacucguguaaaaguuuuuuuuuuuuuuuuuuugagacggagucucgcucugucgcccaggcuggagugcaguggcgggaucucggcucacugcaagcuccgccucccggguucacgccauucuccugccucagccucccaaguagcugggacuacaggcgcccgccacuacgcccggcuaauuuuuuguauuuuuaguagagacaggguuucaccguuuuagccaggauggucucgaucuccugaccucgugauccgcccgccucggccucccaaagugcugggauuacaggcgugagccaccgugcccggcccguguaaaaguuuuacauauugagagacuaaauguuuaaaauaucuaauauuuauacaauagcugauuaaaucauuuuuaccacuaucuuaaucuuucugcuuuuucuacauacaaauuuuuauaguccauggagcauuucacuuguauauguuuuauucuauggaauuauucuaugcuuuuguucaguaguauucuacuagauuccuauacuuccaaguacuguauagucuuuguuuucauaucuauuuguguugcaaaacuagggggugacuauguuaauuugucccuugagauucaguucagcuaagauuuauugaaccucuucaggcuguauuacuuagcauaaacuaaugcuguuucuugcugaagucuuacaauaauaauaaugauuaauuauaugucaucuucuuaaauuuuuaaagaauuaaaguacuuuagaauguguuuuuccugguaaacucaggauaccaaauuacucagcuuuuagcuuuuuucuuuagcauuccugcugaucaguguaacaugaaaucauccaguucaauuacuguauuauuggacuaugauuuugaaaaacugauuuagauuuuauuaauuuuuuaaucguuauugaugauauacacacccgcacccccgcacacacacaaccacccagccugccuuuguguuuguagugucuuccauggaaauuuaaauuggggaaguuucucucuagaccaacaacuacccucuggcuuuauuauccagaguuuccaggaaugccugaugaaguacuucagcuacaucuacccuaaaucacaauacuguuguccucugauacucugagccauucuuguuuaccaauaaagugugugccauucauucauaguauaauuuuuugccacacaucaccuaaacguuacacaucaacucuugaauagugaaguaauggagaguuaacaaauuugguucccaaaugggcccagcagaggauaccuuaacuuaaaggagggguuugacacuauagugggacugaccaagauagagcaaagauauuuuggagcuccucaggucuggccuugcccuauacguaccuauguuccuaaaauuucagcaccuuagaaauaauaucauuaagugaauaacuuuagucauuagagauaggaacauuuuucuuuguuuauaaauaucugcaugcaugugugggagagagauuuuugaggaaacucauugguauaaaccucugcugaggcauaagaccauguauuuugaauaauuugcuauaccaaccauacuugguuuuuguuugaucauuuuuaugcuuaaauaaaaucuggaauuuaaaauuuuauuaccuuacaccuauugggaaagaguaaagugccaguuuucuugauaugguguggcuguguccccacccaaaucuuaauuugaauuguaucucccagaauucccauguguugugggagggacccagggggagguaauugaaucaugggggcuggucucucccaugcuauucucgagauacugaauaagucucacaagaucuguugggcuuaucagggguauccgcuuuugcuucuucauuuuucucuugccgucaccauguaagaagugccuuuugccccccaccaugauuuugaggccuccccagccauguggaacuguaaguccaauuaaaccucuuuuucuccccagucagguauguuuuuaucagcagcaugaaaacagacuaauucauaucuccuuccaaguugacagauaaacuuuuuuuuuuuuuuuccuuaaaaucucacucuguguugcccaggcuggagugcaguggcacaaugaugucucauugcagccuugaccucuccagucucaggugauccucccaccucagcuucucgaguagcugguacuacagccacaugcuaccaugccuggcuaauuuucguauuuuuuuguagagacaugguuuugccguguuguccagguuggucuugaacuccugggcuuaagagaucugcccaccucagccucccaaagugcugggauuacaagagugagccacugcaccuggccaacagauaaacuuucaauuauuugcgucacuuaggagcaaagaaauaucaauugcaaaaagaacagaagaacaaauucuuaaguugcaaauuucuauuuauguuauauucacagguuaauacaaaaaguucugaaacuuuagaaaacagaauauuuuucuuuaagagacggauuuauuucaucaaagaaauugagcagucaauuauuuuuaccuaucuucacacaguggcauuuggucucaaauaccauuuuaauuaugugcuuuaaaaaaucaauucaauuuaacuuuauuuaaaaaaauacuuuuugugagcacaaacaaagugaccucuuaaugcccggauaugaugaaauguggauguagcacuuguugguacgcaaauaguuaaaacugugguguugucuuuucuagguguuuagcaaagauuuuucuguauucuagaguuccuugucaacugugugaucauagaaucaugggaggcuugagaucuucuaggcacuguuugaaauauuguaauauauaccguaguuuaaguaugugcuguuuugcagauagcccucauuucaugcagaguccuguauuuaaauaacucaguucauugcuauucuaaguagugcuuuugcaguuaaacaucugaaaggcgauugacuuuuuuccuauagcaccauaauuuauaagaaaacauaaaaugaaaagacuagaccaagaugauucugguacaugguuguaaucuuaauaucaguuuagagaguaaagacuaagucuguucagaauagacuguuuaaccagcugaucagcuggaauuucauauagcuucaugguucuuguggguauuuuuuuugcuguuuuuuaucuuuauguuuagguguugggugucuuugauuuuaugucuucugagaaauuuaugauccuaugcuuuauuugugacacuagucucagcuuaggcaauugauugaaauacgauauagggaaauuuagcaugcauuuuuuaacagcuuaaauuggaaaaaugaaccaacaauguuaauguggaauuguuuuggagcaagguaagaagggaacaauagguuaauuucuuucuauuuguauuagucuuuuauuguuaaaaucuuauuuauuauauuugacauaauuugcuuuuggagauuaguaguguauuaugcuuuaaaguugugaaggaagauuguaauucauugaaauuauauauguagaaaacaaauuuguaaacuguagagugcaaugcaaguauaaauuuuauaucaaauaugauacuuaacugaggcaaguauuuuauuaauaugccaccaaaaaauaaacgggaugcaauguuaguguugcugaggauauuagugaauguuaaccugcacaugguaggcuauggugaauaaaugaccagguugaaauuauagagaaauuauucacagggaaacauuaauacauuucccuuaauguggcuguaccauggcaaaccucgauucuuacgggaucaauuuaguugucuaacucauauuccuuuaauuuagaguuggaaaauuauuuucuucaucuauauugaaucugucaguugcaugaauuagauuuuauuaaccaaguugaaaaugaauucaguuuuugaaaauguuuuuaaaggccuagauuuaaaacucuguagaauuacuauauuguuuucaggcucacuauagaguauccuucuucuagaggcaguggaauuuuauuuucuuuacaaagcaugugaaauacgacuucuaguuauuugacacaauuucuaauucaagaccaaaaauauuacuaacuuuacagcuuuacuuucaaaacuaccaauguuuguuggacuuugaauucuuggaguauggcaaagaugaaaagggggagaguuaggggauggguugaacuuugcauacaaugcagaaucaaaucuaaaaaaacaaucaggguaauucuugacagguaaaaagagccuaagaggaaaaauagaagaugcuauuacagauuugggucugaauuucucaauguguaucuguuuauggaaaaggacuauauauuauuaaacaugguuaucuuauggucaaaacccuguaguaauaaaauaaauuugagcacuggcagugcagcuugguugguguauagauagaggugauggcaagcagguguucuguuugauacugaagcauucuagccacaaguugaggacauauggaaaacuggguggaauugcaaauuuuucuuaaaugucaaaguuucccuaacccuacaaaauguaguuguggaaacuaggauaaggcaguugucauguuuuugccuugucuuccucugugguaucuauggaaagaauaaccagcaaagauuuuuaugguguuaagcuaacugauagccuuaaauaucugauuuagggguaacuugaaguaauuuuuggaaauagggcagaaccgagauuaacagaaccuuguagacucauaauggaagggugagacauuuguaaaaauagucugucuccaggagaaauaacaaaugccaauaaacagagaaagauguucaaccucacuaauaaucaagaaauguaagauaaaacaguauauacuacuucuuaucugacagauugaauuagaagacuuguuggcagagcaugagaaaauaaacccagucacgcaucuuuaguggaguguaaauuggcagcagucuucuaggauauaguuucuuugccuccuuaaaccagcggccuucuuagccuccuuuggugugaggacccgcgucagcaggaccuccuauccagccaaacucauggaggcuuugacuccuacugcuucugggcuuaggacaugggggacaaagguggcagaaucucuauccucaguaauugcuuggaggaauuaccuagcaagcccagaaguucaagaggcaaacuuugcccaaggauaggcaggagauaggaaaagacuggcagaugauuccuuuuuucuuucuuccuuuucugcugguucugagcuacauugguccauagccugacuggaaaagauccuaugugaccuaggucacucaagccaguaccaucuuuuguuugcuuuuccuccacuccugccacacccccguuuuccucucauccuucauauucugggauuuuacuuuccaagaauuccuuagcuugggagcuuugccucagguuuuguucuuuagggcuaaguagcuaacagucccauuuuugggacucugaaaaugucugcagguuuuagaagauuuauguacauguuuacaauguagcauuguuugcuuuacugaaaaauuagaaacaucuaaauggaucucaauaggggaaugguuaaauaaugauauaucauacagugaaauacuauccagcaauaaaaagaaugauauggaaaguuguucaugguguauuaaaugagauaaaguguaggucaguauguuuagauugaucucauuuugggaaauuaagcccuuuauuuuauuuuuuuuagagacagggucuugcugucacccagcugcggugcaguagcgugaucauagcucccugcggccucaaacuucugggcuuaagugguucuccugccucagccuccugaguagcuagggacuaccagcauauaccaccauguacagcuaauuuaaguuuuuuuguuuguuuguuuuuguuuuuuuuuuuuuuuuuuuuuuuugcagagauggagucuaacuauauugcccaguuuggccuugaauuccugggcugaagugauccucccaccucagccucccaaaguccugggauuacaggcaugagcuaccaugccuggccuacuuuucacuuuauauacuucuauaagauuaaauuuuuuugcauguugaauaucaauaaaacgauggaaaaagaauuugcuacaugcugggugugguagcaugugucuguagucccagcuacucagaaggcugagaugggaggaucacuugaauacaggaauuagugcagccucagaaacauagugauaccuuggcucuaaaaaaauaaaagauauaaaagaauuugcuacuuaaagauauaagcacugaaauauuuauuuaaaauggagaacaaauauguuuaagagauagaaaacuauacuagaguccuuagacucuaguguuaaucuuuggggaucauauaggaacuaaaauuuaaacuuuauuguagauguuuuuacagguacaucuauacauauuuauauagauauauauggguuuaccuuaaacuggggcauuauucuaaaugcuuuauauguauuaucuuauuuacuggucacaauaacucuuugagguaggugcuguuguuacuccuuuuucacagacagggaaccaaagccuagaaaacuuuaagaaagaaaaaaacaaaaccaugccugauguuguauguacuuaaaaugacagcagauaaaguuuuugacauucaugagcuauauaauggacauuuugugcauaggcaaacuauuaauuaaagguaaauuuuaaugaaguuuaucccaauuguuuuaauaauaaaacaaauuauuuaaaaaauauaaauacacccaauaauaagucauuaauuucauucuccagcaagucaaagaaacaagcaaguguugggaaagugucaagcucucauugcaugaacacuauaaucaaacugccagaccaccuaccaaacaguaaauauuaguuuggugcaaaaguaauaggcaaaaccacaauuacuuuuguaguaaccuaauaccuaguaaauauuuuaauagaaauguggccacaaauagucccagaaaauuccuuugacuauguuauguuuacauuucaauuuuauguuguugguuuguugcuuuaacacugaauauaauuagaauaaaaauaugcuaauacuuuaauuuuauauuuugagucaaagcuuacuaaauuaaaccuuuacucccaaaauaguaucugaaguaaauauaugcaguuuacccacuuuauuuuuucuuuuaaaaaauuuuuauuuuagguuuauggguacaugugaagguuuguuacauugauaaacacauaccauagggauuuguuguacauauuauuacaucacucagguauuaagcucaauacccaauaauuaucuuuucugcucccacccuccccccucaaguagacuccagugucuguugcuuccuuccuuguguucauaaguucuuauguagcucccacuuauaagugagaacauacgguauuugguuuucuguuccuguguguguuugcuaaggaugauagccuccagcucuauccauguuccuauaaaaggcaucucauucuuuuuaauggcuccauaauauucugugauguauguguacugcauuuucuuuaucuccucugucauucauaagcauuuagguuaauuccaugucuuugcuauuaugaacagugcugcagugaacauucauaugcaugugucuuuggguaaaaugcuuuauauuccuccggguauauacccaguaaugagauuacuggguugaaugguaguucuguuuucagcucuuugaggaauugccauccugcuuuccucaaugguugaacuaauuuacacucccaccaacaguguauaaggguuuccuuuucucugaaaccucaccagcaucugauuuuguuugaguuuuucauaauggucauguugacuggugucagaugguaucuuauuguggauuugauuugcauuucucgaaugaucagugauguugagcuuuucuuucauccuucuuggccacauguaugucuucuuuugaaaagugucuuuucauguccuuugccuacuuuuuaauggggugguuuuucgcuuguugaucuguuuaaguuccuuauagaugcuggauauuagagcuugucagauguauaguuuucagauauucucucccguucuguagauuuucuguugauaguuuauuuuucugugcagaagcucuuaaguuuaauuagaucccuuuugucaaguuuugcuuucguugcaaucgcuuuugguuucuuugucaugaaaucuuugcuguguccaggauggcauugccgagguugucuuccaggguuuuuaugguuuuggguuuuacauuuaaguuuuuaauccaucuugaauugauuuuuguguacgauguaaggaagggguucagcuucaaucuucuauauauggcuagccaguuaucccagcaccauuuauugaauagggagucuuuuccucauugcuuuugucagcuuugucaaagaucaguuggucauagauaugaggccuuauuucugggcucucuauucgguuccauuggucuauaugccuguuuuuauacaaguaccaugcuguuuuggucacuguagccuuguaguauaguuucaaguuggguaaugugauuucucuggcuuuuuucuuuuugcuuaggauugucuuggcuauuugggcccucuuuuugguuccauauaaaauuuaaaauaauuuuuuuaguucuuugaagaaugucauugguaguuugauaggaauagcauuuaaucuguaaauugcuuuggguaguguaaccauuuuaaugauauugauucuuccuguccaugagcaugggguguuuuuucauuuguuugugucugauuucuuugagcaguguuuuguaauucucauuguagagaucuuucaccuccuugguuagcuguuuccuagguacuuuguuuauuuuuuugugacaguugugaaugggauugccuuucugauuuagcccuucauuuuguugguggugguguauaggaaagcuagugauuuuuguacauugauuuuguauccugcaacuuugcugaaguuguuuaucagcugaaggagcuuuggggccgagacuaugggguuuucuagauauggaaucaugucgucugcaaacagauaguuugacuuccucucauacuauuugaaugcccuuucuuucuuuuucuugccugauugcucuggccaggacuuccaauacuauguugaauagaaguggugagaguugugcugauuuucaaggggagcacuuccagcuuuugcccaguuaguauaauguuggcuguggguuugucauagauggcucauacuauuuugaggucuguuucuucaacaccuaguuuauugagaguuuuuaacaugaagggauguugaguuuuaucgaaauccuuuucugcaucuauugagauaaugugguuuuuuucuuuaguucuauuuaugugaugaaucacauuuauugauuugcguauguugaaccaaccuugcaucccagggaugaagccuacuugaucaugguggauaagcuuuuugaugugcugcuggauucaguuugccaguauuuugcugaggauuuugcacugauguucaucgaggauauuggccugaaauuuucuuuuuuuguugugucucugccagguuuugguagcaggaugauguuggccucauggaaugaguuagggaggacucccuccuuuucaguuuuuuugaaauaguuucaguagaaaugguaccagcucuucuuuguaccucugauagaauucagcugugaaucugucugguccuggguuuuuuuuugauugguagacuacuuauugcuaccucaacuucagagcucguuauucgucuuuuuagggauucaguuucuuccugguucauucuggggagaguauauguguucaggaauuuauccauuucuuauagaguuuuuaguuuauaugcauagagguauuuguaauauucucugauggucauuuguauuucuguggggucagugguaauaucucauuauuucugauuguguuuauuugaaucuuuuuucuuuuuuauucuagcuagcagucuauuuuauuaauuuuuucaaaaaaccagcuucuggauucaucgaucuuuugaaugaguuuuaugucuauauccuucaguucagcucugauuuuggugauuucuugacuucugcuagcuuugugauuuguuugcccuugguucucuauuucuuuuaguuguuagguuguuaacuugagaucuuucuaacuuuuugaugugggcauuuuagugcuauaaauuucccucuuaacacugccuuagcuguguccuagagaucugguacauuguaucuuuguucucauuaguuucaaagaacuucuugauuucugccuuaauuucauuauuuacccaaaaguuauucaggagcaagguauuuaauuuccauguaauuguaugguuuugagugaauuucuuagucuuggguucuaauuugauugugcugugguccgagagacuguuugcuaugauuucaguuuagcauuugcugaggaguguuuuacuucugauuaugugaccgauuuuagagucaguaccauguagcauugagaaaaaugcauauucuguuguuuugggauggagaguucuguagauacuuaucagguccauuugauccagagcugaguucagguccugaauuucuuuguuaauuuuucaucucagugaucuaucuaauauugucagugggguguuaaagucucccaauauuauugugugagggucuaagucucuuuaaaggucuccaaaaacuugcuuuaugaaucugggugcuccuguguugggugcauauauauuuaggauaauuagcucuucuuguugaauugaaccccuuaacauuauguaaagcccuuuaucuuuuuugaucuugaugauuuaaagucuguuggaaacuuaagauuguaacuccuuuucuuuucuguuuucuauuugccugguaaauuuuccuccaucccuuuauuuugagccuaugugagucauugcaugugagaugagucucuugcagacagcauaccaauggguccugguucuuuauccagcuugccacacugugucuuuuaauugaggcauuuagcccauuuacuuuuuuuuuuauuuuugagacggagucucacuguguuguccagguuggagugccauggcacgaucuugggucacugcaaccucugcuucccgaguucaaguaauucuccugccucagccucccuaaauagcugggacuacaggucugugccaccacgcccagcuaauuuuuauauuuuuaguagagaugggguuuuaccauguuggccaggcuggucucaaauuccugaccucaagugauccgccugccucagcuucccaaaguuuuuggauuacaagugugagccaccaugcccagccuaccccauuuacauuuaagguuaguauuguuauguguggauucgauccugucaucaugaugcuaccugguuauuuugcagacuuguuuaugugguugcuucguagugucacuggucuguguacuucaguguguuuuuguaguggcugguagugguuuuuccuuuucauauuuagugcuuccuucaggagcuccugcaaggaccuccugcaaggcauguugggugcuaacgaagucccuuagcauuuacuuuucugaaaaggaucuuauuucuccuuugcuuaugaagcuuaguuugguuggauaugaaauucuagguuggaauuaguuuucuuuaagauguuaaauauuggccucaaaucucuucuggcuugcaggguuuccauugagaggucuacugcuagugugaugggcuucccuuuguagacuaccuggccuuucucucuggcugccuuuaacauuuuuucugucauuucaaccuuagaaaaucugaugauuaugugucuuggagaugaucuucucgugagguaucuuacugggguucucugcauuuccugucugcauuuccugaauuugaguguuggucugucuaguaagguugggaaaguucucaaggaugauauccugaaauauguuuuccaaauugguucccuucucccuagcucuuucggguacaccagucagucauagauuuggucuuuuuauauaaucccauauuucucagagguuuuguucauuacuuuuuacuuuuuuuucucuauuuuugucugcuugucuuauuucagaaacauagucuucaagcucuaaaauuguuuccuccacuuggucucuucugcuauuaauacuugcaauuguauuauuaaauucuuguauuguguuuuucagcuguaucagguuggucguguucuucccuaucuuggauauuuuguuugucagcuccugcaauguucuauuaugguuuuuagcuuccuugcacugaguuagaaugugcuccuuuagcucaguggaguucauuuuuauccacguggugaggucuguuucuguuguuucagccaugucagccucagccacaguccgaacccuugcuggagcagcgauguugucauuuggaggagagaggccccucuggcuuuuugaguuuucuguguuuuugugcuaauucuuucuuaucuuugugggcauacuaccuaaaucuuugagguugcugaccuguggaugggauuuuugguuuuuguuguuuuguuuuuuaagagucuggccacuuuuuuguagggcugcugugguuugcuagguauccacuccaguccguaguugccucagauuuuccaauaccuggagguaucaccagcgaaggcugugaaacagcaaagauggcagccugccccuuccucugggagcuccaucccagggaggguacagacuuguugcugacuugaaugcaccuguaggagguagcuggagacccugguugggaggucucgcccagccaggaggaacgggaucagggaccugcuuaaagaagcagucuagccucacuuucauagagcagccaugcugugcugggguaccguuucugcgaccuguuggguugggcucuccaaagccuggaggcuggaacggcuaaguugcuaaaacagcaaagauggcagccugccccuacgccgggaacuuuguuccaggaaguuuucaaacuucugucaggcagagaacaauggugggaguggcuugaggccccuguugguaagucccacccagugaagaggaacagaugggggacccacuuaaggaacaucacacaccggggccuacugugggguagggggaggggggagggauagcauuaggagauauaucuaauguuaaaugaugaguuaaugggugcagcacaccaacauggcacauguauacauauguaacaaagcugcacguugugcacauguacccuaaaacuuaaaguauaauuaaaaaaaaaaaaaaaaaaaaaaaaagaagcagucuggucaugcuuuuguagaauagcugugcugugccgggauacugcuuccaucccuaaaugguucggacuccccuaagcccacaggcuggaaccaguuuaccaguuuuaaauguuuuuuugaggucauauguguuugauauuuucccuuuguaaaauuuaagaguauauaucuggauguguaacaaucuuuuccccguauaagcaucacucauuuaauagaauuuagaagaugaauuuaugaauuaaauaacaaacugacuuuaauuuuuucuuaucuucauggaauuugagaaacuugacauuucacauagauugccagagacuaccaaaccccuuuuacuguguagguuauaaacuaaaaugaaugugggaaaauguuuuaaaauguacuaacaacuauuagugagagcccuuguccuaguaaacagacccuuguacuuggacuauaauugucacaaaggcccaguuuuaucauuugccuaucuucaucaggauguucauuaggugugugugaguugcaggaccuaauuagagcugaguuuccuuagcuaugcuagaauugaauauuucagucuauggcuuuaugggcugcuauugcuaugcaaggauaccuuuaacaaacgggucagauauacuuaggggggaauguuaguaaauagaacaguaauuauaauuauggagaaagugcaaaaagaguuaaauuacugaccaugguuucaaauuuagaaacauuaaguugaacuggagccaaauuacuaaaauauuagagauuucuuuugaauaacgggaauauuuuaaguuaucuguuagacuaccagauugucuaaugaaccuaucauuuucagcaucuuacgaauaacuuuagugcuuuauaauaugaauuauuuuuaguguuuuacacuacugagaucuugaaaaaauaucauuacuuuuauuagaacuuugagguucuaauaaaacuucuaauaaaacuuucuaauaaaaccuuuaaaaaauuuguuacauucuaagugugauuguacugcauauggagauaaacaguuuuauaauggaacauaugccuuuuuuuaaauaaugaaguuuaauaggaaaaugacaaagauuuuaugccagacuuuuuaggaaucauuauuuaaaucuaaguuuuuaguucuuugaagguccuuuguaguauguacuucucuucccaauauuaugaauccagacuuagcucuaacuuuacacacuguaaauuugauugccauuugauauaacuuuucauugccccucaacuaugguggauuuauuaugccuuuuuuuaacucacgcuguuuucugaaaugccuuuauuacuguuccuaccuaugguuuuuguuuuuuuaggcccugguuaauuccuguuuauuccgugaagccuucaguccacacuaccuucucccuuucugcaaaugaaucacauuuauuauuuauggcaaauguuuuaauauuugaucuuauuugucuuauauuguuucuuaucuguauuauaugacaacauaccuaaauuccugguuauacugaaugucuugguagcaggugucuugauuaauauacuuuacagugaugagcucaguguuuaagacaguagguucuuaaaaguacuuaugcuguugcguugaguugaacugaaauaaguuggggauauuucuuaacauaaauuaugccccauaauauggcaugugugcuuuuugaaagugguucuaacaauuauguauauuuuucauugucuuuuugaaaacauuccaguugcugaaucaugcuuauuuauugaaggacuauuuugagccaugccguaggaaagauauauuaggauuauacuaucaacauugguaaaaaguuaauuuuuggccgggcaugguggcucacaccuguaaucccagcacuuugggaggccaaggugaguggaucaccugaggucaggaguuugagaccagccuggccaacauggugaaauccugucucuacuaaaaaaaauacaaaauuuagcuggguuugguggugggcgccuguaaucccagcuacucaggaggcugagacaggagaaucacuugaaccugggaggugaauguugcagugagcugagaucgugccauuguacuccaggcugggcgacaagagcgaaacuccgucucaaaaaaaaaaaaaaaacaguuaauuuuugugguacaguagacuuuuuuggaauaaugcauuuaguguuuguguaugccuauaugucuuuauauuuuauuaugugaaaauucucuggcuucuucuauuaauuuugcuucccucaaaauaacccacucauucugauucauguuagccucuugcucuccuuaaaugguuguaauuuuucucugcccuuugauuguaagauuccuuagcacuaggucuggcuuuugaggucuuuugagcagaacucaggucugacagguuaagggagaucuaauuuuuuccuagucuuguagguuagugaucccuacugagacaagaugagauggaguaagagagacguuucuccccguaggacuaucugggugaaugcugaguaaagguaggucagucugcaacaaagagauugagaacaguucagccuaccagcauaguuugggacugccagaguaagcaggauuuaccauauguagaaauuauauguagcauguagcagauguggccccucucugcuugcuaagguaaucuaccuucaccaggcaguuggacccuuuugaagguucagguuuuacugccugaguaaauuucuguucucaccuuuggccccguggaucucuugccccuacaugcucuccuuuagguacacugggcuuguuucaguuuuugauaugccauacuggggagaggaagccaaggguauguguuuacaucuuccuauuauuguuuauaggaaaaguuugcuguuucuacugucuuucuacgguuucuagguuugcaaggcuuuuuagucaauauaguuuuuuaaauacuuguuauagugugauguuauaaaauauguuuguuuguaaagaugaauauucuagcaaauauucucuaccaaaaaauuuaaaaauagccaggcaugguggcacacaccuguagucccagcuacuugggagggugaggcaggaggaucacuugagcccgggaggcugaggcugaggcugcagugagcccugaucaugccacuguacuccaaccugggcaacagagaaagacgguguuaaaaaaaaaaaaauuuuaaagaucaacauuuagucacauucauugugugaauuuuucugauauucuucauagcuaguuggaaaguauagguggaaauaccuuucagaauugcauguuuguuguugcuguuucaugauguaucagucucucaucaaagaaauguucugugugccuauaacuaucacguuuacacuuuucaugugcuuucuuaggguggaauuccuugaccaauggcaaccuaggugaaguuugcuauggauccucuuugagccgauccucaauaaaauaccagagcaauuacuguacccacauuaauggucuucuaaucuccaaccuugcauguaauugcuacugucacauacaauugcugucugcccaaguuucuuucccuggggacacuugugccguuccuugauauagaguuagaaaaugaaaagagaguuuuugaaacuuuuugaggguuuggcuuuuaaaucugucuacuuugagaauuuaaaacuauaaaauuaagucacuuuuuuuuuuuuuuuuugaaauggugucucgcucuguugccuaggcuguagagcaguggugcaaucuuggcucacugcaaccuccgccuccuagguucaugugauuccccugccucagccucccgaguagcugggacuauaggcaugugucaccacguccaguuaauuuuuuguauuuuuaguagggacaggauuucaccauguuggcccggcuggucucgaacuccugaccucaggugauccgcccgccuuggccucaccuuuuuuacuuuuguaggacugacucgaauaagucugacaauaauaaaagaugauaaaaaagauuucaagguucauugauuguaauuauauuucugaagaauuaauuaugaauacauuuccuuuauggauuaggaccauauuggccacaguucaaaaaauguaauucuaagauggugguauuuuuuaaaaaguguauauaaaaagugcauaaucuagaauuaauucaauuuuaugguugugguaauaggacaagaucauaaucuaguggcucuagauuggggauuaccuauuaaaguaaugccuucuuuaccccagauuuggagaaugaauucuacagagugaauuuuucagcaaaucaaaccuaccuuuucaaguaucugaacuuuuuuucacuuuuagguagucuuuguaaagugauaauaaguuuccuaguuucuuuuuuuuuaaauuauacuuuaaguucugggauacaugugcagaacgugcagguuuguuacauacauauacaugugccaugaugauuugcugcacccaucaacccaucaucaacauuagauauuucuucuaaugcuaucccucccccugucccccaacccccgauaggcccuggugugugauguuccccuccccguguccauguguuuucauuguucaccucccacuuaugaaugagaauaugugguguuugguuuucuguuccuguguuaguuugcugagaaugaugguuuccagcuucauccaugucccuguaaaggacaugaacucauccuuuuuuuauggcugcauaauauuccaugguguauaugugccacauuuucuuaauccagucuaucacugaugggcauuugaguugguuccaagucuuugcuauugugaauagugccucaguaaacauacgugugcaugugucuuuauagcagcaugauuuauacuccuuuggguauauacccaguaaugggauggcugggucaaaugguauuucuaguucuagaucccugaggaaucgccacacugacuuccacaaugguugaacuaguuuacagucccaccaacaguguaaaaguguuccuauuucuccacauccucuccaguaccuguaguuuccugacuuuuuaaugaucaccauucuaacuggugugagaugguaucucauugugguuuugauuugcauuucucuaaugaccagugaugaugagcuuuuuuucauauguuuguuggcugcguaaaugucuucuuuugagaagugucuauugauauccuuugcccacuuuuugaugggguuuuuuuucuuguaaauuuguuuaaguuccuuguagauuccagcuauuagcccuuugucagauggauagauugcaaaaauuuucucccauuuuguagacugccucuucacucugaugauaguuucuuuugcugugcagaagcucuuuaguuuaauuagaucccacuugucaauuuuggcuuuuguugccauugcuuuugguguuuuagucauaaagucuuugcccaugccuauguccugaaugguauuggcuagguuuucuucuaggguuuuuauaguuuuaggucuuacauuuaagucuuuaauccgucuugaguuaauuuuuguauaagguguaaggaagggguccaauuucaguuuucugcauauggcuagccaguuuucccaauaccauuuauuaaauagggaauccuuuccccauugcuuguuuuugucagguuugucaaagaucagaugguuguagauacgugguguuauuucugaggcgucuguucuguuucauuggucugucucucuguuuugguaccaguaccaugcuguuuucauuacuguagccuuguaguauaguuugaagucagguagcgugaugccuccagcuuuguucuuuuugcuuaggauugucuugucuauaugggcucuuuuuugguuccauaugaaauuuaagguaguuuuuucuaauucuuugaagaaagucaaugguagcuugauggggauagcauugaaucuauaaauuacuuuucaugacauugauucuuccuauccacgugcauggaauguuuuuccauuuguuuauguccucucuuauuuccuugagcagugguuuguaguucucuuugaagagguccuucacaucccuuguaaguuauauuccuaggaauuucuuuguagcaguuuugaauggaauuucacucaugauuuggcucucuguuugucuauuauugguuuauaggaaugcuugugauuuuugcacauugauuuuguauccugagacuuugcugaaguugcuuaucagcuuuaggagauuuugggcuaugacaaugggguuuucuaaauauacaaucaugccaucuguaaacagagacaauuugacuuccucucuuccuauuugaauacccuuuauuucuuucucuugccugauugcccuggccagaacuuccacuacuauguugaauaggaguggugagagagggcauccuugucuuccaccaguuuucaaagggaaugcuucuagcuuuugcccauucaauaugauauuggcuguggguuuguaauaaauagcucuuauuauuuugagauacauuccaucaauaccuaguuuauugagaguuuuuagcaucgaaagccuuuucugcaucuauugagauaaucaugugguuuuugucauugguucuguuuaugugauggauuauauuuauugauuugcauauguugaaccagccuugcaucccagagaugaagccaacuugaucgugguggauaagcuuuuugaugugcugcuggauucgauuugcuaguauuuuauugaagauuuuugcaucgauguucaucagggauacuggccugaaauuuucuuuuucuguugugucucugccggguuuugauaucagguugaugcuggccucauaaaaugaguuagggagguuuaccucuuuuucucuuguuuggaguaguuucagaaggagugguaugagcuccucuuuguaccucugguagauuucgucagcugugaauccgucugguucuggccuuuuuugguugguaggcuauuaauuacugccucaauuucagaacuuguuauuggucuauucagggauucgacuucuuccugauuuagucuugggagggugcaugcguccaggaauuuauccauuucuucuagauauucuaguuuauuugcguagagguguuuauaguauucucugauaguagcuuguauuucuguaggaucaguggugauauccccuuuaucauuuuuuguugugucuauugaaucuucucucuuuucuucuuuauuagucuugcuagcagucuacuuuguuaaucuuuucaaaaaaucagcuccuguauucauuuauuuuuugaaggauuuuucaugucucuaucuccuucaguucugcucugaucuuaguuauuucuugucuucugcuagcuuuugaauuaguuugcucuugcuucucuaguugguuuuauuauuauuauuauuauuauuuaauuuuuugagauggagucucacucuguugcccaggcuggaguacaguggcaugaucucggcucaccacaaccuucgccuccuagguuucaagugauucuccugccucagccucccgaguagcugggacuacuggcacgugccaccaugcccagguaauuuuuguauuuuuaguagagaugagguuucacuauauuggccaggcuggucucaaucucuugaccucgugaucugcccacgucagccucccaaagugcugggauuacaggucugagccacccacauaguuguuuuaauugugauguuagggugucgauuuuagaucuuacccgcuuucuccugugggcauuuagugcuauaaauuucccucuaaacacugcuuuagcugugucccagagauuuugguacguugugucuuuguucucacuguuuucaaagaacuuguuuauuucugccuuaauuucauuauuuacccauuagucauucaggagcagguuguucagauagaaaugaccccugaaaguauagucuuuccuaguuuuuuuaaauguaguuuacugaacacauuuuuucauuuuucucugcuuuuuaaauugagacauuaaaauucacccacuguguucucccauuuaaguguacaauucagugguuuuuagcauauucaugaaguuguacaaccaucauuacaauucaucuuagaacauuuucauccccucaaaaagaaacuccauacccuuuagcucuuaguuucagucuccucauuucccucagcccuaagcaaccauuaaucuaguuuuuguuucuauagauuugccuauucugguuucaaauggggaauaucacauguagucuuuuaugacugacuuuuuuuauuaguauguuuucaggguguucuuucacauuguagcauguaucaauacuucauuccuuuuuauggaugaguaguauucuauuguauggauaugccacauuuuguuuauccauucaucuuuuuuuggacauuuggguucuuuccaccuuuuggcuauuuugaauaauguugcugugaacauuugugugcaaguuuuuguguguacauauaucuuuauuucuaauggauauauauccaggaguggaauugcuggaucgaaugguaauucuguguuuaacuuugaagaaccauuggacugucuucuaaaauggcuacaacauuuuauaguccugucaacaguguaugaggguucugauuuauuuucugccuuuuugauuguagccauccuagugggucugaaaugguaucuuguugugauuucaauuugcauuucccugaugacugaugauauugaccaccuuuuaauguacacauuggccauuuguauaucuuuuuuaaguuacauuucccuuucuuguuguaagcuuguaaucucauuauuagaaugaauuuauugguuauuuagacuaauuuucugucuccagauuauucuagcauacagucuuuuagcuucuauuggaagacucuuaaugaagggaaauuuacuauuugugaagaaauuggcccaauuuuugaagaacuccaguuguuagaagcuucuuuuuauauuaagccaaaauuuauuucacuguuuugguaucguuauuguuuucuacucuguuauauuuuugcuuuuuaggcccacauagacgauguucaguuuuuuauaugagucuuucagaaguuuuuuuuuguuuguuuguuuuguuuuuuugacagagucucacugucgcccaggcuggagugcaguggcgcaaucucggcucacugcaaguuccaccuccugguuucacgccauucuucugccucagccucccgaauagcugggacuacaggcgccugccaccacgccuggcuaauuuuuuuguauuuuuuaguagagacggaguuucacuguguuagccaggauggucucgaucuccugaccucgugauccaccugccugggccucccaaagugcugggauuacaggcaugggccacugcacccggccgagucuuucagaaguuuuaaggcagcuuuuaagucuccucaucuccagaccaaauauuucugauuucuaaaauuguucuucaucuucuucaccaucaagucccacuaccuucccagucauucuugugugaacaaauuucaguuucucaacaccucuuuuagaguauggccuuuggaauugaacagacuguuuuaggcauagugugaccacuacagaauagaacuuuucucucuuuagaacacuauacuugcacugauuguggcuuaaaauuaccuuaacacuucuugcaaccacauuacaauguuaauuauucuuuaacuuucaguaaacuaaaauccugucuuuuuuuauacauucuguuaugcaaugucuguuguguacuaaguucaauacuuuauguguacccguauuaaauuucauuuuauuuuauucaacaucuuauucccacauugaagauuuuugggguggggggguccugaaugugacaucuagugugucaacugucuuucauugacccugucauccggaaauuagauuagcaugcuuuuuuuuuuaaguuuuuuuuuuuuuaauuuaaguucuaggguacaugugcacaaugugcagguuuguuacauaggugaacaugugucauguugguuugcuguacccauuaacuugucauuugcauuagguguuucucuuaaugcuaucccucccccuguccccacccuacaacaggccccggugugugauguuccccacccuguguccaaguguuaucauuguucaauucccaccuaugagugagaacaugcgguguuugguuugggaggccgaggagggcagaucacuugaggucaggaguucaagaccagccuggccaacauggugaaaccuugucgcuacugaaaauacaaaaacuagccgggugugguggcgggcaccuguaaucccagcuacucaggaggcugaggcaggagaaucacuugaaccugugguggagguuacagugagcugagaucacaccacugaacuccagccugggugacagagugagacucugucucaaaaaaaaaaaaaaaaagugcgaguuguaggucagugauauguugcuccguuuuguauccauauggguugcuugcacauuuaguuuauggaauguagauaaugaaucauagcuucaagaaagucuaagaaauaagauuuugagaauucugcuuuagaaguugggauucacaauuucggaaacuauuaaaauguugaaauaguauucauacuuugguaagcuacaaauaacugauguucacugaacuuguguugucagucucuaaaucucucuuucaugaaaucaugcaacuaagauaguugcauggagacaaaaauaauggaaaagagaauggaauggaaacauaccaacuuuagcaauacuaaucuauuuauuuguguauuccuauucauguguuacauuaaaaauuauuuaugguauuuuaauucugggaagaugguaguggcuguagcauaguuuuugaauaguccuccuuccuuaacagaauaacuaggauagcauaaucaaaagcucuugagcaauaucuguaacaaaauuaguugauuagagaaaauagggacaaaccaccaacagcuaccagauuuauauuuuaaaaaaaaugaaagaaaacagauuuguguggcauuggcaucucuuuagaaggaagcagaaggaagcaguagaguaccuaugaguaccuuacuaucuugagaauggcagauuucuaaaauagccaacagguaaagcuaaaagggguuuuuaugcacuucaauucauggcugaguacaagagguucaugguaacguucucuagagcugccugggcucuaagcuucuaaaauuaacuagccaaaacuuucuuccaguauaaagcuucauacuaagagcaaucuacuaggaauuuaaucaaaaucaaguaggacaacaaggacaauaaagacaaaaggaaaaagaagaaccagagggggcaagagcuaaguauccuaggggccaaaauuuuuaccacuucaugaaaacaauagaaaagggagauagagaucuaaaaaucuauccugaccuauguuucugucuuaaaaauuuaagaacauuaaauuuagguaaagaugaccaacaaaaaagauuguuguugaaucucauaccaaguugcaauaguuaaggauuguaucuuuuucuuauaauauccagaaguuauauuauuggugaaaauaauuaauaugugcuuaauauuuguaugggucuugguaggauugccauauacuuuccaaaagacuaauaccauuuuacaaggccauuagggccauuagcuuauuaguaccuguuucacuguaauuuuacugccuuauuuauucuaauguagcuaguuaaaaauucauuguucauuguugcuuuaauuugcauuuugcaaauuauuaagggauguuaagcauuuucccaaguauugguguaugugaguagaacccuaaacccguggguaacuucaaguaucuaacuguugccuacuuauaaucauggucuguuuauccauugggucuuaaugauuuuuuuuuuuguacacaugagaucauuuggauacauuauagaaauauuaaccauuuguuuugcuugcuuaaaauacaguuucuucuuuuccuguuuauuuuugagacguuauuacagaaaugcugguuuaaauauuugaaucuuuugauguuuuaugauuuccuuugguguuuaaaauccaaaaaaaguuauaauuucugaacagcuaugauaaauacuauauucaagauaauuuucuaaagaaaaucuaaauuuugaucaguguuauauuucuagaaaauuagucauaauaaccugaagguaguuuuccaugauagccauuuuaaaacaguguuaaauugaguaaaaauacuaacaaauacaaaugacuuacauauugcgccuuaguuuuaaagugugcuggaaccaagacaauugacaaaagccaagaaaucgacaagaguaauauaauauuuauucuuaaauucuauuguggggugguagaaagcaauuuaccauuuuugguuuguuguuacaaagugaugacauuuacuugguggacuauaagagaaucuucggaguucuguugaccauauuaauuauauguaaaaauuaucucauauuucugugguguaaaguguuugguuaaaaaaaaaguguucuucagucuuuuaaucuuuaaaaaauguguuagcuaguguauguaguauauauacaaaaaauauuaggaaaggcugaaauuuggaggauuggauaaaauacuuguucauaucauuucuguucucauugcuuuuauuuaaaauuauuuuccaaugcuaauuuaagcauuuaugcaacauuucuagagaacugacauuuuuauaaaugucuggguuuuuuuguuuguuuguuuugggacagagucucacucuaucacccaggcuggacugucggggguuaucucagcucacuacaaccucucccucccggguucaagcaauacuccugcuucagccucccaaguagcugggauuacagauaugcaccaccaugcccagcuaauuuuuguauuuuuaguagagaugggguuuuaccauguuggccaggcuggucucaaacuccuaaccucggguaauccgccugccucugccucccaaagugcuaggauuacaggcaugagacugcaccuggcuaaaugucuguuuuuuaaagguuguaggagaugauuuuuuaaaauauugcuguguguuuguaauuuuaagagaaacagguuaaaaacauacguuuauggaguuccccuuucuugaaaaauuuuauaaauauuacuguuauaaguagcaaccaacaauauuuucaugguaaaguuuucuuuuuaaugcugugacaaaugguagaugagaugaaaccaauauucuuacuuuucuacuugaaaugaauagcuauucauguuucaggaaaaaauuuaguauuucaaaaggauuaucagaaaaguguuccucuuuuaaggguuuagaaugauaguauuaaucuagcaacuaaauuaugcauaauuuaucagaauaauuuugcuucaaaaauguuuaaaguuuucucuuugaacuaauggaguacuuuauguaaacauuuuaaaaguacacuuaaggcugggugugguggcucacaccuguaaucucagcacuuagggaggcugagguggguagaucgcuugagcccaggaguuaaagaccagcaugggugacaugguaaaacccugucucuaccaaaaauacaaaaaaaaaaaaaaauuaucccggcgugauggugcuugcuuguggucccagcuacuugggaggcugaggugggaggagaucccuugagccugggaagcagaaguugaaugagccaagaucacccacuguacuccagccugggugacagaaugagaccccaucccccccaaaaaaaaguacacuuaagaaacagacaaaauuuuaauuuagaauauugucaguauguaauaaugguuuccaaaauagcuuggagaaguaauauaauguaauuuaauagaacacaggcuuuggaauaucaaaggaucuuggugugaaucccaauucugccacuucuguggcauuggauacuucaccucuuuucaguuuuugaaucuguaaaauaaauauuuacuuauauuucaucaaaucuuuuuuuuuucuuuuguagagacagggucucaccauguugucuaggcugguuuugaacuccugagcucaagugauccuccuuccucagccuuucaaagugcuggaauuaaaggcaugagccacugcaccuggccaaaucuaaggcagacauuuauucaguuuuuaauauuuuugaaaucuguaugagucuuaguguauuauauuuaauuggcuaguuuuucuuucugaacauuacagaaaauaauggugcuucuuauaauugaggauaucuuagauuaaauaaaauacagugauaaugccagcuuuauagacucguuuugaaguggaaguuggauaguauaagcacauagaaaauauuccuuaaguauuaguuuucuaucucuuuuucuuauaacgaaguauguuagaguuuuuaugauugguuuguuugggggauuuguuguuguuuuaucaagagaaucaggaguuuagagcuauuagguaaagaccauaggucaauauuuuaaguccccacaucacaacaucuuguaucuauauugcugaaacacuuuugcguuggagaaauggccauguuuugggcaauaauaauuauuguauuagcuaacacuuacaaaauggccacuuugcacuggauacuguuuuauuuauguauaaauauaaauagguaugaaauagguacuauuauucccauuuuuacaaaugaggaaacugaggcaaagaaguagauuaauuuucccagcauucuacaguuagacuauaaaugaauuaaacaaaacaguaaaacaaauccaaaaaagguagcacacagaagcaagaaaccucuuugcauagauuagcuugauaaucuuaggaauagaagaaaaaguuucacaaggcuuuaaaucuugacucuaaaacugacuaagguggagucugaaucaagugauaaagauuuagccaacaacuuauccuuucccuuuugagugaaggagcauuuuaguuucucaacuaauagagucucaggcaauguaagaacuggcaaauuuuauccuguucgcugccaaauuggacucuauuuaauugcugaugcaacauaaaagugacuuaauggauuuugaguagagagaaauggaauaaacuucuaagccucuaugaaagaaauuucacuggaguggauaucaagaggguaaaguagccaaaguuuauccacucugguagaugaaguguauagaaaggaaaacuaacgcaucuuuggcaucuuuauucuggauucaaucugauaauggcagguuauuuuuaaaauauuauuucugccuaagauauaaucuuuuuauuuccccacaaaacauugugaccauguguauucuaacauguguauuugugcaguugcauuagaaagaggaacuaaucccaggaaaggggaauguauuuagaauauaccauaaucaaauuauggggucaguuuuuuuucuaaagauuuuaauuaaaaguacuuucuuuuuuuuuuuuuuggagagacggaaucucacucugucgcccagacuggagugcaguggccuaaaaguacuuuauuucuuauuuuuaaaaauauucauuaugucuguuuaugagugaaaaaaugaaaauaaccuaauauacaacuguuagauaaugguuaaguaaauuauauuacauuacugcauggaauauuaugcuggguuuaaaauuaauguuuguaggacuuauguuccugggaaugguggaguaauagggaugagauuuacccuuuugccaaaaacaagaagaaaaccagaugcauggcuaaaauuucuggaugaaacaguaauuuucagacauuguauuauaaguaguguaaaguuacaaaagaagggaaauggccgggcacgauggcucacaccuauaaucccagcacuuugggaggccaaggcaggcagaucacgaggucaggagaucgagaccauccugacuaacacagugaaacccugucucuacuaaaaauacaaaaaaaaaaaaaaaaauuagcugggcgugguggcgggugucuguagucccagcuacuugggaggcugaggcgggagaauggugucaacccaggaggcggagcuugcagggagccaagauugcaccacugcacuccagccugggcgacagagugagacuucaucuaaaaacaaaacaaaacaaaaaaaacaagcugugccuugcaggugcgucccauuuauuaccuggcagcauuuuccaggcugcaaggagggggaucccaaaauggccuggcagucuuaccauuuugaacuagaauuugcggggcugaauaccagagaggaugauccuauauugacaguuccagaggucugcagaggggucccuuuggcugaauacugaucuaugcauguauaagaggaaacuauuaauaacaggccggggaaagaaacauaagaaagcaguaggccaauuucuggagcugacauaggacugagaauauuuuguuuccuaccagucaggaguagaaugaaaauguaauauguggggcauaugguagaggcuucagaaggguuucacuucaguagcugugcuaaauuaaaugcuauaucaaaggcugcuuugcccuugccuuaacacugcuuaaaauugagccucaaaaggaucagacuaauuccaaguaacuuaaugcaugccaaaacaaaguccaacauaauuuaaaggaacacaacaaaauccagcaagcaagaauguaaaauuuauuacaaugccuugcuuacaauacaggucuuuaaagcuugccaaaaaggaaaaaaaaaagugggggcaggaaaauaugacccaggagaaaaaccugucaauaaaaguacaugguggaaaugauaaagaugauaaaauaacagacaaggacaugaaaacacuuacuuuacaaauauauacuauauauucaagaaaguagaggaaaaagugaacauauguagagagauggaagaugcaaaaguaucaaaauggaacuuuuagauagggaaaaauauaauaucugaaguaaaaaauagacuggauaugauuaacagcagauuagacauugcauaagaucagugaacuugaagcucgaagauggagcaagugaaacuaaucaaaaugaagcacagagcauaaaaagacugaacaaaaaaagaacagaacuucaaugagcugugggaaaauacaaagcaauguagcauucauauaauuggagacccagaaaggagaaaaaaagugagagaagacagaaacaaaauuuaguuaauaauggcugaaauuucaaauaguucauaaacuauaaaccagaguuuuucaaucuuugcuccauugauauucugggccagaaaauucuucuuuauggaggauauccuguacauuguaggacauuuagcagugacucuguucucuauucacuagaugucaauagcacugcguagugugacagcuaaaaaauugccccagacaugccaaauaucuguggauggagagggcaaaaaaaaaagugccccuaguugagagucacugccauaaacccauagauccaagaagcucaaugaaccccaugcggaagaaauguaaugaaaccauacaauacauaacaaauuguugaaagccagugaaaaagagaaaaaagcagacagaaaacaugaugaagauaaacaagguagaacuacagcagacuucuuuucagaaaucugaagucaauagguugacaacaaaaggaaaagacgaccaaccuguaauucuauacucaguuaaguuauaauagcuuucaaaaaugaagguaaacuuuacuuaacauaauggguauuuaugaaaaacccagagguagaucaggaauaagacaaggaugcuugcuuucaccacuccuguucaacauuguauacauaaauucuagccagagcaauuagacaagaaaaauaaagaaacagcauccaaauuggaaaggaggaaauaaaaauguuaaucggugacaugauccuacacaguauauagaaaauccagagaauccacaaagacaccgcuagaguuaguauguuaauucagcaaaguuacaagauauaagaucauaagaucagcaugcagaaaucauuguguucuuuagaccaucagcggauacucugaaauggaaacaaacaaaaaaauuccauuuacaauagccuuuaaaagaauuaaaaacaaaaaccugggaauuuuaaccaaggaugugaaagauuuuagacugaaaacuauauugccgaaagaaauuaaagaagaccuaaguuaauggaaauucaucuuguguucauggauuggaagauuuaauuuuauuuagauggcagcgcuguccaagucaaucugauuuauauggaauugcaaagggccccaaauagucaaaguauugaaaaagagcaaaacuaguggauucaaacuuugcaauuucaaaauuuacuauaaagcuacaguaauuaaaacaguaugguacugguauaaggauagacauauggaaaagaauugagagugcagaaaugaacucucaaguuuauggucaguugauuuucaacagggccacuucauacccaguaggguguccgcaauaaaaaagauaauaacaaguuuuggcagggauguagagacauuggaacugucuuagauugcugcuaagacuguacaauggugcagcugccauaaaagacaguuuggugguuccucaaaaaguuaaaaauagaauuaccaauucuuuuggguauauacaggaguggaauugcuggguaauuugguacucaaauaccuguauacaaaugaucauagcagcaguauucacaauagccaaaagugcaaacaacccaaauguccauuaacugaugaguggauaagcaaaauuuggcauuguuguauacauauaauagacuauuaaucauaaaaaggaaugaagaaccgauacaugcuauaauauagaugagccuugaaaacauuaaaccaagugagaggccagacaugaaagauuacauaguguaugauucaauuuauaugaaauauccagaaugguuaaauccauagagacagaaagcagauugguguugccaagguuuugggggagaggggaauggggagugacugcuuaguggguucaaggcuaaagguuugggggagaggggaauggggagugacugcuugguggguucaaggcuaaagguuugggggagaggggaauggggagugacugcuuaguggguucaaggcuuuuuggggggaauaacaaauauguuguggaacuagaugcaguugguugcacaauauugugaauguauuaaaugucauucaauuguacauguuaaacugguuaauuuuaugugaaucucaugucaauacaaaaagaaguaaacgugaaauaaagacuuuucaaggcuggaucugguggcucaugccuguaaucccaauacuuugggaggcugagaugggcagaucacuugaggucaggaguucgagaccaggcugaacaacacauugcaaccccaucucuacuaaaaaugcaaaaauuagucgggugucauggugggcaucuguaaucccagcuacucuggagacugaagcaggagaaucacuugaacccaggaggcagagguuguagugagcugagauugcaccacugcacuccagccugggccacagagugagacuucaucuaaaaaauaaaaauaaauaaauaaaaacuuuuuccaaauaaacaaaagcagguaauucauugccaacugaacugaacuauaguaaauuuuaaaggaacuucacaugaaaggaaaauuauauaagauggaaauuuggaccuccauaaaggaaugaagaguccuggaagugcuaaauauauggguaaauuuaaagacuuuuuuuaaauuuuaaaaucucuuuaaaagaucacugaacuuccaguuucagccucaacaugugaagaaccugcaaguuaucacuccucuccuuaacaauaacaguaaucugaccaaacugaaaaucaaagacuguucuagauccaucagagauugagguaccaguucaaacugccauccccaaaacuggagagacaggugaauacagagaaucauaaccaagauaacagaagaugcuugggccauaaacugguagaaacacuucaaugguaauggaugaauugcuugaggcugaguguggacuagggagucaaaaacuccuccccaguauuuuuuuuuuuuuugagacggagucucgcugugucgcccaggcuggagugcaguagcgcaaucuuggcucacugcaaguucugccuccugaguuccaccauucuccugccucagccuccugaguaacugggacuacaggcgcccaccaccaugcccagcuaauuuuguuguuguuuuauuuuuaguagagacgggguuucaccauguuagccaggauggucucgaucuccugaccuugugauccacccgccucggccucccccagugcugggauuacaggcgugagcccccacacccggccccuccccagucuuaguagggccuuccacuuugguagguuuuaucucccagaaucccauuuacgguaaagagucaagaaaaaucuuguguuuugggccaggggaaggagcauauaguuaacacuacugaguuaaauaccaaaaaugguuaaaaugguaaauuuuauguuuacaauaauuuaaaauuuuuaaaaagaaaugagcuauuagaccaugaaaagacauggaggaaccuuaaaugcauaaugcuaagugaaagaagccaaucugaaaaggcugcauacuguaugagucuaaucauuugacauucuggaaagaguaaaacaaagcagugaaaagaucacuaguugccguggguucagaguauggaggagaguggggagggagggaagggugaauagguagaguacgggauuuuuagggcagugaaacuauucugaaugguaccgcagugguggguacaugucauuauauguuugucaaacccauagaauguucaauacaagagugaacccuaauguaaacuauggacuuucauuaauaauaguguauuaauauaggcucaucagcuguaacaaaugugccacucaaugcaagauguuaguaaugggggcagugggugggagaguuguauacaugugagagguaugagauaacccuauuuuuuguucauuuuucuguaaaccuaaacuugcuuuaaaaagaagucuaaauaaaaaagaaaaaagaacuauacuuauuuuuuuugaacuaccacguaacucuuaauuaguagucuuuauuucacagcaaauaauuaccaaguggaccauagcuaucucuucccaauugucuauuucacuuuaagagagucaaugaauggcgccaauagaagcuaugauugucucaugaacaaccuugucuuauugcuucuuaaaugguuauguccuuugccuauucuauuuaagacacccuguaccuuaaauagaguaggcaaaggacagaaacauuuuaaguucucuaacacagcaguccccacccuuuuuggcaccagggacugguuuaguggaagaccauuuuucugcagcagggauuagggggccaguguuggagggggaugguuucaggauuaaaccauuugacuucagaucaucaggcauuagauucucauaaggagugcguaaccuagaccccucacaugugcaguucacaauagucuucacaguccugugagacucuaaugcuauugcugaucucacaggagguggagcucaggugguaaugcuugcucaaccgccacucaucuccugcugugcggccagguuccugacaggccauguauugcuacuggccugcagcccagggguuggggaccccuacucuaacauucugugcauacccucaucauagggccuuugcacuggcuuuuuccuauggcuggaacaaucuacuccagauaccugcaagacucacuucuucacuuccuuugucuuuauucaaagggccuucucuagaaggcuuucccuaaccaucuuauuccaaauuauaaccuuguuccuggaccuguuuuuuuucuucauaauacuccuuagguuuuaauauuggaaaacuuauucauuuauugucugucucugucagaccuaaccugauuuuugugugacgauuuuguauccugcaacuuugcugaauaacagauuggguggaaucuuuaggauuuuuuuacauauaaaaucuuguugucugugaacagauaacuuuaccucuuccuuuccaauuuggaugccauuuuaggaaaaacuuucaaacuguguuuuuccucugcucucauaccacuacaacaacagaagacuucugugaccaaauacguggggauuucuccccaacauuaugugagcaguucugcagcagacaccaacuggguauccuccuaaucaguucugacacuaggugccuagagauagugucagauuccacagguugaggacucaguccccaggacugccucccaccccuugaccagucacaagccccggucuccagaauuucuuaccaacuggcuucaaguugugguucccaugacccccucuuuggguucaacugaguucuggaguggcuuacagaacucagggaaacacauuugccaguuuauuauaaaggauguuacaaaggauacagaugaagaugucgagggaaaaaagccaaacugcaaaguauuugaagagauuuauucugcaccaaaugugaagaccaugacccaugacacagccucagaaggucuugagaacauguacccaagcugaugggguuauagcuugauuuuauauccuuuaaggagauaugauagcauuaacauuggccuggauaccaucuugaauagaagugaugagaauagauauccuugccuuguuccugaucuuagaaggaaagcuuucaguuuuucaccacugaguauguuguuaacuguggccuuuucauauauggccuuuauuauuuugagguaguuuuguuuuuguuuuuguuuuuugagguuucaauauuuuauucagguuuuuuuaaagugauguuaauuacagcauuugaaggggaggaucuaauuccacacaaaauggaagacucuaaaauguacccauuaaacugcuaaaaaacaaauugaguggugagaauacaacagaaguccaauuuagauucugaguguugucaccaugugauuacaaucauacagacacuucuaagcuuauagguggagcuccuggaagcuauuucauacucuggugcaagggcaaaaaaacacaacgcaagaaggaauaaguccugaauuauuggcuuuaucacguccacccucuccaccccaaaauggcacaaaagaaucgugaccacaccacucugcagacguuuugguguaaaagaggugacgaugaacuggggugggaacaggucaugaagauaugucuaaaaaaaaucccauucaggugaguuuguacacaccaucaaguagugagcuucucaucaauuaggguuagauaaacaagguucaauucucaggaaaucacaauuucuuucauuuacucaauaugaauuuacaaagugccuacauauuaucagcuuccacuugcagccauuucuagauaaaaaagaaaccugauaucucaaaggggccaccaaguuacccccaagucuaccacugaaaggaccuuuuuuggaaaugguuuucuucuguaccucugaaaggguaacaucuuaaagcugaaucaucuuuaaccuggaggucuaacauauuuagcaauacuugcauuccagacguacaacauuaaacgauacaguaaauucugaagguagcuaugcugcaaaauaguuuaaaauuaaacaauuguacaguauucauuuaugcuugaaauuccaggccuaaaccaagcuuguggccaccaccauugacguucuugccauccagaagagcugacagugucaauuugauaccugguuuuagggucugaguguauccuaaacccaucaggcuggaguuauucacuuuagccgagaagcagcugucagagucaaucugauacuuggcugcuauucugaagugcguguuacuguuuccugcuguccaggcgagauugacagcggucucuaacuucuuguucaccuucugguaaauggagcugccaaacucugucccgucauucauauuagugugaagcuggaauucauaagucuuguagccaacugcaaaguugcucuggguuacucgggacuuugcagucucaaaauucauccaggcugggcauggucgcucaugccuguaaucccagcacuuugggaggccaaggcgggcggaucacgaggucaggagauugagaccauccuggcuaacggugaaaccccgucucuacuaaaaaaaaaaaaaaaaaaauuagccaggcgugguggcgggcgccuguagucccaguuacuugggaggcugaggcaggagaauggcgugaaaccaggagacggagcuugcagugagcugagauccugccacugcacuccaaccugggcgacagagcaagacuccgucucaaaaaaaaaaugcaucugguagccggccagccagcccucguaacccagcaccagaguaccccagauggaaaggccagcgauguugaaauccgugucgcagcccagguuaaugugcuucugcuuguacccugucuugauuuuagcuuuuuuuuccccaguguuaggugagaaggaugaauugaagguaagcuucagaucaugugcaagcugaccuuccacgguaaucucggugccuaguguauugucgguguuccauuucucuguaaacgucaggccguacucaguccaucuguacuugguuuacagacugcccaugacuuugguggucucaauguuggcugagccugagcuuguaaauuccaauucauucucagauuuuguuuucaaaucaagccaaauccauaacccuuggugaagacaucccuggcagauuugccaagauuggcauucguggguggcacagccaccuucggcuuagaggcauuggcagcaggcucgguugcggcuauggccuguugagguaguuuuacucuauuccuaguuuauuaauacauugguuugguuuggaaagacaggacaacucgaagcagugacuuaucauagguagauucaaagauuuucugauuggcaguugguugagaguuaaguuauuaucuaaaagcuuggaauuaauagaaaggaauaucugaguuaaggauuuguggagaccaagguucuuacuauauagaugaagucucauagguggccacuguuagaugcaauagaugacaauuguuuccuauucagaucuuuaaaagauucuucagaucucucagcuaaucucuuuaggaucagaaaaagaccuggaaagggaacaggauucuuuacauaauguaaaauuucccuuuuaagagauggcuuugcagggccauuucaaaauaugucaaauauauuuugggauaagauauuuugauuucuuccagggucugcucucugucaugugaugcuauacuagagucagguuggaauuugauaucuuauugauacaaagagucuuuuuugucaguugugagaucucuguuuuaauguuaaugcuggucaguuguuccugaaugcuaaagggaggaaaguauaaugaggcauguccagaccccgacuucccaucauggccugaacuaguuuuucagguuucuuuggagaaaccuuagcugagaggagggguucauccagaugguuguagggcuuagaacuuuauuuuugguuuacaaggagauguguagggugaggcauggaggaagggacauggcgcuuucaugaucucucugggcaugccacccuccaggaaccuccauguguuccacuauccccaggcucccagcacccauuccucuuggguuucaugaugucaguauuccuuccccuaggguauagggcaggacucucucucgggauugugacccacaaucagaaaggguaaccuggggcagguaaaaggagggcaggagaaagucccauagauucucuuuccugaggcuugcuccugaggccugacacaccuaauuauguaacgaaagacuguaacaagggcaauaggaguuagaaaccaggaaccauggacaaaaacaaaucucuuuugugcgcacucucucacucucgcucucucucuguacacacacacacacacacacacacacacacacacacacacacacagcauaacaccacaaaugccuuuuauuucuugucugaucgcuguggcuuggauaccaucuugaaaagaagugaugagaauggauauccuugccuuguuccugaucuuagaaagaaagcuuucaguuuuccaccacugaguauguuguuagcuguggccuuuucauauauagccuuuauuguguugagguaguuuuauucuauuccuaguuuauuuaguguuuuuaucaugaacacauguugaauuuugucagaugcuuuuucuguaucaauugagaugaucauguggguuuuguccuucauuguauuaauaugcuguguuauaugauugauuuuuguauguugaaccaucuuuacauuccaggaauaaaucccaguugaucaugauguauaauccuuuuaacguaauguuaaauucaguuuauuaauauuuaguugauuuuuuggauuaauauucaucagggauauugguuuuaguuuucuugcaguaguuuuggcuuugaugugaggauaagaccucauaaaaugaguuagaaguguucccuuuucuuuaauuauuuugauguaugaagaggauugguguuaauucuucuuuaaauauuugauagaauucuccagugaagugaucugguucugggcuuuucuuuguagggaaguuuuuuuuuuuauuacugauucacucucuuucuuggugauaggucugucagauuuuugauuucuucgugauucagucaugguagauuguauguuuccaggaauuuauucauuucuucuagguuauccaguuuuuuggcauguaauuguucauaguuaucucuuaugauucuuuguauuucuguggcauuaauuguaacaucuccacuuucauuucugaguuauuugacucuucuuuuuucuuaguuaaccuagaauagcucauuucuuuguguugcugaauaauauccuauuuuauggguguaucauuugcuuauuaaucuauuuaaggacauauuggauuuuagccauuccaauagguguguagugguuucucauuuuuguuuucauuugcauuucuuuaaugacaugauguuuaaacaucuugucacucgcuuauuugcuaucucuguaucuucuuugguaaguuguccauuuagaucuuuuacucguuuuucauuggguaacuuauuuucuuaguguugaguuuuaagaauucuuugaauauuuuggauaccagucuuuuauuagauaaguguuuugcaaauuuucuuucaguuuauggcuggucauugcauugucugaacaauaucuuucacagagcagaaauuuucaguuuuaauaaagaccuacuaaucaauuuuuuucucucauggauuauaaauuuuuuuuuuuuuuugagacagaaucuugcucuauugccaggcuggagugcaguggcgugaucuuggcucacugcagcuucugcaucccaggcugaagcaauucuugugcuucagccuccuagguagcugguacuacagucacgcaccaccaugccuggcuaguuuuuugcauuuuuaguagaggugguauuuugccauguuggccaggcuggucucaaacuccuggcuucaagagauccaccugccucagccucccaaagugcagggauuauaggugugagccauugcaccuggccugucauggauuauacuuuugauauugcauguaaaaagucauugcgaaacccaguaucaccuagauuuuccgccauguuaccuucuaggagucauucuuuuuuaagaagcuaugcuugccacuucauacuugguucuaucucuauuuuuuuuccuuucguauccaguuuucucauuuuuaguuuuauuuauuuaguuaucaucucgagcgccaaguauguuuuaguuuuauccuaucaauggaacauguauuuggaauauaauuggauuaaguaaaauaaguucucccuuuguacacguuccucagcuuauaaugaggauacauacugguaaaucuauuauaagucaaaaauaucauaaaucgaaccauuguaaguuggggaucaucucuacuuuuuuuugguauaaagaaauacauuaucuaucccagaaauucuucauagcauuuauucucuaaaaauggcccucagagcacagagaaaucugucauuuaccuagugcuucuuguuugcuagcaucauacuaauacacuuuauauacuuugucauuuaaucauguuaauaguugucgucuaugauuuuauaacuuuguuucuauuacaaguugauaacugacuugauucaucuccucaaaaauuuacaacauuuuuugaaaccuuaguucccccaguaguguuaggaacagauagaauaugcuaucuccggggaagggggucuuuuuccucagcccagugauccacagacugaaacaaacaauuaaaaaacaaaacaaaacucguacuucucuuaaguacugaaaaaauguguauggggauugacuguauuuuauuugaaguaaaacuagucuuuuugcagucaaauuaaauaauaauguaauuuugauucuaagggaauauuuauguccggaaucagaguuuugacuuuugcaggguguccuguacuaaacgcugucaauacaugggguuuugcagagguugcacuuugauccuugcagacaguauuauccagguucauugcuuccacauuacauguuuuagaagaaucuuauuacuaaauuaauuuuacucuuguguguuuugagaacauagaggggcaagacguguugaauccuugaguuuggaaaguauuucugugcaguuugcuucuuuuuucuuuuauuugagauauaaaccuccuuuccuaucccuccucuaccuuuucuccuuccuuuuuuuuuuuuuuaacccaaaaacauuuucuuuauaauuaaauuugaacuuuuacuguaauguagcuucuuauuugggaacuuuuauaaaucuagauacgauuuugcugaucacauucaugucugggauuuauuuuucuuuuucucaccugaacauccauauuuaccacauugaacaucaucucacagucagcuaggagaauuguuuuuugguggcuccagaaggcuguacuggaauaccuuagauugccagccagguacccauuccacuccugugaugaccugagaauccuauugccuuucuguuaccaccuuaaaaguuuuacuaggguuugaagagaugguugaggguaaaauccuuagucuuucuuagcaaaauaacauuuuguaacugauuuaaauaccuauuguuuuaacccauuugucuuuuuuucacuuuuuuuucuccuucccacagauaccagagaagaaaggaaaagaagcaaauacagguuuuggugggccaguuauuaguucucuauaucaugaagaaaccaucagguaauuucucuucugaucuuugauaauagaaauauauaugccugugugugugcauguguuuguauguaugugcuuauguauguguauauguguacuauauauuuuuaauccugaaaucuucaauuugugaagcauuccuucuuaacaugaaacugauuuggugguauuugccagcaggacaauaaaugacaggaaauaauuuuuuagguguauaaucuuuaaaaucaauuaaaugucugaaccagugccagauaagucugaauaagugauaauaauuacuuuucauuggugucuagugacgacugucucauucaaugacuuuccccacacaaguaguuggugggacaagauguugugucucaaucuaaagcuaaggauuuuuguguuaauuuuccucaaaauacuauuauuuuaaauauuuuaauuuuuuaauuuguuuaauuaaaaguuaauuuaauuugcuguaaauuaaaaguaauuuuggaguauaaaaugauacagccacuguggaaaacggaaguuuccucagaaaguuaaaauagaauuaccauaugauccaccaauucuguuucucaagaagcagaaacaagaaagcagaaucucaaagacauauuugcacacccauguucauagcagcauucuauacaguagccaauagguggaagcaucuguugacagauggauggauaaacaaaaugugguauauacaauggaauauuauucagccuuaaaaaggaaggaaauuuugacagcuguugcaacauguaugaaccuugaggauauuacgcuaagugaaauaagccagucacaagaacacaaacacuuugcgauuauacuuacauaagguauuuagaguagucaaacucacagaaacagaaaggauucaaaaaucagagagacaguaaaauggugguugccaggagcuggggguaggggaaaugggaaguuguuuaauggggacagaguuucaguuuuacaagaugaaaaaguuacggggauugcacaacagugugaauauacuuaacacuacugaacuguauacuuagaaauacuuuuagcuuuuaguuuuugauagugaagaucauauuuuacccaucuuugcauucucacuaucugaggaaggcccccaaacuuaguagaucuucagugaaaguacucagaacuugggagguagccacagcugcuucccuugaagagcugauaguuuagugacuauugcuuauguagaguuagccuaagagcccuauuguaagacagagagcugcugguuugguucuucugugauaugccuauccuaaccucuuucucuuaagcaauaaaaaauguauaggcuauuuuucuuuccuaguuagauaaauaaauugagauaguuucuugacuuuccuuuuaaaaaaauuacuaagcuuaaguuucuaacaauaucagucacuuaucuguaaaucauaaugaucuuuauuuuguaugccauuuuccuuaagggcucccauacucuaguauuuuucaaaaugauguacugaauacauuuucuuuucaaaugucugaugacgugacugaucacagcagcccuacagaacacgaagcaaaucaaauguacuccaguuguagugagaguagaaauccugagauagaguuaaacuguauugaaaggguuaaucuuccuuccuuuaucccccacccaauugcuagugaagugauucuuagauuuaaaucaguauuuagaauuuugacagugauaaacaaugacaaagaauaauacaguuuauuuuuguagagauuuaaauucaauucaacacacauuuauuaugaaccuauaaugacagaaaacauuggaauauuugugcuucucaacuucuucacuuuugaauaauauguucuuacuacuuuuggcauuuucaugaaaguauguuuaauaaauauuaauugaaugaaauaugaaccuuugugggcaaaauugguuagacuuggccuuuuuuucaugaagucuucauuaaguauuagucuuaugauaucaucuaaaucuucauauucugaacauauuguuaagaaagaguaagaaacaugaaugugagcaagccauugaaagcuguuuaacuauuacaaacacaguaauuuuguuacuacuacagcagaucagaaauuacagcaacuaaucauacucuuguauugggagaguucuuuuuauaguguagaauuccauuauaacaaauuaggccauaaugaaaauucguuguuuuuugguuuuugguuuuuuuuuuuuuuuugagacagagucuugcucugucaccaagcuggagugcagugguaugaucucagcucacugcaacaucugccuccuggauucaagcgauuccccugccucagccuccugaguagcuggaacuacaggcgcaccaccaugcccaacuaauuuuuguauuuuuaguggagacaggguuucaccauauuagccaggauggucucgaucucuugaccucgugauccaccugccuuggccuccccaaagugcugggauuacaggcgugagccgcugugccuggcaugaaaauucuuauguacugaaauguuggauuauuccagugaagagccagauguaguccguaugguuucuuacguaucagaaugcaauugcaacaaugaaaauggguuauuucuugaaguuauguaaucaaauuaugcuuguauuuuggugaaauauaucugguguuuuauuuuucuaagagaaaguugugcuuuaauugauauuaauugcaauuucuuggcagaauuauauuuaacugaggcgaaagugacaguagguuuuagaguuuuagaagcaucaaaugguagacuuggaugaaagcaaaaauucuuuucuauggaacuguuauuuuuaaaaaaggacauaaaauaauguauuuugaagguuuguuuugauacuuuauaacuccagauuuuuuuuacauuuguaaagaucaggcaaaucacuaucuaauaaauccauuugguuaaguuuggguuccauuguuguggcagcuuuucugacgaauguguauuguauaauagaugaugaguuaugaguuugagccaagggccaguggggccaauucugagcuugcuuccugcuuucuacucugucauagaaaguaucaauauaaugucagagguucagaucucuguguuaauauugcagagcucugacaucaauuucucauucugaagcaaguuaauuguucuguaauauaauugaggggguguagggggauucuaauuaaguacaaaaaauuauggagccaaaccgcuggcauucaaaugcuaguuccaccacuuacuagcugugugaucuugggcaaguuacuuaccuguaaaauggggauaauuauaguacuuaucucacuugauacuuagcagauuaugugaauacauagacauccucgaacaguaccuggugcaaaauaaguuacuguguaacuguuagcuuuuauaaauaguauuguuauucggcagagggagucccuacagaggagccaggagcugauguuaggagcuacaauaacauggcauucugguuauauaauuaaaugcaaguuguuugcuuuugcaaaagaaaauggaaaacaaggaagggagagccaauauuuuuagaacuauagaaacgagaguaacaaaucuuauaacagggaguaaccucugguuuugcgaucagcuguuuuucauuuauaccgcagaugggcagaaaaaguacuggucaauaagcauagggguuuguagaguaagaugauucugcacuacauauacaagaaauugcuucugguuacuugcaugcuucaaagguuugaucuagaaguuugcacauaaauugagaaauuaggguaagaauuaaaaauguaguaaaugaagauugaacaguacccacaccacccugcaauaagauuugauccucccuguuauauuuuguaguuugaugucauguaaucuauuagaauuuuauuaauucugcuuacacagacagccaucuggaccuucucuaagcaagaccaguccuaguauacaacugaaaugauugaugggcucuggaauugauuaguuguucugugagacaaaugaaguguuuuggcagaaaauacaagagguugcugcuuguggucagacacaaaagccuguagaauuucaaagagaugcuuuaaucauugacuuauaaaguuuccauuuuuaaacaauaauggauuuugaaaauauuucccaaauaucuuuucauuggcugcugucuaguccugauuauaaauggaagaauauaaguauaaaaaauuagaaugaaagugauuguuuuaugcuuuaauuuuguauucuuggugaaauaugaacuaacuuggaaguagcauaaaagccugucaugcauaaauuauacucuaaaauuuuccugaaagagauaugauuggagaaaaagcuguaacguguauaguuuuauuguaaauuacuucuaaaaucagauguuauaaaauucuauuuauucauucaaagcuucacauuguuacauugcagccuguuuuuaacaaaucuacuuaaagauucuuaagcuucaagaguauguguucuacauauuuguguuuuaaaaaaugaauauuuggauuuuuaugcauuuaacaggccgucauucuggaacaccacuauccuaaugauaccacugccuuuagcaccaaaaagcuucccuccaucuguuuggcuggugguaguguaauacuucucuauuucaccauguugccuaugaucaacauuguguuaacaccuuggugauaggugauaaauuggaugacauaugucuuguuaaauucugguuauucuuugaggacuacacaaguggguauaggcaagugggcaacucccccuggagaaucugacugcucagaaugaacuugaguuauggauuuauucagccuguaaaaccucagcuggcauaaauaauugagaaagcaaagguuugucuuuggugcauaccucagggacucauggcucccuuccuccucucuaccucccuuucuuaugaaaaugauuccaguugcacuccuagauaauaacacaccaagcaauuaaaagccauggguggcuggagagaggagaaaagguuuaguuaaugagcuuuuccucuuccagugcccaugagaaccucaggaaugacaaggcgauuaaagcgaagagauaauuauagauuaugugaaaauggguccccugggacaugugggucuugacauaaacaguaacuguuguaagagucuccuggcucucauauucacccuuuucuagcgugcuucauuuaccuccugugugcucagugucaugaugccaaccaagcauguacacaaaucuagcccuuucugaaccaagggucauucaucaacugaaaccaucaccuuuucuuccucucuguuuucuucuuuuuucuucuccucuuccuuuuuccaguuuuguucucucuuuccugucuaccccaucuaauuuuucuuucucuucuucccauauccuuaucuguaugugguaccuaugaaaugcuuguuuacaaaauuugguguguguauguaugugugcauauauaaagauauauagagguuguggguauacuguauccauuacaguaaugagaagcagaauaugcauuacaaauaauaugaacaggaccccuuaccaucucaucuaaugccaguuuuccgcucacccccuuuuucacucuguuccaaccacauuggcuuauuuuuuuccuugaaguucuaauuaauauuuauuagauuaauugacacguaggguaugaggaaugaccuccagcuuacaauauaugcugaauucuuaagauaagaauaaugacaguuaacauuuauugaccauuuauuauaugcuaguauaguaaccauacuauauguauuacuucucuuaaucuuuaggaugacccuauuaaauauagaugcuauuaauauucuuuuuuuuacagauaaggaaacugaaauucagagaaguuaacuuacuugcccagggucacauaguuaguaacgcugcuguuaauuacugugcuaugcuggcucuggaaauguuugaggaaucauaaucucuaguuaaugaaauugagucugauaguuguuacuauuuaauauggugaguaucuucaguuaaaauuuuuaaaauaaaauuucuuuuccauuuaauguuuuaaaaaaauguacuuuccugguaaaauuggagacuuuggucuuucauguaucaauguacugaugaugauauuuccuuuggaucgauuaucuuacugauuuuagacuuaccuuaaugguugagaauguaacucagcucuguagagacuuuuaggaaagcggaucugugcuuuuucugauacggcaacugauuuuccagagauuuauuagaacuuaacuacauuuuauguuauuggcauuuaaaguaucagaaauuuucagucaaguuuguuuaagguuaagcagcuuuuaaggggugaaaauacauuuuuaguaaauggugucuuuauaaguuaugguuauguaacuucuccaguauaacuaauuaucuguaagaaauaucugggucauugauuuuuuucuuugucaauacuuuauugaaagauugugagaaaaauacauaaaaauauauguaguuuuauuugaagggacccuuaccaacguaaauaguauaacaaauggaaguuucaauuugaaggcuuuaagaauuuucuagaccuagaacuaaguaccuugcauauauuaauauaauucagucugaaaauaguuauguaguagaagaagauguugccauuaucauaugacaggaagggggaaaacuaacugguuuguuucuauaacugucugaaaucaguugcagauauggcacugugaugcaggaauugugauucaaaauauaauuucugcucaaaaaacacagguugugacugcauagguccacuuauacguugauguuuuucaguaaauauauuggaaacuuuuuuggaaauuugcagcaauuugaaaacacuugcagaugaacuauguagccuaaaauauccaaaaaauuaagaaaaagauauggcaugaaugcauaaaauauauguagauacuaguccauuuuuucauuuacuaccauaaaauguacacaaaucuguuauaaaaaguucaucacaauguaggcacauaaacacuagcagaccauaucuggugccauucucaauccagaaaaauguaaaaaaaaagcaaagaugcaguauuaaaucauaacugcaugaaauuaacuguaguacauacuauacuacugcaguacuuuuguagcuaccuccuauggcuaguguggugagcucaaguguugcuaguauccacuuaaaaugccaagacgcuaaucaucuccaagugagcaguuugucccuccaguaaacugcguauaacaguaaacagugaucucuugugguuuuugaguauuuuaucauuguauguagcacuauacucuaaaccuugaauaacaccaugagacccauaugaaguaccacuagugaugcuggaaguacucccaaaaagcagagaaaugucaugacauuauaagaaaaaguugaauugcuuaauacguauuguagauugaggucugcagcugugguugucugccauuucaggguaaauuaauugagcauuacggacuucuguaaaaaagaaaagggaugggccaggugugguggcucacaggguggccuugggagcaccuucgaaggccaagacggguggaucaccugaggucaggaguucgagaccagcguggccaacauguugaaaccccaucucugcaaaaaauacaaaaauuagccgugagugguggugugcgcuuguaauccuagcugcucagaagucagaggcaggagaauugcuugaacccgggagguggagguugcagugagccgaaaucaugccacugcacugcagccugggugaaagagcgagacuccaucucaaaaaaaaaaaagaaaaaagaaaagggaauucaugaaccaucaccacagcuacacuggcaaguacaagaaccuugcacauuuugugcaauaucuuuuaaucucauauuguaaguucagcuuuuauguagguguaguauugcuauaggaaaggcauacuuagagacucuacuaugauuugagaaaaaagucauucugugacaaagcaaaaggaaggugaaggaucuauaccuggaaaauguaaugccagcaaaggaugauuugauaaguuuagaaagagguuugacuuuagaaaggucaagauaauaggagaaacaacuucuucucaccaagaggcaacaaauaagcaaauuuacaagaaaaaaaaacauuagaaagugggcaaaagacaugaacagacacuuuucaaaagaagauguacaugcagccaacaaacaugugaaaaaaagcucaacaucacugaucguuggagaaaugcaaaucaaaaccauaaugagaugccuucucaugccucucuuuuaguaacagucagaauggcuguuauuaaaaagucaaaaaacaacagauucuggugagauuguggagaaaaaggaacacuuuauacauuguuggugggagugcaaauugguucaaccauuguggaagacagugugacaauuccugcaagaccuagaggcagaaauaacauuugacucagcaaucccuuuacuggguauauacccaaaggaauauaaaucauucuguuauaaaguuacgugcaugcauauguucaucacagcacuauucacaauagcaaagacaugggaucaaccuaaacacccaucaaugauagacuggauaaagaaaauguagaauacuauacagccauaaaaaggaacaagaucauguccuuugcagggacauggauggaguuggaagccaauguccuuaguaaacuaacacaggaagagaaaaccaaacaccacauguucucacuuguaagugggagcugaaugaugagaacacauggacacauggagggaaacaacacacacuaagcuccuuggggaguagggggagggagagcaucagguggaacagcuagcuaauggaugcugggcuuaauaccuaggugaugagacagucugugcagcaaaccaccauggcaccuauuuacauauguagcaaaccugcacauccuguacauguaccccgaacuugaaaaaaaaaucauugaggagagaggauaucuauuugcaugaacagguguuuaauguagacagaaaugccauauucugggggaggaaaaaaaugccacaaaggacauuuauuaguaagggagagaaggaagcaccaggauuuaaggcaggaagggauaggcuaccucuguuuucugcaaauucaggcggguuuaugaucaacacuauacuuaccuauaaaacuguuaaccccugugccuugaagggaaaagguaaacaccgucuucuggucuuuugguuguacaauaagaagccccggacaaugagaacccuuuuucuggauugguuccauugauucuuuuucccugaagucaggagguaccuuucuaguaagagaccgccuuuuaaaguucuuucaauauuggacaguucuccagccacucagaaauucaugaguucaacacugaaggcaucuacugcaaucuacuggcucccaaauacaacaucucuaauucacccucuagaucgggggguuauaaggaccuuuaaggcucauuacacaugguacucuauggaaaggauugucaacaccacgaaagagaacccugauagaacauuaugaaggucgggaaggauccauuggagaugcugucauuauagaaacggcggugaaaaccgucaugccugaagcaauaaauuucugcuggagaaaacugucuacauguuauaugugacuucacaggauuuacgacagagccaaucaaggaaaucaugaaagauugugaguauggcaaaaauguguggcagggcggggcagagaguugguuuuaagauauagaucuugaagaaauuaaagagcuaauagacaccacacuagaggaauuaacagaagacgacuugauggaaaugauugcuuccaaaccagauagauaugaugaggaacaagauguagaauaaauaaugccccaaagagauugacauuagacagucuugcagaagcguucugauuauuuaagacugcuuuugacuuuuacuacauggacccuucuaugauaugggcacccaaacuuaagcaaauggugaaaggauugguacuguauaaaaacuuuuagagaaacaaacuaaaaagggagaaauuaugguguauuuucacaaagcuacacugagugugccugccucaccugccaccucuucugccucugccagugcugagacagcaagaccagccccucuucagccugugaagacaacagggugaagaccuuuaugaugauccacuuccacuuaaugaauguauauuuuccuuaugauuuucuuaguaacauuuucuuuucucuagcuuacuuuauuauaagaauauacuauauaacacaaauaaaaauuuaucaacuguuuaucgauaagccuucaggucaacaguagccuacuaguaguuaaguuuuuggggagucgaguuacaugcagauuuuugacuaugcagggggucggugccccccacccuccguguuguuuaagggucaacuuauacgaauuccuuuggucauuucacuaguccauuggguacuguguauuuugaaccuaccuuauuaccuccuugacuccugcacaccauuauuuaaauaccauuauaagaaaaacaugccaucauuuaauuguaagaugcugcagauuauaagauucauaggagauguuaacaugaaaaaaauuugcauuuagaaucaaugaaauaugacaagguaauaguuuccaaaugucuauuugucauccaggauuucaagaacaauauauuuuuuuuuugagacggagucucgcucugucacccaggcuggagugcaguggcgcgaucucugcucacugcaagcuccgcuuccuggguucacgccauucuccugccucagccucccaaguagcugggacuacaggcgcccaccaccaugccuggcuaauuuuuuguauuuuuaguagagacgggguuucaccguguuagcgaggauggucucgaucuccugaccucgugauccacccgccucggccucccgaagugcugggauuacaggugugagccaccgcgcccggccucaagaaugauuuuaagaacagcacaacacacaaaaaaacacuuuauuaaguacuuuguuuugaaggcuaggcuucuuacaugugguuacugcccaagcaauguuuugccucuuccagggauuaaaccaagguuuuucagaaaggagguacuauuugcaagauuuuaccugaggaucauaguauagauucucauuuguugucuuugguaagauugagagucaaaaacaguauccuacaaugugaaaucaacaucuguaauuuuaauuagauauuaauuagaaguggggguuuucagugugcuaaguauggcagccaugacuauuuaauccuugauuuaggauuugauuuuaccuauuuugcuucucccagauaagucuuuuuuuuuucuuuuuuaagagacaggaucuuucucuguugccuaggcuggaguggugugauuauagcucacuguaaccucaaacuccugugcuuaauugauccuaucaccuuagcuucccaaauagguaggacuacaggcacgcaccaccacacccagcuaauuugaaauuuuuuuuguagagguagggucuugcuguguugcccaggcuggucucaaacuccugcgcucaagugauccucccuccuugaccucccaaagugcugggauuauaggugugagccaccacacacuuccucauauaagucuuaaaugagcuucacuaaacaccuuugaguaagaauagauucuuuuuuucagggagaaaaacaucuguaaguaaaauuaauauaugccugccuguaugauuguuuuauauuuauaaauuaaaacauacuuuuuaaucucaacuuauaaaauauugaugguuucaucagauaaagauuauauaaaaauuauauuuauaaaauuaagauuagauaugugaaagauuauauuaaaaagaacauuagacuuugaguuuuauauuuggcauauacagaauguugaaaaacauaguugaaaucagugagaugacggcauuauuuucuaacauuauauuugaacagaauacauuucuuugccuuucagaucaacaacuucuggccauacauccaacaaguaaaucaggaacuuaaauuccuacaaagaaguaauauucacuagcaguaugacugaauuuuggaagauagugugcagugccagcuuuuauccuagaaagacuaccuccaaaggaacuucacagaguggcauuuuuggugaauuaccauugaucagaguccauuuuucaaccucaaagauguagaaaaaagauccguagaucaagcagacccuuagaaacagaguaggaauaauaaaauuggcccaaaacugagguguaaacuaaaaugcuuguuugcuuaccaaagggacuaugucuuuguagugauugaagugcugggucccuccuuucugagaauugaggaguccagaaaaacagauuaauaguuaaaugauuauuugugaacauaaaaauagagccagggaaaguguaucauuuugaggauugccuuagccaugguccuaaugagaccucaugaaugaacugucuuucuccagagaaaucacucagaaugcuuuuuugccuccgucuuuugguuauacuuccugaaguauacuaacuauaguaaggagagagguguaaugccucuccuuuacaaacgaggagaagaguguuugagcagagggaauguggaaaaggagaaugguaaugaaauauuugccacaggaacccuuucagguagaucaguuuaguaaagaauacauuuaucuagaagaugaagagcuggaaauugagucacuuaaaaugaucuauaccugcauaucucuuuaaaggaguuuauguacccuagagcccacaaauuccuuaguuugaggaauuauggcauuuguuuuuaucuuuguagauauuggcuuacuuucuuuggauuuucauucaugcaauaaauacuuauucauugucuauuuacuagaauacuguguuuuauaucugauuuccaguugcuuaguaaauacaugaauugaauugaauauuuguugaaugugccuauuaaauagauuuccaagcuaguuccuuccauaauuuuuguaguuaaauggacuuuauaugucuugccaugagaccuauuugaaauauuauuuugauaagaaaaugcuaucugaguagaaaaugguacagauaacauauuuaggaaugggcaaggaucuuccugugauugggugaaaaagccguacuuaaacacucucccucuuucccauagagugugcucugauauuucaaaagaaugucaaaaccagugauuauuccuucaggaauauaaauguauuugcugucaauuucagaaaaguuguaguaaccugaagaagagacuuucuguuuugugcuagagauaacaugggacauccuuuaggguagcaucauaaacauaacucacagucaucuauagauaaugaauaugauaauuuugagauucacaaagagagggaacaagauaccugaguaaaaaaucaagaaaggaaaauaaagauauggagagacacauuuauuuauuuaaggcucuacuguguuucauaaugguuggauucauuugcauguuauuuuguuucaaauaagcauggauauagugggcaagauugacuauggaaggcuguauugagcucuuagaaaaugguagagggagaaaguuugauuuauacauuguacauaauuuuagggggcaagaaaggaaauauggaaugauauugcuguagauguuucuucauuuuggccacuagauggugacauuguauaaaaacagcuugguuguagaagguaagauacucaaaauuuggugugggauuggauagcuguauuuaacaaguaagcccaagagugucacuuaauuuuuuuauauucgucauucagccuuguagcauuuuuggcgaauuuauugaacuucucuuuuugguauuuaauuuauauguguauacuauccugaaguauuuuguuaauaucucugugccuagcauauuuggugaugauaaacuauauacgauaaacaaauacuuaaacaaaugcuaccugcccuccaaaaaauucacauagcaaaaaaaacuaguugauauauuugaugugucuaagaaacauauuuaagauacauuaaacaaaauagaaauuuauauguguuuguacuguguuuacuuuuuuacugcuuacaacgguauacaugcacauuuggaaguuggacucaggaagaggggccacuccaaagguccucucaucugugaauaacgcuuacauauacuggguaugcguaacccacaugccaaggauccuucugcuuuccuuucugugcccuaccaccaacuucccauuauuuuccaauucagaaacaauuggcgaguagcacuguaguauugcuaugacuuuaaaagacacaguucuuucuguaacaguugaaguuggugccucuugaauuaguggguuuucuguuacuggauuggaagaaaguaggucccuauuauccuuaaguuggaacucugaagguauucuuucauagacaugguguuuuuuuuuuugcguguguuuguuuguuuguuugagacuuagucuugcucugucacccaggcuggagugcugugguaugaucucggcucacugcaaccucugccuccuggguucaagugauucuccugccucagccuccugaguagcugggauuacaugcacgugucaccacgccuggcuaauuuguguauuuuuaguagaaacgggguuucaccauguuggucaggcuaguuucgaacuccugaccuuaugauccacccgccuuggccucccaaaaugcagaccugauguuuguuuuugguuuuuuuuguuuguuuguuuuuuguuuuuguuuuuguuuuuuuuauuuuuuugagauggagucucgcucuguugcccaggcuggagugcaguggcgcaaucucggcucacugcaagcucugccucccggguucacgccauucugaugccucagccucccgaaacaugguguuuuuaauggugguuaaauauggcuaacgugguauuauuugcagcucuacuuucuaaaaucagaauucucuuuucugggguuugaccucacuucuuauuuucuuuacagaauaagugaucgaaaaagcauuuucucuucuguuuaacagggccucuucaagugaccauauaguccuauuaaacaugauuucuuacuuaaaaccuacaucauuuucucuagcuuugaagcaaguuguuuuuccccuguucuguuauaguccuuuuuaaggauccagcuuuuaccuuauguuaauccuguguagauuuuugucaucccagcuauacuguuugggucuuaaaggcaaacuuucuugcuuagccuuuuaucuguuaucaacaaauucuuguccagugccuuacauguaguaggugcucaauaaaauacuuaagcggcuuaaagaacacuuagauggcugaugcuaaaguagugucuuuuaagaaaauuagcuaugacuggaaauaacuuucuguaugacacaagauguuuagauuggcuuuuaggauagaagaacuccuaugaccagguguuuugcuuucugaugaauggaugcucuggcauugcagguuauaaaacacaucaguuugauuuuuggaacgcaaaaugcauuccuuuauacuuguucauaaaauucaguccacauauggggcaguuugauuguugauauucuaaauuacugaucguuaugggagucacugauucuuuugagaauccgauugaaacaauucuucccccuauacauacaacauccagaaaaaugcacaugcguuauaaagauaauucuguacauuauuuagagagcucauagaugucauguuaagaacuucugcuucagauuuuggaauagacugcagcugauuagucaaaaggcagcauaauauaauagaaaaauguacuguauacaaaaucaguuggucuaagugaguucuagcucuuauuccaccuuugauaaauguaguaccauuuggcaggucauuuaacgucuccuuuuugccuguuuuuucauuuguaaagugaaguugcaugaaagauuaagugaauuagcacgugcaauauacuuagaagagugcuggguauguaguaugcuucccagcuuuucuuucuagucuuugauucuacuaucuuauaaaggauuuuugaauuuuuuaaugccccccucuuuuugucuaauugauuuucuuugcuuuaagaaaaucacuuucauauauauuuuuaaaacuugaguaacacuuuauucucuuauccuguaaggcaaguaggaaacuaagaacuuuagucuuuucaggaguuggauauauuacagcuacugaaaaacuguuacuguucauguaaaauuuuuuuguaagcagaguccauuaacaucuaugucagcagcaaacagauuguguugaaaauauguaacuuuaauguauuacccaguaaaaaaagaccuuucuuuuuuuuauucuagggaagaagacaaaaauauauuugauuacugcagggaaaacaacauugaccauauaaccaaagccaucaaaucgaaaaauguggaugugaaugugaaagaugaagagguaugaaaaacaugcccuguuaauuauuuuccuaugcaugguuguucugccccagugccuuuuccuaaaugguaggccaaugaacuacaacucaaaguacaguaugguuaagaguauaucagaauaucuaaaugagaugguguuaccuaguuaagauacguucugugauuauguccaacauauuuuuaucuguguuuuagaaguuacuaccugaaauuuguaggagucugauagcuuccauauguuuaugcuaaagggagagauuauucgcauaauaagugaaaucuacagguaauagcaaaaucucauuuauacauagcuuucgugucuuccguuauuauaccuugaacagcuagguauauuguucuuugcucaauaaauacaucuuuagaaaacugucagaauuuugguaaaucaauaauuuaaaugcuggccuacuaauuaaaggaauccuauaguaaauuauuuuauaaaauauauuacuccuuuuuuuggagggagaaacagggucucacucuguugcccaggcuggagugcaugggugcgcucauagcucacugcauccucaaacccaugggcuuacgcaauccucuugccucagccucccaaguagccaggacuacaggcaugugcugucacuccuggcuaauuuuuuuauuuuuuggggagauggggucuugcuaugucgcccggguuggucuuguccuccuggccucaaaugauccuccucccucagcuucccaaaguuuugggauuauaggcaugagccacugugccuuguguauuacuucuuaauuuauuuguguugugaauaauaccauucacauacugaguuuuaacugacccugaauuauagcuguuaaaagagcaaaauuugcuaacucacuucuaaucauuuucucauucuuuggugaugcugugaaagauuacugaaauggccaaagguaguaauuguuaggaagaaagcauuaaaugaucauagauaaucuguagaauagauaauaaucaacuuauauguaauucagagcucccuauacaaaagguuagcccuuaauauuaucucaccuuuaggcaacaucuuuccugugauaauauugucaauggugucuggaauugaaaauguaagacuaugauacugcacaaagggacuaguaauacuauguguuuuucacuaaguagugaaacaaaauaauaccaggucuucugauucuaauuagguuugugguuuuuuguauuuuggguuuuuuuuuuuuuuugccuuucagaaucaaaauacaggcauaccucugaaauauugcagauucaguuccagaccacugcaauaaagugacuaucgcaauaaagcgagucacaugaaauuuuugguuucccagugcacauaaaaguuguguuuacuggccagacgcgguggcucacgccuguaaucccagcacuuugggaggccgaggugggcagaucacgaggccaggagcuugagaccagccuggccaacauagugagaucccaucucuacuaaaaauacaaaaaaaaauuagccaggcgugguggugggugccuguaaucccagcuacucgggggaggcugcaguaggagaaacgcuugaaccugggaggcagagguugcagugagccuagaucgcgccauggcacuccagccugggcaacagagcgagacuccaucucaaaaaacaaacaaacaaaaaaguuguguuuacacuguacuguaguuuauuaaguguagaguagcauuaugucuuuaacaaaguacauaccuuaauuuaaaauacuuuauuacuaaaaaauucugacaaucaucagacuuggcuucagcaagucauaaucuucuugcgguaaaaggucuugccucaguguugauggcugcugaccgaucacagugguagucacugaagguugggguggcuguggcaaugucuuaagucaacagugaagauagcuacauugauugagucuuccuucguaaaagauuacucuguacaugcaaugcuguuugauagcauuauacccacaguggaacuucuuucaaaauuguagucaauccuuucaaacccugccacugcuuuaucaacugaguuuauguuguacuuuaaaauuuuuguuguuauuucaacaauguucacaacaucuucgccggaguagauucugucuuaagaaaccacuuuguuugcuuauccauaagaagcuacuccucaucuguucaaguuuuaucaugaaauuguagcaauuccaucacaucuucagguuccacuucuaauuuuaguucucuugcaguuacaucugcaaguaacuuuuccacugaagucuugaauccuuaucugugucauccaugaagguuggaaucaacuucuuccagacuccuguuaauguuuauauuuugaccuccucccaucacacauguucuuaauggcaucuggaauggugaauccuuuccagaagguuuucaguuugcccagaucuaucagagcaaucauugucuauggcagcuauagccuuauagaauguauuucuuuaauaauaaaaguuggaagucaaaauuauuccuugauccauggacugcaaaaugaauguuguguuagcaaacaagaaaacaacauuaauuuccuuauacauuuccaugagcacucuuggaugaccaagcacauugucaaugagcaguaauauuuugaaaggaauguuuuuuuuuuuccugagcaguggguaucaacaguaggcuuaaaauauucaguaaaccauuuuguaaaguaaacagauauacugucaucuaggcuuuguuuucccauuucaaaagcacaggcagaauagauuaagcauacuuuuuaagggcccuaggauuuucagaaugguaaaugagcauugguuucagcuuaaagucaauggcugcauuagccccuaacaagagugucagucuaucuuuugaagcuuugaggccagguauugacuucucuccagccaugaaaguccuggacggcaucuucuuucaauaguaggaguagucuauuuucucuacauugaggaucguuguugaguguagucaccuuuaucgguuacuuuaacuaggucuucuggaugacuugcugcagcuucugcaucagcacuuggugcuucaccuuguacuuuuauguuauggagauggccucuuuccuuuaaccacaugaaccagccuuugcuagcuucagacuuuucuucugcagcccccuuaccuuucucaaccuucauagacuugaagagaacuagggcuuugcccuggaucaggcuuuggcauaagggaauguuguggcugguugaauccagaccacucacuuuuuccauaucagcaauaaggcuuuuuuacuuuucuaucauuuguaugcucacugaaauagcacuuuuaauuuccucaagaauuuuucucugacauucacaaauuggcaguuuggcacaagaggccuagcuuuuggccuguguugguuuucaguaugccuuccucacuaagcuuaaucauuucuggcauuugauugaaggugagagacggugcagcccuuuuccuuucauuugauacuagguuuuacuugaaacuuagagacuauuguauuacuggcuaauaauuucaauauuuuugugucugagugaauagggaagccugaagagagggggagagaccaggaacagccagucaguggagcagucagaacacacaaaguaucuguugguuaaauuugccaucuuucucagugugguuuguagcacuccaaaacaauuacaauaguaacaucagagaucacugaucauuacccuaacagauauaauaauaaugaaaaacuuugaaguauugcaagaauuaccucagugugacacagacaugaagugagcacaucuuguuggaaaaauggcaccaauaguuggcuuaacucaggguugcuacaaaucuucaauuuacaaaaaacacaguauuugcaaagugcaaugaagcauagugcaauagaacaagguaugccuguauagcuuucuuuuuuaaauaaauuuggcaugauugcuucccuugauuuuuuaaauuguaguuuuuuaucuuugugcuugugaguuaaaauuuuuauaaaguuaauacauuuguuuuuuuaaaaaaucaaauguuacuauuagucuuauaaacaaaaaaauucucucuuaccugcauccuucuuacauuuuauucuagcuccuuuaaggcaaaaauuuucucuuuuuuuuagacagauucucaggcuggagugcaguggcaugaucagggcucacuguagccucugccuccugggcucaagcgauccucccaccucagcccccagguagcuaggaccacaggugugcacuaccaugccuggcuaauuuuuguauuuuuaguagagaugggguuucaccauguuggccaggcuggucucgaacuccugagcuuuaguaaucagccugccucagccucccaaaguguuaggguuacagaugugagccacugcacccggccagacuuccaguucuuuuaaugugucuuuagcaccuuaccuacauaauucuaaauaauauacuucuauuucuugauuuuucaacuuuagacauuauugauuuguuucuguguuauauuuagauuuaacuguuuuacucaucuucccucucucucucugacccuccuaacguaauuauaucacaacuuuuuuauuuuauuuuauuauuauuauacuuuaaguuuuaggguacaugugcacaaugugcagguuaguuacauauguauacaugugccaugcuggugugcugcucccauuaacucaucauuuagcauuagguauaucuccuaaugcuaucugucccccuccccucaccccacaacaguccccagagugugauguuccccuuccuauguccauguguucucauuguucaauucccaccuaugagugagaacaugcaguguuugauuuuuugucuuugcgauaguuuacugagaaugaugauuuccaauuucauccaugucccuacaaaggacaugaacucaucauuuuuuauggcugcauaguauuccaugguguauaugauaucacaacuuuuaauuucagcuuucugauugaaucucuguugaaucaauauuaauauuauuaugacuauguaaauacucauugcuaagcuguggauuguacuuguguguaucagucagcuuuugcuguggcacaacccccaaauuucaguugcuuacagcaacaaacauuuguuuuuuugcuuauaucacugucucaugagaugagugacaccaucucauuuauauauucugauaaugcucuuacuugauuucuuuauguuuaucugauauuucaaaaggguuuuggaucaguugagacagucuguauauuuuaucuacuuuuauuauuaauaguaugagugaaggaugaugauaauauaacaaaucaauaaguaggccacuuaacuuuucaaagucacaguuuuuucacuggaaguaucuuguguguacuauauggugccuguuaauauuuaucuuucaaauaacacauaauacuuuauacaaugcaugugauaguuuacagaguacuuucacuuauuacuauauuaucucuacaacaguucucuaaggcagauauuguccuuguuuuacagacaggaacugaaguucagagaccuacauuuacuugcucaaauccauauaacugcuaaguagaaaccaggucugggagaguauucuuccuaccacuagauuuuagaaggauaaauaaaaagaagaaaaagaaggauaagcaguugucauuuggccuucccuguguuaugcucugguuugcagcaauuucuuuuauaaaauauuacuggaagucaaauccacaugugaccuccacaaagaucacuggauggacaacagugauagggguggaauaagugccuagaacacagauagcuuacacuaaauaacacauauuuuguguguguaaagacaaggaaaacuuggcaaaauguauuguuucugccauuuuguuacuuugauguagugcugcuuuccagaucuuccaguuuguuaaccaugcagcuaccuuuacccucagccugccagaacguuguauuucaugaacagaugaagugcuuacacauucauagacugagacgccaagaauucaguuggguucucucauugcuccaagcagauuucugcccucucagccaugacaauucaggcugagcuuugaauacugauggcaaacccuuuuauuauuaaucagggauuuguaugaauuaauuuaagaacauaagggaggugggagcuuaaaaucaaaaucaaacuuaacaucccaaaauaaaauaaauaguauugcuucaucacauuuaaagcucuagcaaauaaaacaauuugguaagcuuugaugauggacuaaaaguguguagccucaaaauuaaacuucuaguuaaauacuuuuaacccuuucuguccuuuugacguuuucuuauuaugaguuggguaacaauuauaguuuugaaaggacauucaguucuuuuuuguauuuaucugauauuugaaauugagauauuucccuacugauucccuaagauucucugggauaauauacguuuuuacuuaaaaucuuaauucagcagguucaaccuaauuuuaugacuaaaagucauguuuauugcacuuaaaauuugcugugagcacauaaagaaauuuaauuauaauaauaaaguaagcuacauuuguauucccacacauugaaauaaauacauuauucacugauagcuaugaaucuauaauuuauaaauuauuauuugaaauacauacauuuggaucuaaguauuguauaugaacaaauauauaugaaaugccuuuuaaauaaaauguauuuguauuucauaaugaaguuauuuuauuguacauaaguauaauuccuaguguacaucuuuuauucauuuaaguuguaauuacuacagguuggauauuccucaucugaaaauccaaaaucuggaaugauccaaaaucugaaacuuuuuagcaacagugugacacuccaaggaaauguucuuuggagcacuuuggauuucagacuuuuggauuaaggaggggccaucaauaaguauauaauguaaauauuuuuuuuaaucuaaaauuuuaaacacuucugguccccagcauuugggauaagggauacucaaccuaugcuaauauaguaaggcauauauuucuaauuugagaaaauuaccugguauuuccuacugguauaguaauuggacauugucuguauuuugcauaauagaaaaaaguuucguaguuaugcuuagauguuuuaggguccaaguuuguaacaccauggugucauauguacuuuuuuaaaaaauuaaauuacaacuuuuauuguguuuucagucauuugagaaaugcuugaaaauugaauucaaaauaugaagggaaaaguuaaagagaagaucuuaaagccuacuuauuuuuuuaaauggcgguucaauuuuuauccuugacccacauuaguacagcucuucacacauaccaaauauuuaugauucuuccaagaaaauauuuuuuaaggggcagggaugauuucaauaauuugugaaguguauuuaaaguauggggagaguauuugcuaucaaacaucaggcucaaauuauguuuacauaauucuugucacacguuauuucucagauuaguguacuauacaaucaacacuaaauacaugcuuauugauaguauuuaaauaguauuuuaaaucuuugaaguaauuuaaauguuuuagaucaaauguaacaguguaauauuuuagcaaaauagaugaccauccagugcaccuguuuaucaucaguccccccaaaagcauucauacauaguucauugguuuuccauagauucuuaucuaaugcacucccaaauuccacuuucacugggcugcuucuuuaguuacauucuuuccuuuucuguccuuuugacaguauaauuguugucauuagccauuuuccguagucuauugauucuuucagauacuuugaagaaagucaccuuucucuugacuaccauucguuuccuuuucuacuuuguuuuaaaucuguggcuccuaacaauacaauuugcaugcuuuuggcuugagaaacugcugcaaacucuggugaaacugugacaguacuaaguaacagaaaagcaaaagauuuaagaggcagggucgguauacugagacuaaauuuaugcaguuauaugagauuugagaaaggaaggaagaaaaaaugcauccucuuaaaucacuuucuauaucaggguauauauuauuuugguuauauaguugauuaagauguuaauuugaaggaacuuuauucacacuaaugacugagaaaugcguuacaaauugucuauuacgcuuauuugcauucauguaggcagugccauuuaaaaaucaagucuauggucauguguugcaucagaaacuuagauuuaauacaaaaucagaaaauagugaaaguagcuuaaauccuaugagcuuuggcaacuuauuuuggguauuuuuuaauugugguaaaauauacauaaaauguaucauuuuaaucauuuuuaaaucuacaguucucugucauuaaauaugcucacaugaggccaggugcuguggcucacgcuugucauccuagcacuuugggaggccaaggcagguggaucaccugaggucaggaguucaaaaccagccuggccaacauagugaaaccccaucucuacuaaaaauacaaaaauuagcugagcaugguggcacaugccuguagucccagcugcuugggaggcugaggcaagagaaucacuugaacccaggaggcagagguugcaaugagcugagaucgugccacuggacuccagccugggcgacaaagugagacucugucucaaaaauacacauauguauauauauauuuuuuucacaugagccaaguguaguggcucaugcuuucaggcacaaggaauucuugagcgcaggaguuuaagacuaggcugagcaacauagugagaucccgucucgugauaaaaaaugaauaaauaaaacaauacauucacauguguaaccaccaccaccauacaacuuuuuuaucuuccccaauugaaacucuguaccaagccaggugugguagcugaugccuuaaucucagcacuuugggaggcugaggugggcagaucaccugaggucaggaguuugagaccagcuuggccaacauggugaaaccccguuucuacugaaaauacaaaaauuagucaggcguggugcugcacuucuguaaucccagcuacucgggagacugaggcaggagaaucucuugaacccaggagguggagguugcagugagcugagaucgcaccacugcacuccagccugggugacagagugagacuuugucucaaaaaaaaaagaaacucuguacccauuaaacaccccccauuccucccuuccccuggccccuggcaacuaccauucuauuuucugucucugaauuugacuacuccagguacuucauuuaaguggagucauaacaauauuugucccuuuugacuggcuuauuucacucaguguaacgucuucaagguucguucauguuguagcaugugucaguuuccuugcuuuguaagaugaauaauauuccauuguaugcauauaccacauuuuguuuauucagauauccauugauggacaccuugguuugcucuuaccuuuugacuguugugaauuaugcucugaacauagguguacaaauuuuuguuugauuuuuuuuccccaagaaucuauuaugaaaaauguuaaacauacagagaaguugaauuuuacaaugaacauccguauuucuaccaucucgauucuaccauuaauauuuuacuaugcuugcuuuaucaauaucuagacauucaucaaaucuuuuuuauuuuuugauacauuuuggaguacacagacaacaguacacuuucuucuaaauauuuuaacaugcguauaacuaacuagaauucaguauuugguuuuucuuuuaaaauaauauuuauauacaaugaaaugcacaagucuuaaguacacauuugaugaacuuugacaaauacauauaccuguguaacugaagugccuaucaagauauagaacauugcugucgccccagaaaguuuccucaugccccuucccagccacuguuuucuuuuaaucccaaaaagguaaccaccguuuugauauuauucuaccauagauaaguucugcuuguucucgaacuuuauauauaugggauuauacauauguacuccucuguguagggcaucuuucauucagcauaauguuuuugagacucauccauauugcuauaguucaguacuuccuucuuuuauacugcugaauauguuccaucaugugaauauaccauugucuuaugauggauaccugggcuguuuucauggcaacuuccuauuauuauugcuguuaauuaccuccuuuauacaggaugaaauaauaccucccuuucauauuccuucacccuuaagucacugacauuauagcuuaguaauuucuugugaagggauuuuuuuuuuuuucuuuugagacagagugucacuguguugcguaggcuggaguacagugacgucgaucacggcucacugcagccaugacuucaugggcuuaagugauucuccuguugagccgagccuccugaguagcugggacuacagaagugugccaccauguccagcuaauuuuuguagagaugggguuucaccauguuccccaggcuggucucauacuugcccgcuuuggccuuccaaaauacugggacuaugggcaugagccaccgcacccagccagauuuuuuaaaguaguguauucaaaaucuuucucaauuuccugacaaauaagcaacaccauuuuccccuacccuagaucuuugccagugaaagagaucaagauccaguaguugcugauuuuaaguguguaucacacauacuggugugugauuuucuuuauaaugcucguaaguaaauuaucccacaagcagucauuggcuuccaugcuagguauaaucuugagauguuagacuaucuuucaaucuuauuccuaagugcuugaaauaacauugucauuucacuauggacagggaagugaaagaaggaggcauuguguaauuucuggugauugcagguaggggaguucucacuauggccagcugcuacaguaguagcagcaaaagguagaagauaguacagaggagauggggacauuacagguuguugguaguugaagucaagcucuacuacaauuauaaauugauacccaauuuuuuugcagagagaaauucagaucuaccuguuugcaguauuucauuugcuaauuagacaguaccauaccauauacuauauguguuugauagaaugacaggacaacucuuacaaauuuaaauauaccaaauuugccauguuuuuaucuguuauacguaugguauauguacuuuguauuugaucucaaaauaucauaagaacaucaagacucauuuuauaauagaaucuccuuccuucccuccucuccccuccccuuaccauuuuuuuuuuuuuuuucuggacagaauuuugcucuguugcccaugcuggaguacaguggcacgaucucaucucacugcaaccuccaccucccagguucaggcgauucuccugccuucacccucccaaguagcugggauuacaggcacgcgcaccaccacaccccacuaauuuuuuguauuucuaguagagacagcauuucaccauguuggccaggcuuguugcgaacuccucaccucaggugaucuucccuccucggacucccaaagugcugggauuacagauguaagccaccgcgccuggccagaaucucuucucuuuuuuuuaauuuugugauauugaggagaaaagucuaauuaaaaaaaaauucuacaugguuuauggacgaguuacuaaggaaaucagagaagcauuucauauauuaagaugugcucucuguauuuuccagaagguaugaaaguaauaccacuuaauagguuagcugcuacccugcacuuucaaagcacuuuagagucauucaucugucugagguaggacaguguuagcacccuugguuaauagaugagaacucuuuuucucccugcaucuuacuguauuugaguuucagaauuuauucagggcucuccaguguucguggucuucugguggccuaacaaagguuccuuuuaauaauggcucucccucaccaaucuccugaauacuucugggauauuuuuccagaagaguuuuaaaaauuagaaacaaagaauugucacuuauuuugguagcaauaaaaauaaauuuaacuugaaaauuuauaagagauuauaucacucauggaaaaagauaaaacaauuauauagacaaauauguaaaauaguucauaaauuuagauaaagucuuagaagauauagcuuuaaugcacaccuaagucaugguuuuccuucuggaggagagauuuuggaauucuuuaccuaaaauaguuuaauaauuguaguggucuagguguguuugugguuaacaaagagaaaggaaagaaaccacagguguuuauuuccugauuuuaucaugauuaauuauaaggauagcaucucugcaaauuacugguuauguuagugagugaauaauaaucuuaaauuagagcauguuuauaggaauuuuauaauuugaagaaguaaaagguaucacagacaccucauuuugcugguuuuuguucauuuaaauauagagcaucuugaagguuaaaauuccaaagccugauuuguuuugucuguguuuauuuacaaguauguuuaauccuacucuuguuuuugagcuuuuuaauacugcauggaauauuaaucauuagguggucuuaauguagauaucuucagugcuucuacagaaagucauugucagagaauucauucuaauucaagguuaauuaguguaccauuaaaauaauguguuacaagaauuaauugcauugcaggucagaaaauguguuaaaaaguaugguguaaaugucugagagcacaucauccuucuuaaaacauugcuauacaugugccccgcuucuggaaaauauauccaaagugaaaaucacuauggagguccagucauagguguuuccccuaaaguaaauuuuuggcaucacauggaaaauuuaaaauaugggaaauuuaaaauauaacucccauuaacaguaaaauguguugcuugucagcuuuaccauugaaacagcuaaggauuuacauuuuagcuuuaguugauauaacccuauugggucaaaccuaaggaaaauucaggaacguggcugagagauagaaauuaucuauacaucuuaugguaaaaguacaagacauauuauguuguccuacuuaacuauuacauaguuuuuguaaguacccuauguaaauauaucacacaucgucuuaacuauguauaacucuugucaauaguuuaaccuaauagccauaaaaugcacacuuacaauuagaacuaaaaaugauagacuuugaaauuuugucugauucuuuuaauguauuaauaaaugcugugaaacaauaacauggaccuguagaauauuuuauucauuaguauuuauucagagucucauuaaaauaucuaauuguucauauggaggauuucugaauuagagcccuaguaacagcaggucacauuagagcuacaaaaauuuuaacauaggaaacugcucuagaacucaacaauacauuuucaccuggacuuuuagaauugucuccacugaaaaauaacuucuggcugggcgugguggcucacgccuguaaucccagcacuuugggaggccaaggcagguggaucacaaggucaggaguucgagaccagccuggccaacauggugaaaccccaucucuacuaaaaagaaauacaaaaauuagcugggcaugguggcgggucccuguaaucccagcuauuugggaggcugaggcagaacugcuugaaaccggaaggcagagguugcaguaagcggagaucccgccacugcacuccagccucagcaaaagagcaaaacuccgucucaaaauaaauaaauaaauaaauaaaaaauaacuccuagugggcucugaacaaggcaaaauaaauuuuuuuuauuuugauacuacaauaaauugugaaugauuugaccacacuuuuucucugcuuuccccccucuuaggauuuuguguaagcuuauuagaaaacagauauuuacagguaaauaaaaguaaaucaagcaaaugaaagcaaaagaagaagacaauuuguagggaagaaguuuuccuacuuuguuuuuuguuuaaagaauagauccuaguuuaauuauuugaaauaauagguaugugaagaaagucugaaugauaaaaagaauguaggcaguuuuagaaaagcuauuucuugaaaggugcuuuuuacuuuaaaucaauccuugcccuagcuuauaucuauuuaaaucuuuucuaaaaucacauaaaguagggaugucaacuuaauguggaaaaacauuccauucuuuauaaaugacaacaucaucaccauccucagaaaguaguaagccaugcaucacucauuuauucagaaaagcccuuagcuuuugggguuuuguuuauucuuuugaaccaaguaggcuuuuuuucauuaacuaaaacaagauuuucuggcaguagagaauagaaauaacacacguaauaguaacugugagucuuugguagacaaguguuaaaauuaauauuucauauuuaguacuuuaucuccuaauauuuagucauccauucucuuuuacaaguggcuuucacagucaacuguuuggugauagacacugauagauuguacuaguguuuuugagguauuucagaguguaaacuugcaauaguaaggagaaaugcuuauuuucaaacugguuaaauaaucuuuuuaaggaaugaacucgaggaaauuuaguuaucauacauuuagauuaugauuucuaccuagguuuaagugcuugcuuuuuuauucuuaugauuucuuuccagaaaaaaagaaauggacauaauauuuaagaaaacuauacuuuauauuuaaaguacaguuuacaaagcauuuucuuacaguucauuuagcagguauuauuuauauuauuguuguuauuacuaucauuaucuccacucuguaagugaacugauugagcugaaagcaggcauugggcuaguacagacccagaaguagauauuggggcuuccuauugauuguuuucauuguuguuguuguuguuguuguuguuguuguuguaguuuuugagauggaguuuugcccugucacccaggcuggagugcagugguacaaucucggcccacugcaaccuccgccucccgaguucaagcgauucuccugccucauccucccaaguagcugggauuacaagcacccaucaccaugcccagcuaauuuuuguauuuuuagcagagacaggguuucaccauguuggccaggcuggucucgaacucuugaccucaagugauccacccaccucggccuuucaaagugcugggauuacaggcaugagccaccaugcccugccccauugauuguuuauugcuuuuuccauagugcauuuuuuauaucaaucauucuuagaauaauuaacccauaauuuuuuauauuuccuugucuuucuuaaaacauuauaucuuuuacauggcuccacaacugagauaacaaauucauuuaucuucuguguuuuuaggguagggcucuacuucacugggccugugaucgaggacauaaggaacuagucacaguguugcugcaacauagagcugacauuaacugucagguaagagugauaaagaagagcuuuuauuuuuuaaauugaaguauaauucgcauaacauaaaauuuaccagauuaacucuuuugaaaugugcaauucaguggcguuuaguacauuucacaauguuguguaaucauugcuacuauauaguuccguaauacuguugucaccgcaaaagaaaacccuguucccacuaagcagucacuuuuuaacauuuuuuuuauuucuccccuugccccagaccuuggcaaccacuaaucugcuuucuguuucuauagauuugccuauucuggauauuuuauauaaaugggaaucuuaaaauuuaugguuguguuugacuucuuuuacuuagcauaaaguuuugaagguguaucuauauuguaacauguaacaauaccucauuccuuuuuauggcugaauuuuuuggauaucccaaauguuguuuauccauuaaucaauugaugggcagcuugaguuguuucugucuuuuggcaguugugaauaaugccacugugaacauuuguguccuuguauuuuuauuugaauaccuguugucaguucuuuugguuguagacauaggaguggaguuacugggucauaugguaauuugauguuuaacuuuuugagcaacugacaaacuguuuuccauaggagcuacaccauuuuucaugcccagcagcuguguaugaugcuuccaguuucaccacauccucaccaauacuuguuauuuuugcuuuuuuaaaaauaacuauuuuaguggguaugaagugauaucucaucaugguauaauuuugauuuacauuucccuaaugacuaaugauauggaguaccuuuucauacgcuuguugacuauuugcauaucuuuucuggagaaaugucuguuuaagucuuugcccauuuuaaagugauuugucuuuuuguuguugaguuguaggagugcuuuauauauucuggauacuagacccuuaucagauacaugauuugcaagugucuucucccuuuuuguggguuuucucuuuauuuucuugauggugucuuuugaugcacagguuguaaauuuugaugaacucuaucauuuguuuucucuuuuuuccuuuuguuuauggugucauacuuuagaaaccauugccaaauccaaggucauuaaaauuuaccccuuuccagaaccuaagguuuugguuuucuuccucuuuuuuauugugguaaaauacucauagcauaaaauuuaccauuuuaacaauuuuaaguguauaguuauguggcauuaaauacauuuguauugugugugcccaucaccagcacccaucuccagaacuuuuucaucucccccaacugaaacucuaaccauuaaacacuaauuucccauuccuccauucccucagccccuggcaacuaccauucuacuuucuauuucugugaauuugacuacucuagguaccucauauaaguggaaucauacaauauuugucccuuuuugacuggcuuauuucacucagcauaacaucaucaagguucauccaugugguugcaugugucaaaauuuccuucccuuuuaaagccgaauauuauuuguauguauuuaccauacuuuguuuauuccaauaucuguggcacuugguuugcuuuuaccuuuuggcgauuaugaauaaggaugcugugaacauggguguacaaaugucuguucaagucccugcuuucacuucuuuugaguauauacccuagaaauagaauagcuugaucauaugauaauucuacguuuaauuuuuugaggaauugccauauuguuucccacaguagcugcaccauuuuacauucccaccaguaauacacagauauucaaauuucuccgcauccuuguccacacuuguuguuuucugugcuuuugacaauagacauccuaaugacugauuuggguaccuuuuauuucauuuucuugccuaauugcuccggcugggccuuucaguacuagguugaauagaagugguaacauaggcaucuuugucuuuuuacacuuagguucuggaaaaagcuaaaaauaaaaauaaaaaaaaaucacacaacacugguguuaccauaaaucaugguaauaucaucauuaaauuugacuaccaaaucuucuggucuuuaucuucagaauaccuccuauuucacagagaaaguagaauaaauguuuaucaccaacccagaucucagccaguagcuccagacacacauaucucuucuuugauaucccucagacacuucaaacgcacaauaucuaacacuaaacaccagcauccuucaacaguccacccuuccccgcccacuacucaccauaauuggcaccaucauccaaccaguucccaggagaauguaucauaauuuaguuaacuaguaccauguaaauggacuguaacaauuuauacuuccaccagcagugugugagagaauuccuguuucucuagccaugccaaauaguuuaucauaacacuuuuuguucucugccuguuugaugaaugaugaaugguauauuauauuuuuaauauagcuuuuccucaguuucccauuguauugaugguauuuuucuccuuacaggaacuuuuuauauaguaaggaaaauuugcacuuucuuugugauauaguuguuuaaauuuucccccacauuuucuucuaguacuuucauuauuucgugguuuuuaucaacucaucuauaauugauauauguauccuauguauguaauaggaauuuuacuuuuguccagauggugccaacuuuauuuuuguccagaugacuagccaguuccaguaauguuuauggaauaauugguaucuuuucuauagcaauuugaacugucuuaccauagucucaauucuuuuauguauuucagucuaucuugggggcuuguucuuccauuccauugcucugguuuucuguucauguauuugugcuacacuguuuuaaguauuauagcuucaaaauauauuuuuaaauccgguugggcaaauuccuucacuacucauucaaaauacuuucuacuauuuuugcucauuuauuuuucuguguaaauuucaaagucauuuuuucaacauccagcuuuccccaaccacuauuaccacuaaauuaaaacaacaaagaaaaaaaaaaaaacuggccagaugugauggcucaugccuguaauucuagcacuuuagggggcugagucaggaggaucacuugaggccaggaguuugagaccagccugggcaacauagugagaccccaucuccacacauuuuuuuuuaauuagauguaguggugggugccuguaguccuaacuacucuggaggcuguggugggaggaucacuugagcccaggaguuugagguuacagugaacuaugauugugccacugcauuccauccugggugacagagcauaagacccugucucuaaaaaacaacaaaacaguuuuuugaaccaaacacauuguuuggagguauuguauauggaaauauccccaaguuaggcauugccugagguuuuugccuugcggauuucuuacguucuauuuguuuggauagugugagacaaacaauccaaaaacuauagguggcuuuauagaacauucuuuacuaaacacuaagcuuuaaugcaaaguaaaaguuccguguagguuuuuaggacggaucuguuagaauuauaugccugccacaauguuuuccuuuguauucacaugaccauuguguguagccaccagcuuugauucucuuuugacagucauaaucuauacaaucuaacuuuaguuaauggguugcuuuuggcuuuuccaguuugaguugcuaacaugcuucgaagucagagggcuucuggagauuagcgcucagaauaacucuuuugcuuguaauaucuucuuugguuuuguuauugaaaacgcuuuucaaauauagacaauacaaacauaauaaauggaaggaaagguucaucuccucaugacucuauauuucuuaaacaacauuauuauugacuggccuauugguugccaaaaaggaaaaucaauuuuauuggaaguauuugcuuggccacagaucuugguacuaacucagcacagacagucugauguuaucagcuaucugaagacuaauuuuuaccauuagucugaaacgaagcaguaauuagagauaugucaaagucuacucuguguuuuccugucauuuuuuacccuucagucuaucucauacauuuuuuuuuauacugcggcuucuauguugugugacugugauggaauugaagcuugaaauuuuauuucuaagaaagaugcuguauagauuucauuuguuaucugacaguauuauggauacaguuuugucucuuccacugcuugguauugauuuuuaauuccacucuggaaguuagguucuugccacauuugggauuaggauauggcuuacgggcgugcgcacgcacacacacacacccuucucugacuucuugaguaacuuugauuuuucaagcccugaagaaagauuaaaacuaccccccaaagcacauuaaaagguauuugaaugcugaacauuuauugguaggaggaguaggagcaucugugguguaugugucaguacuguguacugguguuaugcaguuuaaaagaaaaacauuuuguuuuaagugguacagaaauguguaaaggcuuuaugacauauaaauuguauaagcuuacgguuuauagacuagcccugcgcccucucggugaauaccuugugccugucugugucuuauaaaagauuucaaaaacaugagaaaaguauaaagcaauaaauaaaaccaucuguaaucccauuacauaguauguaucuguguggggagggguggguuggguaggauauaacaaguauuuaguguuuacuaugugucaagaauuuuaugugcauugucucuuuuagucauugcaucaaugccauaaugugcauauauuaugcucuacauuuuacuggugaagaagcaggagccuaaagaaguuauagagcuagugaaggccaaagccuagauuugaauauucugacuccaaagcccaagcucuuaaccuauucacuguaaaauuuguauauauuucauuuucaucuuuuuucuacuuacauguauauauuuuaaagcuauuuaguauaauauuguacauaaaguuuuuucuucauuauuuaaaauuauuaagucuaaaauaaauucagugagguaauguacacaaaucuuaaggauacagcacaguguguuuuacauacauacacacacacacacacacacaucuauacacauacacauacccuuguguaacuaccaccuauuucaaauuagaacauuccuggaaccucuagaaaguuuguucccuaaaguuacuuccugucaauaugcauccuucacuuccacccugaggugacuauuauucugaacuucugugaccccugauuaguucuaacucuucuuaaaauucaaauauuuggaauaauaaaguauauauacuuuuggauuaagcuuauuauguucaacauaacauuugugagagucauucauguuacauguaucaauuguucccuuauugcuguauaacauuucauugcguguauauaccaggauuuuaucuguucuguugauggacauuuaggugucuuuuuuuuccuucagugucuggcuauuaugaauaaaggggcugugagcuuucuugaauguagacauauacacauauauuuucauuccucuuagguguauaccuaggaguagaauugcugggucauagcauagcucuauguuuaaccuuuugaggaacugcuuguuguuuuucagagaggcugcaccauuuuauauucucagcagugauguaugagaguucuaguuucuccacauccuugccaauacuuguuaucaucugucuuguugauuauagccacccuaagguaugggaaguagcaucucacugugguuuugauuuucauuuccuugaugguuaaugauauugagcaucuuuucauguacucauuggucauuuguauauguucauuguggaaauuucuauucagauuuugugcuuauuuuuaaaauuguguuauuugucucuuuauuauugaguuauaagaguuauauguuuuggauacaagucucguuucagaugugugauuugcagauacuuucuucaguucauugaauuguguuuuuacuugcuugauaguguccuuuaaaacauaaaaguuuuaaauuuuuaugaucuuauuuauuuuuguuguuguuguuugugguuuuaagaaaucauugucuaaucaaagaucaugaugauuaagccuuuuucuucuaagaauuuuauaguguuaucucuuacauugaagucuuugauuauuuugaguuaauuggguagagugugaaguaggggucuaacuucauucuuuuacauauggauauccaguuguuucaccaccauuauugaaaagacuguucuuucccccauuaagucauuguagcacucuugucaaaaauaaauuuguuuauaaauaugaggguuuauuucuagauucuuaauuuuauuccauugaucaguaugucuuuccuuauguuaauaccacacagucuugauuacuauggcuuuguaguuaaguuuugaaauugagaaguguuauucuuccgccuuuuuucaaaguuguuuuggcuauucugggccccgugaauuuccaugugaauuuuaggaucaguguguucauuuuugcuaaaaaggcagugaagauuuuaauaagaauugugugaacucccauucacaauuguuucaaagagaauaaaauaccuaggaauacaacuuacaagggacgugaaggaccucuucaaguagaacuacaaaccacugcucgaugaaauaaaagaggauacaaacaaauggaagaacauuccaugcucauggguaggaagaaucaauauugugaaaauggccauacugcccaagguaauuuauagauucaaugccauccccaucaagcuaccaaugacuuucuucacagaauugggaaaaccuacuuuaaaguucauauggaaccaaaaaagagccugcaucuccaagucaauccuaagccaaaagaacaaagcuggaggcaucacacuaccugacuucaaacuauacuacaaggcuacaguaaccaaaacagcauggcacugguaccaaaacagagauauagaucaauggaacagaacagagcccucagaaauaaugccgcguaucuacaacuaucugaucuuugacaaaccugagaaaaacaagcaauggggaaaggauucccuauuuaauaaauggugcugggaaaacuggcuagccauauguagaaagcugaaacuggaucccuuccuuacaccuucuacaaaaauuaauucaagguggauuaaagacuuaaacguuagaccuaaaaccauaaaaacccuagaagaaaaccuaggcauuaccauucaggacauaggcaugggcaagaacuucaugucuaaaacaccaaaagcaauggcaacaaaagccagaauugacaaauaggaucuaauuaaacuaaagagcuucugcacagcaaaagaaacuacuaucagagugaacaggcaaccuacaaaaugggagaaaauuuucgcaaccuacucaucugacaaagggcuaauauccagaaucuacaaugaacucaaaccaauuuacaagaaaaaaacaaacaaccccaucaaaaagugggcaaaggacaugaacagacacuucucaaaagaagucauuuaugcagccaaaaaacacaugaaaaaaugcucaccaucacuggccaucagagaaaugcaaaucaaaaccacaaugagauaccaucucacaccaguuagaauggcgaucauuaaaaaaucaggaaacaacaggugcuagagaggauguggagaaauaggaacacuuuuacacuguuggugggacuuuaaacuaguucaaccauuguggaagucaguguggcaauuccucagggaucuagaacuagaaauaccauuugacccagccaucccauuacuggguauauacccaaaggaguauaaaucaugcugcuauaaagacacaugcacacguauguuuauugcagcacuauucacaauagcaaagacuuggaaccaacccaaauguccaacaaugauagacuggauuaagaaaauguggcacauauacacccuggaauacuaugcagccauaaaaaaugaugaauucauguucuuuguagggacauggaugaaauuggaaaucaucauucucaguaaacuaucacaaggacuaaaaaccaaacuccgcauguucucacucauaggugggaauugaacaaugagaacgcauggacacaggaaggggacaucacacucuggggccuguugugggcgggggagcgggaagggauaacauuaggagauauaccuaaugcuaaaugacgagucaaugggugcagcacaccaacauggcacauguauacauaugaaacuaaccugcacguugugcacauguacccuaaaacuuaaaguauaauaauaaaaaaaaauugcauugaaucuauagaucagcuuggggaauaguaccaucuuaaaauauuaaguccaugaauacaugaugccuucccauuuauuuaggucuuauuuaauuucuuucauuugauguuuuauaguuuucaguguacaagucuuacacuucuuuuguuaaauuuauuacuaaguauuuuauguuuuuaauguuauaaaugaaauuguuuucuucauuuccuuuucugauuguucauuuuuaauguauagagauacaauuaauuuuuggccaggcaugaugggucacaccuguaaucccagcacuuuggaaggccaaggcaggaggaucacuugaggccaggaguuugagacuggccugggcaacauagugacucuguauugcuacaaaaauuaaaaaaaaaaaaauugaucuguguuuauugaucuguauccugcauucuuucugaaugcuucuauuaguucugacaguuuguuaguggauuccuuauaauuuuuauauacaagauuauaucauuggcaaauagagauaguuguauuagcugcauaaaaccagaugggaaauacuccuuuauucucugaaagagugcauuuaagauuaguauuaacuauucuuuaaugcuuagaugaggggucuucaguuccugauaagacuuauuucugccuguucuuccuauucaguucagauuuaaaacccuggacauacacagcaaauaaacauaagaagacuaaaggguuagaagaagagagcugacugacuagggaccucaagaauugagaaaugacccuguggugauuucucuggguuuucuuuuucuuuuuuuuuuuuuuuuugagacggagucucgcucugucacccaggcuggagugccguggcgcgaucuuggcucacugcaagcuccgccuccuggguucacgccauucuccugccucagccucccgaguagcugggacuacaggugcccaccaucacgcccggcuaauuuuuuuguauuuuuaguagagacgggguuucaucauguuaaccaggauggucucaaucuccugaccuugugaucugcccgccucggccucccaaaguggugggauuacaggugugagccaccgugcccggcuucucuggguuuucuuuuuguuucuuuauaagcugaagugggcucuggagaagcccacaacccagaaauaccaaugggugcagauaagaaaagccuguuaucucuugccaaaggacaggaaaaggggcaaucuaaaagaacagaacuuuucaacaacaauaccacccuaccccagccaaauacauggaggaagaauaugccacccccuugcuuggaggcugaaagggaagccuacacauccucuggcuggugguagcaagcagugcuucucuuccccaucaagguguuaucaacagaugcugaaugaguacccugagcuuucaguuccugcccagugguagcagggagugauuuccuuuccucaccaggguggugccagaagaggccaaaugggaagccuagacuuucaucuccugcccagagguagcagaugauacuccccuucugucguaaguguggugucaguggagaccaagugguaagcuuggauauccaucaccucccacccuggaauuaaaagcaauaauaagguaguacuucuccccuucccaaauagggagugauggugugggggagaauuuuagagaggagggagcuggagaaagcaaugcuuuaaacuuguauguagaguccuggaaagaacccagagugacucguacauuauacugaccaaaauuaacaugacagaaggguugagaacugaacuacaguguggaauagugccuacauuuucacauugaccucuaaguagcacacaagcaaggcagacccaaauaguacuguaagggcucugaaaaugaaauuauuauuggaacuacaacuccuaaaaguagaucaggagcugcacaagaaacccaaauagagaaacugccugcuaaacuagaagauuuaaauagaauacagauacgcauacucaaaacugaaaauuacucaucauaccaagaaccugggaaaucacaacucgaaugguaaaaggaggucaauauacgccaaacagugagauggugaaauuaucugacaaagauuuuagagcagucaucauaaaaauguuucaaugaguaguuacaaacauucuugaaacaaguggaaaaaacagaaaaucucagcaaaggaauaagagaucuaaaaaggaacuaaauagaaauuauagaauugcaaauauaauagcugaaauaaaaauucacuggaugcacucaauacuagauggaaaugauaaaaagaucagugaacuuaaagcaauagaaaguauauaauuugaauaacagagagaaguagauggaaaagaaauuaacagaggcuccaggacugugggacaauuguaaaagaucuaacuuuuuuugucaucagagugcuagaaggagaggagaaagaguguggaacuacaagaaauauucgaagaguuacuggcugaaaacuucccaaauuugauaaaaggcauaaaccuauagauuugagaagcugagagaaccauagacagauauaccugacaaaauccacagcaagacacauuaaaaucaagcuuuggaaaauuaaugagaaaaaaacaacaacaacauugaaagcaguuagaaggaaaaaguacacugcagaugcuccucaacuuaugaugggcuuacauccugauaaacccaucauaaguugaaaauaucauaaguugaaaauacacuuaauacaccuaacuuaucucauagcuuaacuacugaaugcgguuuuuguuuguuuuuugagacagugucuagcucugucgcccaggcuggagugcaguggugcaaucuuggcucacugcaaccucugccacuuggguucaagcuauucuccaaccucagccucuagaguagcuggggcuacagguacgcaccaccaugccuggcuaauuuuuguauuuuuaguagagacaggguuucaccauguuggccaggcuggccucaaacuucugaccucaagugguccacccgccucggccucccaaagugcugggauuacaggugugagccauugcgcccagccuuuucuauccuuuuacuuguacccuauguguauguguuagucuacuugguccgcuguaacaaaauacacagacugaauagcauaaacaacagacauuuauucccacaguucuggagguucuaaaucaaagauaaaggcgccaacaggguugauuucuggugaggccucucaacuuggcuuguagauagccaccaucuugcuggguccucacgggccuuuccucugugcucauauauggagagaucucuagugucucucucucuucuuguaagggaaccagcccuaucacguuaaggccccaccuuuauaaccuaauuugaccuuaauuagcucuuuaaaggcccuauuucuaaauauagucauauugaguguuagggcuucaacauaggaauugggugugggggagcacaauuuaguccauaacacuguaucuuuauauuuaaggcaugucucuuauaaacaguguguaguuggguuuuggucuuuaucuaguaugauaaucuuugucuuuuaauugcaguguuuaauucauuuacauuuaauguaauuacugguaugguuguguuuaagucuaccagcuugcuauuuguuuucuguuugucccaucugcucuguuucucuauuuuuuucuuuccugacuucuuuuguguuuauaaguauuuuguugcauguauagaauguguaaugaucaagucaggguauuugggguauccauaaccuggagaacauuucagguucucucuucuaacugccuugaaauauacaaugcguuguugcuaacuguaguaaaagcccuacucugcuaugaaacauuauaccuucuaucuaacuguauguuuauaccuauugaucaaacucuuuucaucacuaccucccaccagcacacuuuuuccagccucugguaucaguccuucuacccacuaccuucaugagaucaacuuuuuuagcuccuacauaugaaugagaacauguaaaauucgucuuucugugucuggcuuauuucacuugacauaagggccuccaguucuauccacauugcugcaaaugucaugauuucauucuucuucauagcugacuaguauuccauuguguaugcauaccacauuuucuuuauccauucaucuguagauggacacuucaguugauuccauaucuuugguauugugaauagugcuacagugaacaucaaagugcagguguaccuuugauacacuuauuucuuuuccuuuagauaaauacccaguagugcgauugcugaaguguauguuaguucuguuuuuaguuuuuuaugaaaucuucauacuguugccccauaguggcuguacuaauuuacauucucacuaaccauguauaagaguuuuucucugcauccuugccagcaucuguuaauuuuuaaucuuuuaauaauaaccauucuaacugggauaagaugguaucucguggucuugauuuacauuucccugaugauuagugauguuaagcauuucuuucauguagcuguuagcuauuuguuugucuacuuuugagaaaugucuauucacauccuuuacucauuuuuuaauaggauuauuauuuuuuuaacuauugaaugguuugaguuucuuguauauucuggauauuagucccuugucagauaauuugcagauauuucuucacauucuauagguugacucuuuacucuuuugauuguuugcugugcagaagcuuuguaguuuaauauagucucauuuagcuauuuuuguuuuuuuuuuuuaaucucugcuuucaaagucuuagccauaaaaccauugucuagaccaaguucccuauguuuucaucuaguaguuuuauaguugcaggccuuguauuuagguauuugauucaucuugaguugauuuuuauauauggugagagauggggauccaguuuauucccuugcauauggauauccaguuuuuccagcaccauuuauugaaaaggauggccuucccucaauguauauucuuggcaucuuuguugaguaucaguugacucuaaauaccuagauuuacuucuggauucccuauucuguuccacuggucugugugucuguuuuuauaccaauaccaugcuuucuugguuacuauagcauuauaauauauuuugaagucagacagugugaugccuccagcuuuguucuuuuugcucaggauugcuuuagcuauuugggcucuuuucugguuccauacacauuuuacaauuauuuuuucuauuucugugaaaaaugacgucaauauuuugauagggguugcauugaaucuguagauuacuuugggcaguguggucauuuaaacaguauucuucuaacucaugagcauggcaugucuuucuauuuuuuugugaauuucuuuugucaguuuuguaguuuuccuuauagagaucuuucaccuccuugguuaaauuuauucccagguauuuuuuuuauagcuauuguaaaugggauugccuucuugauuucuuucucagcuaguucauuauugggguacggaaacccuacugauuuuuuauauguugauuuuguauucaacucgacugaauuuguuuauuagaucuaagagauuuuugguggagccuauagguuuuucuagauauaagaucauaucauugucaaagaaggacaguuugacuucaaguuuuccuguuuggaugguuuuucuuucuuucucuuuccuaauugcucucacuaacacuuccaguacuguguugaauaggaguggugaaagugggcauucuuggcuugugccaguucuugggggaaagguuuuccgauuuuuccccauuugguacgauguuagcugugcguuugucauauagcuuuuauauguugagguauguuccaucuaugccuaguuuguugaguguuuuuugaagagauguugaauucuaucaaaugcuuuuucugugucuguugagauggucguaugguuuuuguccuucauuuuauugaugugauguaucacauuuauuaauuuguguauguuggaccauccuuacaucccugggauaagucccauuugaucaugauguauucuguacuguuggauuugguuugcuaguauuuuguugagaauuuuuacauuuauguucaucagggauauuggccuguaguuuucuuuuuuuguugagcccuuaucugauuuugauaacagguaaugcuggccuuguagaaugaauuagggggaaugccuuccucuuuaaguuuuuuuuaaagaaugguuugagaacugguguuaguucuucuuugaaaguuugguagaauucagcagugaagccauccaguccuggacuuuucuuuguugagagacuuuuuaucacugauucaaucucauuacucacuguuggucuauucagguuuuauuuuucuuccagauucaaucuuggcaguuuguguuguccaggaaguuacccauuuucucuagguuuucuaguuuuuuuauuguguaauuguucauaauugucucuguugauccuuuguauuucuaugguaucaguuucaaugucuccuuuucguuucugauuuuguuuauuugggucuucucucuuuuuuucuugguuagucuagcaauugguuuauuaacuucuguuuaucuuuucagaaaaccaacuuuucauuuuguugauucuuugguuuuggguuuuuuguuuguuuguuuuuuagucucuuguuuaguuuugcugugauuuauuauuucuuauacuaaguugggguuugguuuguucuuguuucuccuuuucuuuucuuuuuuuuuuuuuuugagaugcagucuuguucugucacccaggcuggagugcaguggugcaaucuuggcucacugcaaccucugccucuuggguucaagcuauuuuccugccucagccucagccucccugguagcugggauuacaggcaugcaccaccacgcccagcuaauuuuuguauuuuuuaguagagaugggguuucaccauguuggccaggcuggucucaaacuccugaccucaggugaucugcccaccucggccucccaaagugcugggauuacaggccugagccacugcaccuggguguucuuguuuuucuaguuccuugaggugacuuguuagauuguucauuugaaauauuucuacuuuuuugaugaagguuuauauugcuauaaacuuccuucuuaacacuguuuuuacuguaucccauagguuuugguaccuuguguuuugauuuucauuugguucaauaaauuuuuuuuauuuccuccuuaauuuuucucuugacccaauggugauucaggagcauguugucuaauuuccauguauuuauacaguuuccaaaguuccuguuguuauugauuucuaguuuuauuccauuguggauugagaagauacuugauaugauuucaguuuuuuaaaauuuguugagacuuguuuugugaccuaauguauggucuguccuggagaauuuucugcaugcugaugagaagaauguguauuuuguagcuguuggacaaaacguucuguaaauaucucuuaaguccuuuuggucuaaugugcaguuuaaauccaguauuucuuuguugacuuucugucuagaugauuucugucugguggcgaaaaugguguauuaaaguccccaauuguuauuguauuggagucuaucccgcccuuuaaaucuaauaauauuugcuugauauaauaucugggugcugcgauguuggguguauguuuacaauuguaaccucuuucuaaauuaauccuuuauuauuauauaaugaccuucauugucucuuuuuacugguuuugacuuaaaguucauuuugucugauaaaaguauagcuacuccugcuugcuuuugguuucuguuugcauggaauaucuuuuucauccucucauauucaggcuguaugugucuuuacaggugagaugaguuucucguaggcaguauauaguugagucauuuuuaaaagccauucagccacugugugucuuuaaaguggaaaauuuaauuuacucacauuuaagguuauuauugauauaugagagcuuauuccuaccauuuuauugcuugauuucugguuguuuuguauauccuuuguuccuuuauuucucucuuauuuuuuaucauuguaguuuagugguauucuguagugguaacauuugagguuuuucucuuucuugauuuguguguuugcuccaccagugguuuuuauauuuucacgugucuucaugaugguaguuauuguuguuucacuucuggguguaggacucccuuaaccauuuuuuuuuuaacuuuuaaaaaccuauacagcauguuauuauacugaguaucccuuaagcaugucuuguaggaccagucuagggcgaugaauucccucagcuuuugcuugucugggaacaacuuuauuucuuuuucauuuccaaaggauaauugugcuggguauaauauccuugggcaauuuuuuuccuucaggacuuugaauauaucauccaauucucuccuggccuguaagguuucuacugagaaauuuguuguuauucugauggggguuccuguauaggugauuagaugcuuuucucucucugguuuuagaauuuugucuuugauuguucuuuguuuguuuguuuuguuuuguuuuuguuuuuguuuguuuuugccacaugaucucacugugucacccaguagcaugauaauggcucacugcagccaugauuucccgggcucaagcaaucuucuugccucagccucccaaguagcugggacugcagaugagggucaccaugcucaacugacuuguuuauuuuuuguagaaauggaguuucaccauauugcccgggcuggucucgaacuacuggguucaagugauccuccuaccucaccucucaaagugcuggaauuguaggcaugagccacuaugcuuggccugucuuugacuuuugacaguuugacuauaaugugguguggagaaaacauuuuuacauuguuucuauuuggggaucuuugagcuuccuauaucuggaugucuaaauuucuugcuagacuugggaaauuuucacuuauuauuauaguuuuucuaaccuuuuguuuucucuuugccuucugggguuccaauacuuugccuauuuggucauuuuaugguggcccauaugucacaaagguuuuacucauuguuuuuuuguucucuuuucuuuauguuuguuuggcugagguaucugcgaagaccugucuucaaguucugagauuuuuuuucuucuguuugaucuauucuguuguugaagcuuuugaauauauuuuguauuuuauucaaugaauucuucaguuucagaauuucuguuuaguucuuuuuuauuauaucuaccucugacaaauuucucauucauauccugaauuguuuuucugauuucuguguguuguuuuucagaauucccuuguauuucacugagcuuauuuaguaucaauuuuuugaauucuuuuucaggaauuucaugaguuucuuuaugauugggauauguugcuggagaauuauuauguuccuuuggaaguaucauauuccuuugcuuuuucauguuucuuagguccuuacauugauaccugcaaucuguugugacagucacuucuuccaguuuuugaauuugcuuuuguaggagagaacuuuuuccuacagauauaucuaugguguuggguagguagggcacuuugguuuucauucugguaguguaauuucuggaugauuucuucaacuguaaauagcaucaguguuaccugugauuuccuugguggcuuagcauacaguuguuagugaaguuuuucuggggacugggaugccaagugggccagucuuuagaccccagggugguguacccuggcauugguauuagcagguccaggcaggcugacuuguaggcuuccagguaacuuacuugggugccaaaaauggcaguggugggucagucaaguggguguguucucgagccccuagguaaugagugugacaugggcaguggcaguagcaguggugggacaacccucugggacccaagcagaggguccccacuggugguggugguggcugugauggguggagugggccagugcccaaaucugcagguagcacaugcuggggggugccaucuaugguggcaguggugggcugggugggcccaaccucaaaccccagcagggagugcucaggugccacuuguagugggcugggcuggggacauucccuaggccucuggagcuauuuccugcuuucugucuugaauccaacauuaacaguuuacacuggaauuuuuuucauuuuuuauuuggaaauaauuuuagacucuacagaaaaguugcaaaagcagugcagaguuccuguauacuacucaucuagcuuucccuaauaauuaacuucuuguauaaccauaauauaacugucaaaauuaggacauuaacauugguaugauacuauuguuuaaauuacagaccuuauuugaauuucaacaguuuuucuacuaauaucaagaauguuuucuguuccaagauccuauccaguauuguaauuuggauuuaguuauucaguuccuuagucguuccuuauacuuuaauuauccuuaugcuuuugaagauaacuaauuaguuuguagaauguuccucacuuggguuugucugauguuuucucuugauuggaauuagguuaugcauuuuuggcaagaauaucacagaagugauaugcccuucuuagugcaucauauuaagggauucauaauauuaugucugauuacuggagauguuaaccuugaucacuucguuaugauagugucugccugauuucuuuacuguaaaguugcugucuuuucuuuguaguuaauaaauaugggguggagugagauacuugaacacuaugcaaauccuguuucuccucaaacuuauggcuauuauuauuauuauuauuauuauuauuauuauuuugagacagaguuuuguucuugucgcccaggcuggagugcaguggagcaaucacggcccacugcaaccuccgccucccggguucaagcgaaucuccugccuuggccucccgaguagcugggguuacaggcaugugccaccaugaccagcuaauuuugcauuuuuaguagagacgggguuucuccauguuggucaggcuggucucaaacucccgaccucaggugauccacccaccuuggccucccagagugcugggauaacaggcaugagccaccaugccuggccuaugcccauuaauuuuagcguccaucaaugaguugugucuccaacaguuguuauugugguauuugccuaauggugauuuucuguuuuccucuuuucuuuuacauuuacuaauuggaacccucuauaaggaagaacuggcuauuucccccgauucuagguucaucuuauauuuucccuacucuaguccuggcaccaaccauuucuccaaggaucacugguucccuuuauuagaaaauguguuuaaaaacuaagagcuggacacuagaugugcucaauccuuuuggaacaguauuguuucuugguucucuuaauggccagagcuacaaaauauauguauauguagaaaauguauguauguauacuaauccaugcaaguacacauacucuauuucuguaucucuguaucuguauuuguauagaauaucguguguuuacacugauacuuugauuauaaucaaaaauuacaggguuuaguuuagccuuuccuuauuuauaacuuuuucucacagaaacucagcucuuauuauuugcaguguuuuuuuuucuguucaacucuaguauauacgcauaaaggaguuucagaauuguuaacucauaccucugugugaaacauuuacuaacuauguuaaaacauuuauguauauuucauuuugccauuagccuuacgguuuccacucaacauacuguuuuccaaaguuacuuauguuuguuucuuccccacucccuucaguauaguuauguuauucaggucagguucauuuguggguguuuguaugcgauuuuagauucacuucaaauacaugguuggcuuuaauguuuuguuuauuugggggguaucugaaacauuacuauagauaugagcaucagaggcguauaaauagauguacacagagauuguuauuuuucccccguuccugcuaccugagugccaucucugucuuuucaguccuuuuucacccacucccuacagguaaccagucuccuuuguuucugauuuaucuuuucuauauuuauuuugcacuagugagagaguaugugcacauuuucauaucccauuuuuuuuacaugaaagguaacauacuaaagauacucuuuugcucaucacuuuuucaccuaacaguguauccuagaguuacuccauaucacuucaugaagauuuuuauuuacagcugcauaguacucccuuauguggauguaccauaguuuauugaaacacucuccuauucugugggcauuuagguaaugucuaacgcuuugcaauuacaaacagugcugcaacuaauaaccuuguacauauguauuuucauguuguuggagguguaccuucaggauagauuccuguaaguggaauuacugggugaaaagguaggugcauauguaguauuuuguuagauguugccaaauuucccucuagaaggguuuacuaauuuauauucccacuaccaguucauaagagagccuguuuccuuauagcuuuuucaauagauugugcucucucacauuuuagaauuuuugcccugauagagaaauggcaucucaguguuguuuuaguuuucauuucucuaauuaugagugaguucuuauuuuuauguauuucagggcuauuuuuauauccugguuuuggugaacuaucuguucacauuuuuccccauuuuucuaucagguuuuuggccuuuugugacucaguuuuuucagaguucuuuauauaccauggauauuaacccuuugugguauauguuguagauauuuucgcccauuuuuguuucauuugucuguugauuuuguuuaugguaucuuucaucaugcaagaacuuuuuauuuuuauauaaucaaauuuauuagucauuuuauugccucuggauuuuaagucauaauuaaaagccuuuucaagagagauuccauauuuucuucuaguacucguaugguuucauaguuuacacuuagauucugaaauguaugauuggagauguggaucuaauuuugucuucuuccaaguggcuuaccuguuguccuggcaccauuuauuuaaaagucuauuccagcugggcacaguggcucacgccuauaauuccagcacuuugggaggucaaggcaggaugaucccuugagccuaggagcucaagaacagccugcacaacaaagcaagaccccaucucuacagauaacaaaaaaauuagccaggcaugguggugugcaccucucgucccagcuacucaugaggcugaagcaggaggaucaccugagcccaggagaucgagacugcaguuagcugucauugugccacugcacuccagccugggugacagagaccuugucucaaaaaaaaacagucuguucccucaugauuugagaugccaccuuugucuuauauuguauuuccuuauguuugggguuuaauuuuggacuucauaaccucuuccacugcuucuuuugugcauguacauuauuuuaauuaaaaggcuuuauaauagguauuaaugucuagaauagguauuucucuuucauaguuuuucuuuuuaaguguuuuccugguuauugcacucuuugaaauaugaaguuucauaauaguuuauguaacuccauaaaauagcuuauugguauuuuuauugggauugcauugaauuuauaaguuagggaaaacugacaucuuuauaauauugagucaccaauacaagaauauagggugucuuuccauuugaucuagucuaauuugcaucuuucaggaguuuuacauuuuuuucucauauagguuuuacacauuucuuauuaaauucuuaaauguuuaauauuuuugcuauaaaauguuuacuguuuuuaaguuuuucauauguuugagguuuuuagaucucuaauuucuauacuucaauauaauucuuacaccauuuauaugauguuaagucauugucuauauuucaaauauuuuaucuguaagugaagguguaaauauguuuccuguuuuccgucacauagugucuuugugauuuuaauucaagagucuuuugaaaagucugggcuaauguguuaagucaccuguugauuuucuaaagaauuacuuuaauuccacuuaagaauaggcaggucaggugugaaaacagaagcucuuuaccaaaaacacaauacauuuugucaguugaucuucuuuuucugcugaguggauaauugugaaaacacucuuagccuucaaauuauuuucuuaauccuugauucucucacacauuguaaacagucucuccauaucaguuuuacuuccuuccuagauuacuacuauguuucagguacugaggaagaaauguuuacuagcacuugaguguagcaccuuuccauaguaaaauacuaaacucuucucuaaaaugagugaaaguuuuacauacucugcagcgagugugcaugugaguguaaggggggagaggggcauguggagauuaaauccaguugcuguacuuaaaaaauauguaaugguuuauuuuucauuaugggaaucacuuucaugcaugccaguuucuuuucuacaaaauuauuugaugagaaaacuuccauuuuuagugguuugauaaaacacugauuuauuauguuguggcauaucuuuuugcacuaaggaugugccuuccaaauauacuuguaauucuugccaauuuaagggcagaguuuauguguuaauuuugcauugcuuuuaauauugaaaucacuaccugggcauucuaauuaaauauuuucuuuauguuaccuggagccaaucaaaaauuagaauuucaauaaauaaauaaguaaaaggguuuuuacuacaucaaaaauaucaauugauaauguauauggcuuuaggauuuucuuuacacuuucuaaaaauuuuauaauuucauuaucaaauaccaaaaacuaugucccagaaugcaaagauucuuaaauaauauucuuuacauuuuuaaauuacuuuuuuuaaugucuggagguuaaauaauaaaugucuggagguuaaauaauaaaauuaggaccauauaguauauuuagcaauuucugaucccacuagucauuguuaguaucaacaugauuuagaauucccacuggccaguauguaaucuggucccaauggauuauggguuaaacauaaauguguuuuacacauucuuguucuuuguaagcuuggauauugcucuugcagugacauucuauuugucugcauuuuaugcauuagccagcuauaggaaaagugcauuuagguaaaggcuaguacucuuuucccuagaugaugauauguuuuuuucuugaugcucuuagauuauugaauguuuuaaguuacauuuuugcaaaugacugcuuugaugaguuacucucuaaugaaacucugaaauagcagcaaagugcuaaaauggcaaguacuuugauuuuuguauucaaagaacauguuuggaaagcugaaauuaggagaaauuucagugaaugaaaagaaauaaaaaauaaaugagguaaucaaagucagagaaauugauauuggcagguucugaaugauguuucuagaugagcaauauuucaaaauacuucuuguacauugcugcuauuccuuuauuuauuauuaaaauaacaugauccaugaggagcucggggugacucucggccuagcuaauucuaauuaauccagucagggagagcaguaggguaaguggagcagucuaucggauugaaauucauaacuuaauugaggucaaagucccggucugggagaacaaaagucuuuugcuaggaccaggcagaucaauagcaauaaauaucuggcuuggauacaaguagcuuauagugacagauuaucugacacuggccagaggucuugguucuguuaagggcaaagucuugagcaugccaugguucuugcugauguucagucuguacccaugacacuuggaaagaaguaagugauacucucaagaacacuggaaaaucuuauggaagcacuauguaugaaauuccaagugacuucuacuuguuaucaaaugaacauucucuaaggaugcauuuuuuacaugacagaggagcuucucucacauugccgguaaaauccaaaggauuugcgacguugauuaaucuugagaacuaacuuucccacuaauaauucaaaaauaauguauagaauugcuuuaugggagaaaaauaacaggccuauauuaucaugauuuauauguaaccauaaaaguuaagaggaccauguaacauuaauuucauggaauuagcauuaagucuuuuagguguaacaaugguauugugguuacauaggaauauguuuuuguuuuuaggugcauacugauauauuuagagacaagaugucaugaugucuguaacuuauuuaaucuacuucagcaaagauaaauaggacagaaaguuaauuguugaaucuguguaauaggugucuacuuuucuguauauauaaauauuuauauaauaaaaaguaacaacaaaagaaccauguguauuaaaaccauuaggcuaguauguuacuaggaaagguuucccucugucccauucuguucauaaccuuaaauuccuauugaguuaucaaaaucuugguuguucuuuuaugugguauauuguuguuuauccaucaucaucaccaucguaacuuaauuaguauaacacuuugguauucuguuuaucauuugauaacauuauugccacucagguucaacuaccacgugacuguggggaaaggaauucuugugaucugcaguuguugaccuuguaaggugugaagagcuucguaguaaauauuccacuccuguugauacuucacuaguccaaacuaucauuucuucaugugugaauuauuguggcaacuucuuaugugacuuuuuuuaauccuaaauaauugugacagauuagucuuccauaaacuucauugucuagauuccacuucauaucuaaaugauucugugaucaaaaaccucuagugguuuucuucucuaugaaucauuucucaauuuuuaugauuaacucucaaggcccuaccucuuaugaccaaacauuuuuauccaguguuccucacuuuggugaaauuggugagcuuacuuuguauaucucagaaguucugaaaccuggaucaccaagagucgacuauagaucuuuuaaaaaaguaggccccaacuccagaaauuaggacucagaggguagguuaggagagagcugucgggaagaugagaauuucaaaauuauaaaauauccacaucuaauuuugugguaucagguuuguaauucuaaacucuguaucuaccugccagaccuucagugcuuccuaucucaaguaggaguuaggagaaaaacaaucagguuaaacugauucauucgugugaugaaucacuaacaacugucuagaauucccauauacaguuguauuuuuaaagaaaagaugcaaauuuagauauaauccuauuggcugagcacuuguuauuuguaaaauaauuguacaaaauauauauauauauuugaucucuuuuuuccuuauaaucaucugugaaauguuuuuuucuuuauaaaauaacccaaagucacagagcuacuauacagucaagauucaaauccaaguuuuccaauaccaaaugaucuaugauaaauuuucaguuuaucaauuuucaguuaguuugucaaaauaaagugaaaaaaauuaaggcauuuuagagaacauuuuuuaaacagaacuaauaaacaaggcaguccaacaucagauuguuuuucagcauguuuucuuuuuaaacaguuucugcccuuuauuugucuuggaacccacauguuuuccauaaguuugcauacacauuaaaauaauaauaaaacaacuccucucugauggcaaauuggagaacauagguggaguuuuuuaaugggucauuuggaagccaaaugaagucagagacuacauuuguauaccugaguuugagaaagcauaguagaaaauguauaacuaaguaauuuaaaauuuagacaagcaaccucugcucucagaaacacacacacacgauaguuccauaauacagaacuguuggagaaugauauaugugaauacacuuuauauguauauaauacuuguguaaauguauauuuguacaaaaauauaaaaucuauauuuaacuaauguuacuguauuauauuuacuucauuguccacuuuguguugucuuuccaguggauuguaaguucuuugaaugcagggaccauguuuucuguuucuucaauauuccuaguggucucuuguguaauguuugacauacaguauuauaaaauaugcaaaaugauuguuccuuuauagauagauacucccucagccuaaaacacauguacaugugcauaugcacacacacaaacacacaguucuuuuccccauacccucuuuacuaaaguuaucaccuuucugaggaagacccugaccuaaccucacucccuuuccucuaacuacaaccucccuuuaaaccccccucuuuugugcuucugugauauccuuuguuuaaucugucuuguaauuuaucauucuuuauuacaguugucuccaucuauuagacuccaggguccuugagaauagggacuuugauauuuuuccuuuucuuaacuccuaacauacuacuuggcacaucacuuaauguguuugauauaagcuaagaauacuuagaguagaaauaauauugccucaaagaaaugaugcauccaaauuuauggaaaagaaaaaaagaauucagauuaugaacacucagucuuaaguuuauuugaaugcuucgugacuuucuugauauaucuggucaauaugcuuauuuguucucuagaaacuuguguguggcaggaauaaauaaguaugcuguaacacauauaucagauagacauucuugagugguggaugcuaaauacuuuguucuaaagauaaauuugauguacucuuagaugaagguuaugcauuagagaccacagugcccauguugacaugacuuacugcucagaaaucucugcaauggacugauuuuguuucaugcaacuguuacuugucuaacaguuuuuuauuuuuuagaaauuuuuuuuauuuuaacauuuuaaaaacugaguaaguugaaggaaauauagagaaucucuuuaaacuguaguagaagguauuaguuuagagauggaagaagaaagcugagguauacgauaaucaucucucugugucucucuuuuauuucucccuuccgaaaauauaaaauuuauagcugcuuaguacuuuuaaaaucacaucuuccaucaguuaugcaguggacuuuauauagagaccaguccaaaugacccagcucacucucaggaucaaccaacggcagaucuugcuguugauacaugugccccuaggccugaaggguggccaaggggcaagugagcgaaaggugagggaguguguugcauuuggacauguaaacugaaaugucuauacucacgucugugaggaccuuugugauauggguuggagcccugcguaggcugcuccguuuauacucuugccccaggcccacacaaauguugggggaggccugccuaccagcgugguaguuucaaacuguucugugaauuccuacagagaugccuaaagguuuucuuccuuugaacauucuuccuugaaccuuuacuuauuuuuagauuagacuucugaauaagauuuguuuuuaaaaugaguucccuauaaaggauuauaaacuccuuuuuuaaggauugagauuaugaagguagauacuaaaucuaguccucacugugugcaguagccuuucuuauccaugguuucacuuucugcaguuucaguuaccugugauacagcauaauaagauguuuugagaggagaggaaaggauaccacauacacauaacuuuuaugacaguauguuguuauaauuguucuauuuuauuagugauuguugcugaucucuuacugugccuaauuauaauuuaaacauauauauauauauaugaaaaaauaauauauguaggauuugguacuauccaccauucaggcauucacuggggauuuugaaaugcaucccccugaaaagacuuccuauucaguaaauggugcugggauaacuggcuagccauaugcagaagauugaaguuggaccccuuccuuacaccacauacaaaaauuaacucaagauggauuaaagacuuaaauguaaaacccaaaacuauuauaacccuggaagacaaccuaggcaauaccauccuggacauagaaacuggcaaagauuucaugauaaagacaucaaaagcaauugcaacaaaagcaaaaauugacagauaggaucuaauuaacuuaagagccucugcacagcaaaagaaacugucaacagaguaaauagacaacuuauagaaugggagaaaauauuugcaaacuaugcaucuaacaaaggucuaauacccagcaucuguaaauaacuuaaauuuacaagagagaaccccauuaaaaaguggacaaaaaaacagggacagacacuucaaaagaagacauacaugaagccaacaagcauaugaaaaaaaaggucaauaucacugaucacuagagaaaugcaaaucaaacccacaagauaccgucucacacaagucagaauagcuauuauuaaaaagucaaaaaauaacugaugcuggcaagguuguggagaacagggaacauguauucacuguuggugggaguguaaauuaguucaaccauuauggaaagcaguauggcgguuccucaaagagcuaaaagcagaacuaccauucaacccagcaaucccauuacuggguauauaccaagagguacauaaaucauucuaccauaaagacacaugcacgugaauguucacugcaguacuauucacaauagcaaagacauagaaucaaccuaaaugcccaucagugacagacuagauaaagaaaaugugguacauauacaucacagaauacuaugcagccauaaaaaagaacaagaucauguauuuugcaggaacguggauggagcuggaggcuauuacccauagcaaacuaaugcaggaauagaaaaccaaauacugcacguucucauuuauaagugggagcuauauaaugagaauucaugaacacaaggaagggaacaauagacacuggggucugcuugaggguggagggugaagggugggaggagggagaggagaagaaaagauaacuguugaguacugggcuuaauaccugaugaaauaauuuguacaacaaaccccuaugacacgaguuaacuguguaacaaaccuucacauguacccccaaaucuaaaauaaaaguuuuuuuaaaaaggaaagaaauguaucccccucggauagaaggggacugcuguaccaauacuuuaguauuauuuaaguccuggaacuuggagucauuuuguaaguauuuguugacuaaugaaacaaauuuauucauucccuuaugcaaagaaaucucuacaucugcaaaaacauaggcagaguuucugggcuaacaaaaagacaaaugccaaugcaaaggaagucugaaaauugugaacaaagauuauuaaaccaguauuuacagaucgaacauuuuaaucacguuucuauucugcaaaguauguuuuucuguauuagcucauuuuauccuuacaggaaucuguguagcauuaucuucauuuuacaguugaggaaacuaaagcucagagagguuaugugaauugcuugaggacacaaagcuaguaagugguauaaccaggguucacagcccccugguauuuucacugcagauuccacccuuuuuuuccugcauuguguugccgucauaguuuaucauacugacucagugcuucuagaauucauagcuaucggaugcauuuuaugaggauauaguaauaaguuccucauaucuucuauauuauauauaaugaaauucauauauguagaugacauuuuauucaucaggcuuuuccuuucaguguaacuuuuaacccauauuccuauucacaauuuuguuuaaucaguuauuucucugucauuuuuauauugaauagucacuuccuuugcuaaguuuauaucugagaaugaacagcuggcucacaguacagugugaaucaaguucaaauuacucugaguucagagaacacccagugucaucuuauuuuuacaucuaacugaauuauaggacacugucaaaguguuaugaccugcuauaguaaauugcuccuucuuaaugguccccuggcuacauucucucuugguacugcuauuaaccagaaauuguugacauuuugcacuauuguaagcuugaaaacaaaagaauuaguuuuuauccccaggaaaaccuaccgucuucaccauaaagguuucuaaaugucuaagcuaccuacaacugaaucauaacauuuuguagucuaaaguugaugguacccucagaauugaauuaauucuguaauucuuucaauuuuuaaaaugucaggcaauucuuccucauugaauucaggaaauuaguuaaucaucugccuuaaaagaacuaacuuguuugaauguugaacugguggcucauugaugguuucugagauguacuauuuaaauaaguaugugcauguuauaaaauauauuuggcuaugccuaguguugcuaaauuuuaaauguucuuuuaaauguaacauuauaagaaccaauuaaugaugaaggaauuacacagaauaacaaaaugcuugcaaaugagaccaagcaauuugcuuaguuauacuaaguaaacagaguaaguucuagaaauggucaauauugcuuuugaucaaacugauauacucagagugauuaaugccugaaagaugggaaaaagauaagaaaaaaaagacucuucaaagaaaaguaauuuuuccgugaaauaauuauagaauauggagcauauuuaaauauacuuauggaccauaugcauguauacauguauagagauuguuuaugcacaaauaucaucaguagaaaauuugacggcuauuguggaccguagguaaacaaugagauggcaauguaguguugcucuuacaaagcaaauuuacugcugccauuacaguaauaggaauauaaucuauaaaggccagggcaaaguacuguuauauacauagcaauuauuaggauguaauuaauauaaaacauaaagcuuagauuuuuguauuucaaaaaggauguugauaaauuugaagacuccagagaaggauuuuuuaaaaucaguaguuuggaaauggaguuuuugaguaaagucucauggucacaaaacaguauaagucaugugcagcccauagaucuguuuuuguuugacaccuguaguguuaguccacaauuuauuuauaauuaacugucaguuaauuucauauaaaaguacagauuuuagacuucucuugaaaaaucugcaaauauggcaaucgugggcacguucuucuaucaacuagagcugaguaccuacugcccucuguugacaggcuuugaacucuucaguuucccugacccaguugaccucagucuuuuauauuuuugccugaagacuuuugaggaguuuauaaccuuguguuuggaaagacuguguuuggagucacguuaccugaauuccaauuucuauucugccacuaacuaugaccuugaauaaauaauaauuguaaaaucuuaaaaguaggaauuggccaggcgcgguggcucaugcccguaaucccagcacuuugggaggccaaggugggcggaucacgaggucagaagauugagaccauccuagcuaacacggcgaaacccugucucuauuaaaacuacagaaaauuagccaggcguuguggcacacgccuauagucccagcuacucgggaggcugaggcaggagaaucacuugaacccaggaggcagagguugcagugagccaagaucgcgcuacuguacuccagccagggcgacagagcaagacuccaucucaaaaaaaaaaaaaaagauagaaaggaauuuaaagaucaucugguucaacucccaccuaaugcaggacuccucuccacuaaauuuccaaaagaugguuaagccagcuagccugucugaagauuucuguuuacuucacaaaauagccuauucuguuucagaaagugcuaauuauuagaaauuucuccuaccuguuaaaucuaugucugcuuaccuauaacucacucucguuuuaguucugacucuuaaaacuaugaagaaaaguuguaucuccucccuuccaggugucaaccguucuguuauuugaagacaguagacauuuucuuccuaagucuucuccagacuaguuucaccaaccuaguggcucauuacugaaucaaugucccuuuuuaaacauguaacacuaaaaauguacauuauauaagaugucuuaucacugguagggaacagaguagagcuguaacuuaauagaugugacaucaaaggcaaggugucugccuuuacuguuccucuuaaaguguagcuuauuuguaaaaugugcuaggccaucaauaagugaaugguuuuauagcaaaucacuguauagauguagauauuauauuagcccaauauuagccagacaaguuauagaguuucuuuguagacuuagugcccagucuuuauuguagcauuguuuuaaauauuugccaucccuuuuuuuaaaaagguaaagaaaaagcaggaaaaaaggcuuagacacaucuuguauucuuguugguaucauggcauuugucaguguguucauacuuuuuaauuuucuaguacuugccgacuuaaucccaugagcuuacuucuaauaucaguaaaggguaugagcugucuaugugguucaagcugccacuugaggguuucuccauuuuguggagcuuucuaauggaauucaagguucucucuaaggaugagcauuacaaagccuucccuggcugcugugggaggaggaagugcaccauagguucaaggacacaugugaaguuuaaugugcacaagcaugcucccgcuccugcuccugcuccugcuccugcuccugcuuacucugauuggcaagguuaacucugagaagcugcugcuuuuuuaagugauuugauuagacccaucacuucauuccuuucaguccucccucccaaggaccaaaccaccacugucuuugcagucuuugcuuugcccguuacauuuucucuccuuuuuuccugcuuuuucaucaacuuuuaacauuucguaaaacaaaauaaggaacucaaaaguaaacuaacuugccucacugaaagcuuugacaugaaaaauuuccauacuuuuguuuucuacacuuguaaauuacaaaacuuuuauuucauuuucacuuagcucauaaggaaaaauagaauuauuauucacauuaguucacuuagauaauuccacaguccucuaucaaaauuuauuuuguacauaaugaauucuuuccucacaaucguuuuaaaaauaaccuuuuaauuacaaaaacuucaacgagguacaaaaauaaagagaauaucuaguuucagcaauuaccaauuuguggccaauccuguuuaaucuguacugcuaucucacaacaguggucuuuaaccauuuuaggaagaauaugaggaaaguuaugaacaccagagaaaaaggaccuacauguuaaauuuuugcaaaauauguuaauaaguuaauacauuugccagagcccgcccuuggcuauccuaggaaugcaagaauucagagugagaaucccugcaucccagcaaagagaauauuaaaguuucucaacuucucuagucaccugaguguugggauuugggauuagcauagguucuaugccaacagugaugaaguuaagccaauggcaggcucuuuguaaugauuaaauauucauuacauaaucgcuuuucuaaauauacuuccuuccauguuuagcuucuuuucccuuugguugcuuauuaguuugucuuuuuaaaauuaguaguauuuuuaccaguguugauagauuuggugacuuugaaccaucucaacuuuuaaggccuaacaacucagaauuuuaucuggagcuucugaguugucauugccaacagcuaagaaagaaaaacuacaucucucuauguaugaaggauagaaugauuaauagugaaugcauuaggaacuuaaguaguaaagcugggguuuccauaaaagaacauacuagcacuugaauaugaauucuaauuauuaaagcauauuuauuuaagguauagggauagcugauuguuacaugacaaaacagucaucuuuuuuuucccauccuguuucaccuucuuuugucaguuggcauuuggucucccucuggagcagcuguggucauaggguggacucaaaacauagcaguuaguaaaguggcacuagcagccugaggauuucccuguagaacuaugucauuguugaaucucauaccaucuggcccuguugugagcuaaaaguacuuuuuaaaugcacguaauaaaagaauaguugauauaacuuaauuauucauuauuccauuugaaaauacuaaguauuuugcccuuagcacaguuucuuuugucccucucucccucucuuucucuucauuugguguggggagcuagggaauggauaauguacauuucucucauuuuaguaugauuaaagauauuucuauuaaggugaugauucaggagaggaaccaccuucauuuauagauagucacgugucuaucucagaauagauucucauuuuuuaaaaguucccuauuguguucccucuauaacauuuugugguuggcaguacuuuuaauauuuuauugaauggggguggggggaaucaacagcaacaauauaaaaccuagaauguucaauaaauacagcaaaauaaauauauguucagagaaaguaaguguaaaccaccucuuuauuauguuucuaaggauguauguaauccauauaacauauaaauaacccugguuuuauugauugauguuucugugguauuuugaaaguuguaaaaugugggguuuuaccccauuauaggcauuuaucugcauggcuugggaauacaguaucuguuuuugcuagauacugucucuauuggaaggccauugaaugccuaaucucugugcucuccuuugaggguuggcuuucuucaagaccaaaucccguaagaaauuauucaagaagcucaacagagaagcaucacuuauagaauuacuaaucauuacuuuuaauacauuuuaaaacauuuucuuuuaaaaaagugucuauaaaauuuguuugaaauauuuuacagauuccauuauguguuuacagauuuuacagauacuuuacagauucuauuauuuguuuguuauuuggacugaggucuaguucucugcucuuuaagguagcgcccugacauccucucaauauaaagaagccuaagcauaucuaagcaccuguuuaaaaaaaaaaaaaaaaggaaaaaaaaaguugcuuguaacaaaaacuauccccaccuacaauuuauuaaaccuugacauacugcauuacuuaagaguucucagagaaaauuaaaacccuuuugacugggcuuugcaaagcagggaaauuuuuagugacauuuaaaagguuucucuuguguuccucuaaugggauaaauaaaaaaggcuuguuuuagcccagcaaauggggggacaauccaauuuccuugauuccaucaagacacucuuaaagcauuagccugugcaguaaaaaaaauucaacugaccccccuuugcgugauggcuuugaaaaguguccugauguguagguauuugcccaacacagcauacuugguuauuacucuuccaacacauccguugauggaaaaaccuuaugugaagcuccaauaaaugucaguuuauguuauagaacuauaaaaacaguguaccagacuauaaugcucuccuuaauggguagccuuucacuugaagaugaaaagaaauucugccaaguauguuuaaauuuuaaaauuaaggaauaagauaauauuauuuaaaauaauauuuuaauaauuuuuuugucacauuuaauuacuucacaaagguugacuucuguuuguccaaaagauagugcuccuuuacagagaauuuacuagcauagggcagugguucucgaauguuagauuccauuagaauuacauagagcuuguuaaaacaaauugcugggccccaccccagaguuugugauucauuaggucucugguggagccugagaauuuccauuuuuaacaaguucccaggugaaauugauacugcugaucugggacccacaguuggagaaccacuggccaagggcaugugugaaaagagauaccucuggauuagugguucauauuuugaaucaaaucaguuaguucugaaagucauuaacaucugagagcauccuaauaggugaaaaaugugcugauggauaccaauacagucuugaguggaugggcauuuuuuggacguuugucuccuuaauuggcaguuuuuaaaacccagucugaaggggggaaauaacaugaagauagaacuuucauuuuagagaaggugcagaagagaaaacuuaggucccuguguguucuuuaaagaauagaaacugaauguguuuucuauaaccaauugcauaauaaagcuguuguuuauauccuauuaaaaaaguucuuuuuaucaaaacuucugccuuuaucuauguaaaaacccaaaguaccuuguuauucaauaaaaaauuaaaaaguaaguuugauauucugauuuuuuaaaauuauuuuugcauaguaaauaauaauguuaucuggaauaucucacuuucuaugucuguaauauuuuacuuaaaaauacuuagaauugacauaauggucuucucuagagucuagaguuacaugccauuuauucaucuguucuuaaaaugcacuuuggaaauaaauaggagacaaaaaaaacaccauuauuugacaagaagaaauucuaagagagggauuuguugacuuaucuaaaagucauaacagcaaagcaagaauaaaagaggcuuaggaccccacugaaagaagguagugcagcaaccagucucauuuucuucugguggaaaaauacauaugaugaugaguacauguauaucuucuaaaugucuaaaugcuugguaguaauucauaauuuucuuuuguuuaacacuuuucuuccaucaauccaaguaaauuccauccuaacaaauccuuuucauaaaauaauacaggcaucuuauauuugcgugacacuuuauauuuuuacaggggguuuuagauacauugauuucaugucauccucaaagcuauuuuuuuaaugguuuccuucuaaaguccuggaaauacuguauaauagcgauagaggggggccaaaaaaaauccaucucacucaguauuauaaauauuuuuguuuuauuuauuggcacugucaccuuuuaaaaaauauacguugaauuuguggcuagcuuucaaguaaaauaaauguuauuuuaaaagaguuaucagucgcuuugugcuuccuuugggauuaaggguacuaucugcauuacuuaaaacucaguuugaaaauaauuaaaggugacuuugaaauugccguggguuaaaugaaugaaaucagguaaucagcacuuuucuggagccguucugcauuucccuagaguccuuggagcccuguauuuugugauucccuuccagcaccaccuuucuucuuuuuuuuauccucagcaaaggauagguaaaucaagucaaaugauaauuuuccacauuguacugguauuauuaagcuaaaguuuacuucuggugcaguaaguacugaagauggaguccagagaagacugcauagaggaggucagugcagaagugguagcaguuaaucucuccacugcucugauauccgacagcuggucugacaugggccuggugccagcagugucuuuacaggcuuuguggcagagauuauucaaaggagauuaaucccucuaaaccccuuauauuuuaauuauuucuguauguauuuauaaaaccugcagucugcuaguuucaggacacaacuguucaagcccucaucuuuaaccugguuuccauaaucagacaaaauauauuucuuuuaccacaaagaguacaucauugauuugauuuuguuauuaaaauuguuuuucuuuugggguuuuuuuugggguuucuguaugauauugcuaauguuacuuuuuuuuuuaaggauaaccaaaguuaauaugacuuauuuuagaauacaugcuaaaaugcugugagguuuuuuuuuuuuguuguuguuguuguuguuuuugagacggagucuugcucuguugcccaggcugaagugcaauggcacaaucucggcucaccgcaacccccgccuccuggguucaagcaauucuccugccucagccaacugaguagcugggauuacaggcaugcgccaccaugcccagcuaauguuuguauuuuuaguagagacaggguuucaccauguugaucaggcuggucuugaacuccugaccucaugauccgcccaccucggccucccaaagugcugggauuacaggcgugagccaccgcacucggcccuaaagugcuguuuuuguauuacaugauagaagucuaaaguugcagacauguagaaugugaaaaccucuuuguuaaaaacaacaugacuuucaaggaauuuuucuuuuuaauggcuaccauacuuuccagcauuguuaggcaacuuuaucccugaccaaaguauccagaacaaugauuucuguaugcccaauuuauguuauugagggcuauaaaauuuuaccccaaauucaagaguuaacacaauaugaacgaccaaagaauuacaagagcuuaugaaauaagcucugcuggcaagagcaucaagucucuagcaccaugaaagucuugccaagucuuucaccuguagggaagcaguucugcuucuucaugcacacuguugcuccuucuuucauauacugagaagaggaagacuuugaggaucaucuuccugaaggucuuccagcuucuagggaaccucuacugagaccugucuugaugugugcuggugauagaauguguuugugauauuuguaucuucaaaacacuuguuuuagaucauuuaaucuuaguauaaaguuaccuuuuuugauuauugaggcuguccuuucuucucuuaguuggauuucuucaugcuuaucugaaugaaugucagcagcauauuuggggcagggaugcagagggaucuuggcuagccagaauauuaguagcuuguguuuuauuauccaaauugaacaauaacuuuugcuugugcucuaaaaaugggaauuagacauuaauaucucaagacuuaccguuucuuuacuuauuccauuuguaucgaggaacauaaauuuaagcccuaacucugcuguuuggcaugcuaucauuugggggcaggucauuuaaucuuguugaacuugaguuuccuuauccacgaaauauagcuacuauuaccuaccuuacuuauuucaggauguuaguuucaaauaaguuggcacauauaaaguguuguguaaaaagauauauaaauauguuuuaauuuucuuaaagaacagcaugucugaaucaagaaagaucuguggaaagcucaguagugucauuaaaaaucuuuuaugcugucgauaucuugugaauuauuuuuuaaauugguguuaguugagcuuuuuccuugucucuuuccaaauaauguaaucuucucuuccugucagucauuguuaguuuucaaaagugucuuuuacuguaaugguuaugauagaaguguaaccauaaggaauuagauuauaauauauaauaucauaauaccaaauauaaacaaucuuuguuuuuuuuuuucuuuugagacaaggucuggcucuguugcccaggcuggagugcaaguggcucaaucuuagcucauugcaaccuccgccgcccaugcucaagccauccucccaccucagccucccaaguagcugagacuacaggcacacaccaccacaaccuggcuaauuuuuguauuuuuuuuguagaaaugggguuucgccauacugcccagguuggucuugaacuuacgaacucaagcaguccaccugccgcggccucccaaagugcugggauuacaggcggaaaccagcacgcccagccaacaaucuauuuucauuauacgauauauuaucauauuugaacugaucuaaacuuccuguauauacgauguuaauuuaaaaaauaauaacaauaggccgggugcagugguucacaccuguaaucccagcacuuugggaggcugaggcagguggauagcuagagcccagauguucaagaccagucugggcgacacgguaaaaccccaucucuacaaaaaguacaaaaaauagcugggcaugguggcacacaccuguaguuucagcuacuuggaaggcugagguggcaggaucaccugaguccagggaggucaaggcugcagugagucgugaucaugccacugcacuccagccugggugacagaguaagacccugucuuaaaaauuguaacaauaggccaggcacgguggcucacgccuguaaucccagcacuuugggaggccgaggcacauggaucaccugaggucaggaguucaagaccagccugaccaauauggugaaaccccguuucuacuaaaaauacaaaaaaaaaauuagccgggcgugguggcgugugccuguagucccagcuacucgggaggcugagacaggagaauugcuugaacccgggaggcagagguuguagugagccgagaucacgccacugcacaccagccugggcaacagagcaagacuccgucucaaaaaaaaaaaaauuauagcaauaugacagauucuguucaaagcuagggaaaucuguaguuagaaauucuuguaugacuugaagacaguuggaauaagcuucaaaguuuuaaacagaguaguggcaugcauaagacaaugcuugcaaaagggaugggagacuacauaaauuauuaaggaagcucuuguaggaguuaguggauuaggaagugagggccuggauagaguucauuacuguggaaaaagaaagaaccagagauauauauaguacagaaggagaauucaaucaaccucacuugaugaaagauaauauaaaaaauaaaagagaaguugaacaugacuucaaagcuaugggcaaaaaaauaaugagcucugguuuugacauggcuaauuuuagugagcuauuaugacauccuugcugaaauguccuaaagaaaaagaaaagucaguacaggacaugcacuuaaagauguuuucccaaaagaaugguaacauacucaaagagaagaaugaaucuuaagauuagaauacuguaaaaccuccauauacguaugaagauacacagagaaacccaugaaaucccagucauaguuaagagcauaagguugggagccagagaccuucuaaguucugacucugccacuuacaaaucaugugaccuuggacaaguuacuuaaccuaagcguuaguuucuucauuugugaaaugagauaacuuaguaccuauuucauaaggugguuggaugagauuaauaaaagaacucauguaaaaauugccuagugcgguaaacagcauuagccacuaccaucauuguuuuuacucacaauugacauaaaucuuuuuuguuguuguuacauugacaguauacagcaugcagaaagguauacaaaauaagguauuauuaaagccaccuggaauacugcaucuuugugugcuuuacuauucagagacaauguugcguaugucuuuauuauagaauucuaauucauaagugacuuggaggacguguuuuauucuuauuuuuuaaaaacuauaucagaaauaagaccuucuuauuugguucuuaguugcacagucauacacaaaaguuguuaaauuacagaagggcugguagauagaggugcagcaggggaauaaaacuaaagcuaacauuuauugagaaucuauucccuuuaauacagucauucauucuccuuaaaaccagucacuuauacuagaaaaaauagcucaaaauaguuuuaucuuugaaugcauggguuuuguuacuuuucuuucaucggcaguccuacuuuaucggggcccuaaauaaaacagcuuauuuaacuuuuuuuuaggagacccaggaaagaauuuaggcggcaagacuaauguguacaguaaaaauugaaauaaaaaucuuuucauguuuuuaaacauuuuuuaaaauuaccauauccccuaguccauggcaaguguuuaaaaaaaaauaccauaaagggggaugaaagcuuguggguggugaugaaaccacauuugauaauauuuauaggcaaauaguuaugaauaaauuacaguacucaaaacugacauuguagcuucaggguaaauagaggguuaaaucucugagcuguagaagcagauuguguuuuccuuuugugaucugggcugacaagacaucaguauucuauucaucuguugggaauuaggcuguuaauccaaucaaugacucuugagugagcuguggccuaccucccccacuggggaacaaucggaucaaacugcagauuguuuaagagcacagugcuguccucaugucagguggaauuuucaaauguucccuggugaauuggggauagggaaagcugucuuggcccauuuauccugcuccuuaaauaaccagguaucugccucauccauacgaaagcauuugguaguagugacaacaggaaugcaauagaaauccauuaacuuuagcucacaaaaguguggaugaaagggaggaaauguuuucaaacacucacaaaauuaucuauauuaaaauguuuuugcuuuauuaauauuuuuucuuuuccuuaaaccuuaaaucauuuucuuugcugggcuuuuuuuuuuuuuuuuuuuugugguuguuaacuguuuuaugucauugaauuuuuuuaaccaccacaagcucuuuuuguaucuuuacccugcccugcauauauuuuuguaagucagcaggauacaaauaaauuuuuaauauagauuaugggaacacuaauuaaauaaaauuuuaauuuuaaaauauauuucuccgaggaaugcuaauuaaauacaauuuuaauuuuaaaauaucuuagucugagcauacauaauucugacaucuuuugcagccuagcaaaauuugauuucuaauuacugauuuaauaggccauuaaguacauuuggaaauuauuauugaacugauuggauagauguucagaguugcaguugucuucuaugaaaugcugcccaaauuuuuucuguuaaccaguaaggugacaugggcuaucacagaguaaaacaucuaaaaugacaaaaagaaauucucaagaaguauuuacuaaccaaucucagugaagaaaagcuuaaagaauaauuuuauuauuuucuaucuacauuacauaagaauauuccaaaaagaauuuccuaagucagccaaauuuauccauucauucuguggauauuuagugucuaccuuuuauguaccccauaccucuucuaggcauuagaauuauaguaaacaagacaagauucacguucuuuuggagcauacauucuaaugaagaaaauaugcuaaaaacaaacaagauaauaucaguuaaguucuaagaaauaaaauaguggugguuacuuuaaacagugaucagguaagacuuuacugagaaagugacaagcugagaauucaaugaagagaaguugcuauaagucguaauaaaaaggucccugaaguaggaaugagcuugacauaccacgaacaagcuacuuacagguacacuauucucugggacaguaaguuucagaccugguaaaguauugaauuuucuugggaacuuuguaaaaauaaagguaucugagccuucaucccuagauaugcugauucagcagggcugaaugggauguacucuguguauaaagugcagugaacaguauugaaagucuuaucucuaguuaauguaguuucuuuccuugaacauaucacacacuuguuccaucugugccuuugcucauguuuguucuuuaccuguauuguuuacccuuacugucucucacaugcuuccauccacacugucucaaaugccaucugcuuuuuaaggcccccucucaguaggaagcagaauaauacuuguauucuuccaaaaaauguugaacccaaaucuaacaaaaccuauaaaaaauauggcugggugcggaggcucacaccuguaaucccagcuuuucggaggcugaggcgaguggaucaccuuaggucaggaguaagagaccaaucuggccaacguggugaaaaccuccugauccucaggagccuaaggcaggaagaucacuugagccuaggaguuugaggccagccuggacaacauagcaagaccucaucucuaaaauaauaauaauaauauuaacaauaaagcauucauuuauucauccauucacauuguugugcaaucauuaccaucgucuaucuccagaacuuuuuuaucuucccaaacugaaagucugugcucauuaaacaauaaaugcccguuauccccaccccgccuccuggccaccauaauucuacuuucugucucucugaauuugacuacauguaccucauguaaauggaauuguagcauauuuguccuuuugugucuggcuuauuuuauuuagcauaaugucuucaagguuuauguuguagcaugugucagaauugcauuccuuuuugaggccaaauaauacucacuuuguauguauauaccauauuuuguuuauccuuucaucugcugauggauaugcauauuguucccaccuuuugguuauuguauaugaugccacugugaacauggauauaaaaauaccuguucaagucccugcuuucaauucuggaaaguggaauuacuggaucauucucuguuuaauuuguugaggaauugccaagccauuuucacagcaggugcaccauuuuacauucucauuagcaauacuugaagguuccacuuuccccaaauccuagccaacacuugucauuuucuguguuuuugauacuagccaucuuaauagagaugugaagugguaucucaaugcccuaucaaaaaaaaaaaaaaaaaaaacguaauaucgggccaggcacagugacucacaccuguaauuccagcauuuugggaggcugagguggguggaucacaaggucagaucgagaccaucauggcuaacacagugaaacccugucucuacuaaaaaauacaaaaaauuagccaggcaugguggcacgcaccuguagucccagcuagucgggaggccgaggcaggagaauugcuugaacccaggaggcagagguugcagugagccgggauugugccauuguacuccagccugggugacagagcaagacugucucaaaaaaaaaaaaaaacguaauaucuggcagguaacugacagcacccagauuaaagggauaccugaaaaguaauauaagcuauagaaugacauaaagaugucuagauugagaauaaaccuauauauuuuuaucaguuuucuauggaaauagauaucugcaauucaccuauauuauauuucauaggauuauuuauuaugguuaagaguaguuacuagaaauucugcauacagauuaccauaagaauaaaaucagcaauauaaacauaggaaaaguaacagcccugaaauuauuaaauuuaacucaaauauuuuauuaaauacuuacuccaugaccuggaugcaacaagacauuaggagacacaagagguacaaacugugguuccugcccugacaucgcuuacuaucugagacaguagaaaacucguuaaauuauuaaagaacaauuaugagccagacuauaaccaaaucccauaaugagagaucaucugcaagugcauuggaagagguaauaggaaaaaaagggagagauuacuagggagcaccguaguuggagacaucuucaguuaugaauuguggccuaucuuguacuguaaaggcuaggugauauuugaaggaugcugagguguggaaagggauagguagcagaaacagcucgggcagacuauggaagccauaaauacucagaguaaggaauuugggugaguguggguguguuuuaaaugaggacuauaaggaauuuuuuagagugauuaguaacaguguacuguuacuagggagaaagggaauaggaaggaauaccagugaagauacccuuguauuaauuuugguuauugauguugaauugaccaaggauuuguguuucgguaacaacaauagaaaauauagaucgauuucucaaauaccugaacuagggucucuuaacacauugagugaaaugcugggaagaaaucagaauuaggagucggccaggcaugguggcucacaccuguaauccaagcacuuuggguggccaagguggaagaaucgcuugagcuuagaaguuggagaccagccugagcaacauagugagaccuuaucuuuucuauuaauacaaguaaaaaauauuuagccaggcauaauggccugcauuuauagucccagcuacuuuggaggcugaggcagggagaucgcuugagcccaggagaucgaggcugcagugagcuaugaucgcaccacuguacuccagccugggcgacagagcaagacucugcucaaaaaaaaaaaaaaaaaaaaagggucacuggagaggacugaaacaccuuuaguuguacuauuauuguguagccugguugauuacaucaaaauuaugcaguuguuaggaggaggaaauuagaauacaaauagaaaaaaaaauauuuacgugauuuuaugguagcuuaaagguuucaagacuugagaaaaaaaucaguuuuacagugacauuuagaggaaaaaccaaagaggauuugaaacauuaauaaaaacucuaugcaggauagaaagagaagcuaacaagaauaggaagugauuuauuucaggauaaaacaauauuaaagagaaaggcccacuaauaaacaaggucauacgacucuaacaaagcccaucuuuaauggaaaaauuaaauccauuuuuaaaagcuaacuuuagugguugcuuuggcaacacauaaaauuuauuauacuaaaaaaaauuuuauuuauuuuuuuauacuaaagaaauuaaaaggcugggcacgguggcucacgccuguaaucccagcauuuugggaggccgaggcaggcggaucacgaggucaggagauugagaccauccuggcuaacacggugaaaccccaucucuacuaaaaauacaaaaaauuagccaggcgugguggcgggugccuguagucccagcuacuccggaggcugaggcaggagaauggcgugaaccugggaggcggagcuugcagugagccgagaucgcccgcgagccagccugggcgacagagcgagacguuuccaaaaaaaaaaaagaaauuaaaauuuuuuauuuauauuuuuuauuauacuaaaaaaauggaacgauacagagaagauuagcauggccccugacaugcaaguucgugaagcguucuauuuuuuuauaaguaaauaaaagcugacuuuauaagaaaaauuaaguuaaauaaaggauacaaaguuauauuaaacaagugauacugcucucgcaacauccuaaaauggguuaaaaaaaacucaggaaaaaauugccccuucgccuauaaaugcugugaauaacauuuuuagugaaaaggguaauauucuguuauauuuuugauuccuaaugauauuuuguccuauuaaccugagagaaaaaaauuauaagagcaaaaagaaagcuuauucagauuuuauuuguugauauguugccuaauaaguuugucauaaguucuuaguaaaagcaguugaauaaguagaaaauaaagguuuagaaggcuauggaauauagcagacaagaaauaaggaacauuuguauaucaaaaaaaugaauuagacuguuuaaaaauugauagcuguuuggacuggauuuuuaauuaauggaggggcaggcuuacaauuuacuucuccauucuaucuaaagcuauccuuauucagacacuucagcauucauacuaacaccuaccaauccuuggucugugaaaaccccucaacccuggcuacauucauuuauacuccauuuuaacuuacuugaacacuuaacaucuuugagcuugcuuccugucacaaccucaaauucugaaacuucucuagaucuuaauacucuuaauagcucccauuuccucaguucuccugauccuacacuucuuccugccucaacaugccuucuaacucagccugaaccccaggacugaucauuuccguucauuuuuuggaccaaaagugguagugccaagacugaaacucacaguccagagcucuugucgcuucucuauguugauuuauuugcuacaaaaagacauacuucuuucucccacagauagccgcugcuacuuucauugccaucaagguuuuauuuuuaauuugcccaaaaggagcauuaaaaggcaauuagaucguaggauauuaauauucucauuuuuucuuucauuauauuuuucuuuugugcauuuauucauucaacaaauacuuauuggcugccuacaguacacuaggcacugcaaauauuuaugcuguaaauagaaguaccucuuuauacacauacaguauuuaaagauggaaaugccuaagagagagacaagauuauuaaucaggccaucuagaaaugcuuagaaucucuuuuuuuuuuuugagacggggucucgcugugucacccaguggcgcaaucucggcucaccgcaagcuccgccucccagguucacgccauucuccugccucagccucccgaguagcuacaggcgcccgccaccacgcccggcuaauuuuuuguauuuuuaguagagaugggguuucaccguguuagccaggauggucuugaucucuugaccucgugauccacccgccucagccucccaaacugcugggauuacagacgugagccaccgcacccggccuagaaccucuuuauaugugucugcuuaucagucgugcaucuaagcuugaaaauuuucaaggauagggaauugaaggaacauuaagguagccguuuuaaguuugaaaagaucuuucuaccagcugggccaacauggugaaacccuguuucuacuaaauuagcuggccaugauggcaggcagcuuuaauccuugcuacucgggaggcugagguaggagaauugcuucaacccccgggagggggaggcugcagugagccaagaucacgccacuuuacuccagccuagccgacaaagcaugacucugucucaaaaaaaaaaaaaaaaaaaaaacuuucuguugaaaaauuaaguguuugacucccuauaauuuucucauacucuuccuacuucuaaaauguguagccguauagaagcaaacaguuuuauuguuuucagauauuucgucuuucguuccuaacaugacaugauuucaaguuacuuuaccauccagccaaagccuauuucaggcucuuuauguauaucuuucaagguacuuuucacccacagcucuuuacuacuaacacugcaggaauuaucugacccuagaaaagaauagcucuguauuaguuuggguuuggauuuuuuucguuuuucauuauuuuuguuuuguuuuguuuuguuuuguuuuuuguaauugagacaaggucucacucugucacccgggguggagugcaguggcauggucacagcucacugcagccucgaccuccuagccucaagcaauccucccaccucagccuuccagguagcugggacuacaggugcacaccacuaugccuggcuaauuuuuguauuuuuuguagauggggucuugccauguugcccaagcucaagugauucuccugcccuggccucccaaaguauugggauuacaggcaugagcuaccaugcccagccuguaucaguuuucuauugcugcauaauaaauuaccacaaauuuagcaacuuaacacacuuuuguuuucucacagucuccaugggucaagcauuauggcauggcuuaucugguuccucugcucaaggcuucauaagucuucauucucaucuagaguuugcaguccucuuaguuacuugaggcccucauuccuagacaccaucccucuccuuaggcaguucacaaaauggucaacauggcuauuuguuucuuugaggccagcucucuccauuccaucucugcccuccaucaugaaagugguuucccaucacauucacuggugccaccgucacucaaggcaagggaauuauacaagggccugggucauuggggcuuacuuuggauuucugccuaccacaagcacuaucacuuuccucauucuaauaguauguaccuauuaauauauuucuaaaauuuaauuugcuuuugaguagcuacaucaaaauucacugagcucacacucuacuaaagccccuaaaucuucuauuuauguuucuccuaagauuacuccacgauguaguuugugacuacuugguccuugguacgggaucuuuucucuaugucuguuaaauuccaucuuguuagaucuaaccgaucuagccugucagcacuugcuaccuauaucccucauccaguaugcuuaccauaucucucaagcugaaugggauuucuaaaauuuuagcuucagaauuucagaucuccagcacuugcugcugguuuucagggagcugcuacaggcuagggagcugcuacaggcuagguuuugcuacauuguaaaacaauguaacuuuaaaauuucaagguuuuaaaaauuuucauuacaaagauagcacuuguucauaauagaaauaucagaauauacggaaaaguuaaaaaaaacauauagacauacuguuuacauugugguagguuuuuaaaacauuuuuaaauauacagugcuuuuugguuuaauugcuugcuuuauauaguuuagaucuuaguauaaaaacauuuuuuauaauuccauuuuacauuaauaauauuguaaugauguucuaaguuauaaauguuuuaugaccaucauuugaaauugcugcguaauaaucgacucaacuuucccuguguuguuggacacuuagauuguuucuaauuccuugcuauucuggauaauacuggaauaaacuuuuuuauaagguuuuuuuaaauauuugaaguauuuuuaggauaccuuucuagaaaugcuaagugaaaggaaaugauuuuauuuuuucuaaaagauuuauaaaucuuuucauuuucuaaaugauuuauacuaauguaugcuccuaacaacuaaugaaagugccuauuucauagcaccuucuguagaggaggaacuguuuugugggccuaacagacuauguaaauuuucacuguaaaagugaaagaugaaugagaauaugaaugaaaauaauuauuuccuggauuucucuuuuuuacuucuggucauucaccaucaagggauuuagaauagaguggauuaagguauauugaguuuuuacugaauaguguuauagaaacaguaugcaauaagcaagacacccuucaaagaguuuggcuuuguucuuauuuaccuaacuuugaaugcuagaccagcucgguaaauuaauacaaauauagagacuaagcuccagcuucucaaaauauguauaacuugaaaaaguauagcaaucaacugaugcagagguaaagaagaguguauaguguugaagaguaagauuauucacucucugaugauaugucaguuuugagauuuugguaauaggaauuacacaagcaugcuguaugugauaccauaacuuaggccaccuauugucuuuaaccugaaaaaaauaaaaaauuuuaacugcauuucuuuuuauuuguauuaucuguguugauucuccuuucucuuuucuaguagcagaguugagaaaauacggauuguguuguuagaagggccugggaccuuaggcaaguuauauaaugucucugagcaucauuuuacucauuuugaaaaugggaauaauaguguuuacauaauaggguuguugugagaaugaaaagaaaugauguuuguaaaauuuccagcacacaauggguauucggucaauguuugcuccuuuuucuuuacugcagugaagucucaacucuguagcacuggaagguuaaacauucuagauaaguguucuuuucaguuagcugaacaguuacauucugccuuuuauuuuuuaacuguuuuucuacaaaauacuuuuuuaaaaauauauuccauacuucauuacuuccuucuuaaaucauuuuacuauaccauggguguuuauagcuggugugagacauaaggcugaagcuucucuuucucucuugcaauugcuaaaaccuacugguuggcaugcagcccaguccucuuuauggcuggcuauucucuguggucuaaaaugucuacaaguugccaccugugucauagcuucuaauuucugcugccugcuacuguugcuaccccauuccuucuaauuaccauuaggcucugcuggccucuuacccauuuaugcucuuuauucuuugcuguuuuuuaacuguucagucucuuuuuccucuguugcaucucauauuucauagucaaagacaggccuuucauugcuuucucagaccagcuagaauucuucuucuauacagagccaacuggucacaaugugucuaauaugguccucaucagcacuuuuucccuacucugggcccuauuccagguacuugaaaaugccaaaaaucaagaaagccaacuauauuuacuuuucuugcaaguaguuuauuuucuuuugagauagggugucuuucugucacccaggccggucucaaacuccugggcucaagcgauucaccugccucggccacccaaagugcuggauuacaggcgugaaccaccacaccuggccuguuuguuuuuguuuuguuuuguuuuuaugcuuacuuuuacuauaugcaaaguuuugugcagauacaaaggauaaaagaaaucguagucuauaaaguuaaauuauaccaugauccuuaccuucaaaggagcagaagaacacaaacauaauacaguuaaaagaugaaggaggucgugggagacaguuuuaaguaaggauugugaaggaugaagguucugcuuaaacuuauaaagaggaguagcuguuuuugaauccagucucaaaguauugggugauaguuuagaauccuauaagucagaacagagaaaaacaggccaaauggaagggagcuuccaugauucucuaccauuuuaaagguaugguaaagaaucauuuaggaggauuauggguacuucuugccuuuccuuguuugagaaucugagucuuuaaacuuuguauauuauuuuaucauuuauguauauugcuuauagguuuuuaauauuuauuuggaaacaggauauggagguggaauaaacucuuuuuuuauaagauuuuuuaaauauuugaaguauuuagguuauguguuuuuaugcuuucauagcuucaauuuuaagcaugcuugaauuuuuuuacauuuuaacucuauuauguaauuuuguuuauuuuuaauucaguuggguauuuuuauuuuacccuaauguuucaucuauuuaaaagauuucaaacauauaaccuauuuuaauucauuagaauaguuucugcugcuguuuauaacaacuucauauugauuaaauuugaacauuuccuuuaagauaaacagaagggaaaaacauaaauaaucaugacaaacaaccuuuucugguguggucauuugaaaugaaacaacaaaaaaaauucaaucaauuuaaaucuagaaaaauuagcugauauaaguuguaaaccagaugaguaaaagcuuucacuuauucauucuugacauucaauuccauuuauucuuuguaauauauuuuaaaacagaaugucugcaaagacuaagguuuagguuccuauauucuauucugagauuauugagaaaaaauguuugggcuuauacucaugcuuuaauaucaauuccauuuuaacacacaaagaagacuaauagaauaaagauuuuauagagacauagugaugugguuuauuaaggcaucauaauuauaauaguaaguguauuauaguagacuuaagauaauuauuaauaauaauuuaaagcugaacagacuuuauauuagugagucauaaucauuccaaauaauuauguucaugauugaauauuucuuaagugccuauuguaugcuaggcauacaaaaaaugaguaagagaagaacaacuuacauuugggucccuaaacacuacaauuggauuagauaauaauuuaagauaauugucuuuucuuuguuucacucaaauaccuauccuuuaucaaagugcuuagacgcauacaaacaauucagaguugaaaaaucuugauaucuuuuuuaaagacugauccuuuucucuacuacucuuggaaggcagaauagauaaucuaauuagaggacagucugguuggccuccugucuuucuauuccccacuugccagucaauucuguaauuggagucaugguucuuauguucauguccuugcucuaauugauuucuagguagacauucccuaaauugaaagaucaaaaaucucaacauuucacauuaaacaguagaacacuucagcccacagcaucugaacacaaaagcuccaaauuaggcauggugaucugaggaacacagcaaacaagaaauggauugggaagugguagguaagccuaucaugcuuguaauuguaaagagcuacuuauaaguaaccaugauuuuagucgguuugaugaguuuuuccuuggaacagcuaaguaauaauuaaaucacugaagaaguuuguaagcguguagaugguauuccaauucagagaguguaccaacaauaccaugaccacagagagcauaaaaauaaauuuuaacuguaacuuuuucuuauuacaaaguaauaauguauuuuauaaauuuuuacaaaaacaagugauugguuuuccugaaauaacaggaagaauaguggaagugaacaucugauucaaguggguucaagagauaaugggaaggaggaauuagaguauagacaacgcuuucaugaauuuugcuguaaagaggagagaaauggggcauuagagggaugguuaagguuuggagagauagcagcauauuuauauccugauggaaccuauacagaaaauagggaaaacugauaaugcaaacaaaagaaaaucuuugucaucuauaauauuauccucaagauaaucccuguuuucauucucauguuuuuaaaaucuuuuuccuguagguagagauacaauuuuaaaacaaaaaugggaccaugcucuacauaguuuuauaaccuacuuuauuauuaauauuuucucuuauccauauucuuuuuaacauaauuucuuaugacuaccuaguaucguauaauaugccugcaguauacuauacuuguagccauuccacuguuaagauauauagguuguuucuauuuugcaauauguaaacuacguuguaaacuccauaaaggcaaagacuguaacuuggcuuguuuauugcuuugucccugguauauaguagacuuucagaaagcagauauuuaaaugaauucuacucuuccaaaccuccacccaagcagcuaaauauggcuggaaaaaaauacacaaccaugcucacuccauguuuauaaccacuaaucucagcagugacacuacauuuccuuaucccaugaacucuaccaguuagaugacuuuuucauauuuucucuucucuccucaaaauuuagauaucucgauccucaucaucauucugugcuggugaccuuccuucccguuuaacugaugaaacaggagccauuaaaaaagaacuuccgcaaauucucacuaccauaucuacugacuuaccugcaucugugcuuuuauaguucacuuuccuuuguauuaguguggaugaacuaucugggcuucugguuaaggccuuccccucugcuuguguacuauaucucauccugcucaaggaucuuacuccauauuuaaaccccccaccccuguuuuuguuuuuuuguuuuuguauuaucaguuuucucucucuucuguguagauuuccaucaggauacaguuauacugcuauccucuagccccuugcccauuuauguaaugccccauuucuuuccuccuuuuuacaacaaaaucccaugaaagaguucuuuauacucuaauuccuucuuucccauaaucucuugaacccacuugaucucaaauguucacuuccaccauucuuccuguucuuaucaggaaaaccagugacuuccacuuugcuaaauccagugacuauuucuuagucuuuaccauaccugaccuaucagcagcauguggcacaguugaucacuccuucuauuuucaaccuagcagccagagugauccucuuaacccauaagugaagucaagcuauuccucugcucacaacccuucaguggucucucacugaauuaaacauaaaagccaaaauccuuagaauggcuuacuaggcccuaugccaucuggcccuuuauuaccucucucuccccucaucuccuauuacuaaucuaacuuccuuucauugcuucaguaacacacuggccuccucucaguuccucagacaugcuggguacauaaccauuucagggucuuugcacuugcucaucuuguucccuccuauugcuuuucccccagauauuuagacagcuuauucccuuaccaucuucacguuuuucuccccuaguugucucaguaaggucuacucugccuuccuuauuuuaaguugauacccaaucugcccuaccucccagcauucuguaucuuucuuuccugcuuuauuuuucucuguagcacguaccaucaucuaguauacuauauuuuacuuagcuuguuuucuguucccccucucccaauuagggcgagauuuuugucuuguuugcuguccuuagaacagugccuaacacguaguugauacucaauaaguauuucuuuuuuucuuuuuuuaauuauacuuuaaguuuuagggugcaugugcacaacgugcagguuugucacauauauauacaugugccauguuggugugcugcacccauuaacucgucauuuacauuagcuauaucuccuaacgcuaucccucccucccuccuuccacccuacaacaggccccggggugugauguuccccuuccuguguccaaauauucucauuguucaauucccaccuaugagugagaacaugcgguguuugguuuuuuguccuugcaauaguuugcugagaaugacgguuuccagcuucauccaugucacuacaaaggacauuaacucaucauuuuuuauggcugcauaguauuccaugguguauaugugccauauuuucuuaauccagucugucacugauggacauuuggguugguuccaagucuuugcuauugugaauagugccucaguaaacauacgugugcaugugucuuuauagcagcaugauuuauacuccuuuggguauauacccaguaaugggauggcugggucaaaugauauuucuaguucuagaucccugaggaauugccacacugacuuccacaaugguugagcuaguuuacagucccaccaacaguguaaaaguguuccuguuucuccacauccucucuagcaccuguuguuuccugacuuuuuaaugauugccauucuaacuggugugagaugguaucucauugugguuuugauuugcauuucucugauggccagugaugauaagcaucuuuucaugugucuuuuggcugcauaaaugucuucuuuugagaagugucuauugauacccuuugcccacuuuuugaugggguuguuuguuuuuuucuuauaaauuuguuugaguucuuuguagauucuggauauuaacccuuugucagaugaguagauugcaaacauuuucucccauucuguagguugccuauucacucuggugguaguuucuuuugcugugcagaagcucuuuaguuuuuaauuagaucccauuugucaauuuuggcuuuuguugccauugccauugguguuuuagacaugaaguccuugcccaugccuauguccugaaugguauugccuagguuuucuucuaggguuuuuaugauuuuaggucuaacauuuaagucuuuaauccaucuugaauuaauuuuuguagaagguguaaggaagggauccaguuucagcuuucuacauauggcuagccaguuuucccagcaccauuuauuaaauagggaauccuuuccccauugcuuguuuuugucagguuugucaaagaucagauaguuguagauguguggcauuauuucugagggcucuguucuguuccauugguccauaucucuguguugauaccaguaccaugcuguuuugguuacuguuuguaguauaguuugaagucagguagugugauuccuccagcuuuguucuuuuggcuuaggauugacuuggcaaugugggcucuuuuuuugguuccauaugaacuuuaaaguaguuuuuuccaauucugugaagaaagucauugguagcuugauggggauggcauugaaucuauaaauuaccuugggcaguauggccauuuucacgguauugauucuuccuauccaugagcauuuguuuggauguucuuccauuguuuggauccucuuguucuuccauuuguuuggauccucuuuuauuugauugagcagugguuuguaguucuccuugaagagguccuucacaucccuuguaaguuguauuccuagguauuuuauucucuucgaagcacuugugaaugggaguucacucaugauuuggcuguuugucuguuauugguguauaagaaugcuugugauuuuugcacauugauuuuguacccugagacuuugcugaaguugcuuaucagcuuaaggagauuuugggcugagacgaugggguuuucuagauauacaaucaugucaucugcaaacagggacaauuugauuuccucuuuuccuaauugaauacccuuuauuuccuuuuccugccugauugcccuggccagaacuuccaacacuauguugaauaggaguggugagagagggcaucccugucuugugcccauuuucaaagggaaugcuuccaguuuuugcccauucaguaugauauuggcuguggguuugucauagauagcucuuauuauuuugagauacaucccaucaauaccuaauuuauugagaguuuuuagcaugaagcguuguugaauuuugucaaaggccuuuucugcaucuauugagauaaucaugugguuuuugucauugguucuguuuauaugcuggauuacguuuauugauuuuuguauguugaaccagccuugcaucccagggaugaagcccacuugaucacaguggauaagcuuuuugaugugcugcuggauucgguuuuucaguauuuuauugaggauuuuugcaucgauguucaucagggauauuggucuaaaauucucuuuuuuuguugugucucugccaggcuuugguaucaggaugaugcuggccucauaaaaugaguuagggaggauucccucuuuucuauuaauuggaauaguuucagaaggaaugguaccagcuccuccuuguaccucugguggaauucggcugugaaugucugguccuggacuuuuuuugguuggugagcuauuaauuuuugccucaauuucagagccuguuauuggucucuucagagauucaacuucuuccugguuuagucuugggaggguguaugugucgaggaauuuauccauuucuucuagauuuucuaguuuauuugcauagagguguuuauaguauucucugaugguaguuuguauuucugugggauugguggugauguccccuuuaucauuuuuuauugcaucuauuugauucuucucucuuuucuucuuuauuagucuugcuagcagucuaucaauuuuuuuucaaaaaaccagcuccuggauucauugaguuuuugaaggguuuuuugugucucuaucuccuucaguucugcucugaucuuaguuauuucuugccuucugcuagcuuuugaauguguuugcucuugcuucucuaguucuuuuaauugugauguuagggugucaauuuuagaucuuuccugcuuucucuugugggcauuuagugcuauaaauuucccucuacacacugcuuugaaugugucccagagauucugguauguugugucuuuguucucauugguuucaaagaacaucuuuauuucugccuucauuucguuauguacccaauagucauucaggagcagguuguucaguuuccauguaguugagugguuuuaagugaguuucuuaauccugaguucuaguuugauugcacuguggucugagagacaguuuguuauaauuucuguucuuuuacauuugcugaggagugcuuuacuuccaacuaugugaucaguuuuggaauaagugcagugggaugcugagaggaauguauauucuguugauuugggguggagaguucuguagaugucuauuagguccucuuggugcagagcugaguucaauuccuggauauccuuguuaacuuucugucucauugaucugucuaauguugacagugggguguuaaagucucccauuauuauugugugggagucuaagucucuuucuaggucucuaaggacuugcuuuaugaaucugggugcuccuguauugggugcauauauauuuaggauaguuagcucuucuuguugaauugaucccuuuaccauuauguaauggccuucuuugucucuuuugaucuuuguugguuuaaagucuguuuuaucagagacuaggauugcaaccccugccuuuuuuuguuuuccauuugcuugguagaucuuccuccaucccuuuauuuugagcuuaugugugucacugcaugugagauggguuuccugaauacagcacacugaugggucuugacucuuuacccaguuugccagucugugucuuuuaauuggagcauuuagcccauuuacauuuaagguuaauauuguuaugugugaauuugauccugucauuaugauguuagcugguuauuuugcucguuaguugaugcaguuucuucauagccucgauggucuuuacaauuuggcauguuuuugcaguggcugguaccuguuguuccuuuccauguuuagugcuuccuucaggagcuguuguaaagcaggccugguggugacaaaaucucucagcauuugcuugucuguaaaggauuuuauuucuccuucacuuaugaagcuuaguuuggcuggauaugaaauucuggguugaaaauucuuuucuuuaagaauguugaauauuggcccccacucucuccuggcuuguagaguuucugccgagagaucagcuguuaguaugacgggcuucccuuuguggguuaccugaccuuucucucuggccgcccuuaacauuuuuuccuucauuucaacuuuggugaaucugacaauuaugugucuugggguuguucuucucgaggaguaucuuuguggcauucucuguauuuccugaauuugaauguuggccugccuugcuaguuuggggaaguucuccuggauaauauccugcagaguguuuuccaacuugguucccuucuccccaucacuuucagguacaccaaucagaaguagauuuggucuuuucacguagucccauauuucuuggaggcuuuguucguuucuuuuuauucuuuuuucucuaaacuucucuucucgcuucauuucauucauuugaucuccuaucacugauacccuuucuuccaguugauugaaucggcuacugaggcuugugcauucgucacguaguucucgugccaugguuuucagcuccaucagguccuuuaaggacuucucugcauugguuauucuaguuagccauucgucuaauuuuuuuucaagguuuuuaacuucuuugccauggguuugcacuuccuccuuuagcucaaaguaguuugaucgucugaagccuucuucucucaacucaucaaagucauucuccguccagcuuucuuccauugcuggugaggagcugcguuccuuuggaggaggagaagcgcucugauuuuuagaguuuccaguuuuucugcucuguuuuuuucccaucuuugugguuuuaucuaccuuugaucuuugaugauggugacguacagaugggguuuugguguggguguccuguuuguuaguuuuccuucuaacagucaggaccuucagcugcaggucuguaggaguuuacuggagguccacuccagacccuguuugccuggguaucagcagcggcggcugcagaacaauggauauuggugaacagcaaauguugcugccugaucguuccucuggaaguuuugucucagaggaguacccggccgugugaggugucaaucugccccugcuggggggugccuccuaguuaggcuacucgagggucagggacccacuugaggaggcagucugucuguucucagaucuccagcuaugugcugggagaaccacuacucucuucaaagcugucagacagggacauuuaagucugcagagguuucugcugccuuuuguuugacuaugcccugcccgcagagguggagucuacagaggcaggcaggccuccuugagcugcggugggcuccacccaguuggagcuuccuggccgcuuuguuuaccuacucaagccucggcaauggcaggcgccccucccccagccucacugccgccuugcaguuugaucucagacugcugugcuagcaaugagcgaggcuccgugggcauaggacccucugagccaggcacgggauauaaucuccuggugugcuguuugcuaagaccauuggaaaagugcaguauuagagugggagugaccugauuuuccagaugccggcugucaccccuuucuuuugacuaggaaagggaauucccugaccccuugcgcuucccgggugaggcgaugccuugcccugcuuuggcucacgcucagugcgcugcacucacuguccugcacccacuuucugacacuccccagugagaugaccccgguaccucaguugaaaugcagaaaucacccgucuucugcgucgcucacacugggagcugucaguauuucuugaaugaaugaauuuaagccaugaacauccuugcagauaaauauuuacauaaaucuaugaaucauuuauucacucagugaaauuuuuugagugcagcaggucuaugaggucaggauuauuuuauaauuccaagacauuauuugccuuuuucauacucauugucaugagcaugcaauagcauauuucaaaagcuauaucacuuguguugucacaacagauugaaugcagaacuagauaugcauauccaauuauuuucuauuuaaccagguauuaaagaaauuugcaaaaaucuaaaaugauaccacucuucucauuguguuuuuuuuuaaucuggaaaaauauuuucauuuuuaaaauuauguuacguauaauuuauguuaaguguaaaacauguaacauguuuuuauguuauauguaaaauauauaguaacaugaugguuuuuaaauuuacuggcauuaauuucuaauaugguaaauauugauagauuuaaaccacauaaacaaaaguucuuugagguccucaguaauucugaagaguaacuccaaagaguuacuauaaagggauccugaaaccaaaauguuuuaagaacugcuauucuaggccaugguaagaguuuugaacuuuauucuaaaaacaguaagaagcuguugaaggauuuaaaagcaagguaugacauaaucuggcuuaacuaagaaaaggucauuuaucuaacucagugguccccaaccuuuuugacaccagggacagguuucguggaagacaauuuuaccauggacuggggucagggggaugguuucaggaugauucaaaugcauuacauuuauugugcacuuuauauuauuauuacauugcaauauauuaugagauaauuauacaacucacuauaauauagaaucaguggaagcccugagcuuguuuuccugcaacuagauggucccaucuaggggugaugggaggcacugucagaucaucaggcauuagauucucauaaggagcauacaacuuagaucccucauaugugcaguucacaauaaggguuggcauuccugugagaaucuaaugcugccacugaucugacaagaggcagagcucagaugguaaugugagugaugaggaacaacuguaaauacagaugaagcuuugcucacuugccugccacucaccuccuguuguguagcccaguuccuaacaggccauggacagguaacagggauuggggaccccuguuuuaacugcugucugaagaacagauuguaguggggaaggggaacaaauaugaaguuacugccuuugucuagguaggaaaugguggagguuuguacugaugugggguauuaauuuccuaggacagcuguaacaaagugccacaaacuagguggcuuaaaacaacagaaauguauuguuagcagggccauucucccucugaaaccuguaggggagaauccuuugccucuucgggcuucugguguuugcuggcaauucuuggcauuccuuguguguuuccaaauaagguacccauugugagguacaaggaguuagaacuuuaacauauuuuugggagacacaauuaaacucauaacagguaguaacaaugaaguaaagagaaauggauaauuagacaucauauauuuuagaauauacucucuaguaggaguuguuuguggauucaauauagaggaugaggaaaguagaauucaaggauggagcccaaauucuugacuugagcagcuggguaauagagccaaaugacauaccauuuauuaacaugaagucuugggguugggacaauuuuccuugggggaaaaauuuacagaaguggaauugcaaaguccccuauuuccuuaaauauccucaugcaucucuuuguccagauaugcuguagcauuguuauauuguuuuaguauuauucuaucagaucccccugguuuaaacaaucagauguagcaaaauauauuguagcccaauucacuuagguauacuuacguaaaaagaaaauaacaaaggaacaaggaacaugugcugugggagaaauucuuauagucaaaguggaacagacagaguuggcaaaguccuaugauauccccaaaguauuucaaauuaaacuucgauauggaaauucugauuauauaaguuugauaccauauuaggauauugacuacauuuuccccugcugaaugaaaaucuggcuuuagauuaaaauggcuaucuaaguuauuugguaaccugaugggguuaaggauguuaguuauauuacuaaguaacauuaugacaaaaaugaccccuugauugguaaauuaauuuggacugggaagaacugcaaaggaaugauaaauaccugauggggacacuguacuuuggaauguccugaguuacuuguaauuggcauaccccuugugugacccuagaagcuacuguuauauuguggcacuugugaaguaccaggacuucuaagccaagauagaccccacaucugcugauauggaucucuuccccuaauaucugaguuauaucuccuggagagaagaaaccuccuggguggcuggauaagcugucacaugaauuaccucaaggacuccagucugacacuacccugauggcaaauuuggaaugguuucugucugaaauauuuccgaauaauugaugcuaauuguacccaacaguaguuuugugagucugaaugauuagaagaccaccguguggauagagcacauauauuauccauucuuuagguucaacugcuuguuuacacuguaccuauuuuacuccaauuccucucucuccagcaauuuuaauaugauguuaaaguaaauguaguuguuuuagcugcaguucccaaagcaaacuugcucuuaagaacaucuguguagauguacauuugaucaguugccuuaaaagggaugaauaaucaguaauacugccuuugauuguuuuccuuuuaguuguuugcuugucauguuuacaguagcuauuuaucaauuuggauaucaucuauuuaaguuagcuuuuacuguuguagcccauguggagaaagaguuugaaaugcccauuuauauuugaucacagauguaugguuuuucaaauaagguuuuuuuugugauuuugguuugguuuuuuuguuuguuuguuuguuuguuuguuuuugaaacagagugucacucuguugcccaggcuggagugcagugguauaaucauggcucaccacagccucagucuccugggcucaggagauccucccaccucagccucucaaauagcugggaccagaggugugcaccgccacaccuggcuuuaaaaaaaaaaaaaaaauucuuauagagucaaggucucccuaauguugcccaggcugaucucaaacuccuaggcucaagcaguucucccaccucagccucucaaaguacuagaauuagagucaugagccaccaugcccagccuucaaaugaaguuuugauccuuaauuauugcuuacaccuaauaagaaagacguccagagaaucaaguccuuguauuuugcuguauuuugucagcuuuuuggaauauauacuguuacuuucugguuuuuauucauagagaaaacuuaagaaaacugaggagugggcuggucagaaaguuaucuuguaacuauugauuaacaaguuaguuccauuauuuuguggaggauuagacaaauguccggaaacagaaagacagccaguaaaaagaguuacuucuaacuuguccaaagacauguuacccauuuguggugacacugauggcaacugguagagaggcaagaaggcgaagugugcacgggcuacagaucaccacccagagcagugccacuuuaauguuggcuuuauuuacuugucauuccagauucuauuugaauacaagcuuccauagaauguuaaaaaaaauugaaaaucacugauuaagaauauagucuaugcuuagaaaugcuccccaaaaguuuaaaaaaagaauauagccuaaaaccaagauaaaaccaacaugaacauaaaauacacagaucuauaauaaagcuuucuacaaaucauguugugagaccauucccagacuaucagucagagacaguuucccaguuuuagacacagcuugaggaacuugcuugucugauuuccaauccuuagcagaugagagguagaaaauuuuaaagaguucagguacacugauaauaauaaaggauaaaugaauauccuauggcugaggaaaagcugcuuaaaaaaggaaaagacaaaaaucaaacucaacaaaaagcaaaaguagucuggguccauuuggugaaagaccaaauagccuuauauaccuuagugcacuguaaaggcaucuuuuauaguguguacaguaaaugauguuuuuguucaaucauauucccagacauuuacuuggugccagaaauugagggauauaaucaguuugugauguugacugagaaucgucagaaaaagguuaaaucauuguccauguucuccauauagaguaaugagaaguaagauguguuagaaauaauuauaugcaaaaguuuacagggaugauguuuuuaauuuuuggaugcugaaauguuaaugauccaauuauuugaaaaaucuacugauauauacucccucauuccauaaagaugccaguuaaauaagauguuacuguaucuacauuguuuccuagaaagaaaggaaaauaccuagaaccugcagcugaaagcuuaacuuauauauauauauagaaaaauaaucauaaaaggcauuugcaagcuucuaaauugucagauuaaucaucuauuauagagucacagaucucauaaggagagacaguacauuccaggcuuagaaauacuauuaaaauuuaccuaaaacuauauuacuaacucaaaauuuuuuauuacuacuucgaauuucucacagccaguuugcuugagugccucacuuaucauacauucacuugaaacacuguuuuuuaaauaaaauuuauauuuuaaguaaauuacuggauauaacaaaauuuucucguuagccauaucaugggaaaaucuagccccucuaugcagcuuuguuauuacucuuguaucuuuagagcugacauuaguagagaugguagaucaagugugaauugaauuagagcaucagaaucauggucaaaaaaaaaaaauccaguuacacugaagagaauuuuccacuuggaauauauauguguguauauauacauugccuguauauauacaagcuguaagaacagcuuggaauauguauguguguauguauguguguguguguguguacauauauauacacacaccuguacaggaauauacauauauauguauauauacauauauguguguauauauguauguaucuuaaucuaggaauauggcucuugauucagugugauaaaauguauuuagcaguuaaaaaccaggggcuacacaauuuuaugcagaagaaacagcaguguuaccaguggcuuaguguuaaagagauaaaauaaaugauaguuuccuuguaccaauccugagcuauguauuuaauauuuucgucaacaccucauuugguagaauaaaagcauacuauauuugaugaggcacacaauuuggagauacaagaaaacucaguccuuaaaggaaauauuccuaaaauggagacaugaucaaaaauaagaaagaauugcugcagaguacaugugaggaaagaaauaaucuguuuaacuucaggagcacauguggaagaaaaaagaauccagaaaucaaacagaauauaguagugauuuugcagcuaguaacuauaagcuaaauauccuguucaucauuguuuagaccuucauuguauuaucaugucugucauugcacuccacacuguaggaaauaaaugggaacauucuucuaaaggguuuaaguaaaaggaaaaagguuaaauuaaagacuaaaauuaauuagucuuuaaauugguuuaaauaauaaacugaauguggagcaagauugccaaauaggccccuccaccaauugucgccccagcaggaacaccaaauuuuaacaaauaacuacacauaaaagagcacugucauaagaaccaaaaaucagaugagcaaucacaguaccugguuuuaacuucauauuauuaaaagaggcacugaagaggguaggaaacacagucuuaaaucgcugacaccaccccuucucaaucccgcagcagcccuguggcguggagagagaaucugugcacuuggagagggagaacacagcaacugggagauuuggcauugaacucaguacugcccugucaaagcagagagcaaagccaugcagggcucagccagcacccacacauagaaggagcauuuggacuagcccuagccagaggguaaucguccauccgagugauaggaacuugaguuuugauaaaccucaccacugcgggccaaagauaucugggguccuaaauauacuugaaaggcagucuaggccacaggacuguaauuccuaggcaaguccuagugcugcggugggcuuagagacaguggaccagggcagcacaugaccuagggagacaucagcuagggcaacaaagggagugcucgugccaucccucugacuccuuccuucuguuugagaagaggagagcaaagaguaaggaggacuuugucuuacaucuuggauaccugcucagccacaguaggauagggcacugggcagagucuugaagcccccauuccacggccuaccucccagaugacauuucuagacacauccugggucagaagggaacccacugccuugaagggaaggagccaguccugcaggauucaucaccugcagacuaaagagcccuuggguccucaauagccaacagcaaugcccaguuaguaugcugugggccuugggugauacucugagaugugcuggcuucaggugagacccagcacauucccagcugugguagcuacaguaaaagacuccuucugcuucagaaaaguagagggaaaaguaaaggggacuuuaccuuguaccguagguaccagcucagccacaaugggcuagaacgccaagcgggcuguuggggugccugauuccaugccuaggcucuuggacagcuuuggaccagacaagccuuggauagccuucuggacuugucgugggccagaggggagcccacugcccugaagggugaguucugggguuggcagcauucaccacagcugacugaagagcacuugggcuuucagugaauaucggcaguggccuggcagagcucuccaugggcuggugguggugguggcaacugggagugggagaggcuccucugccuguggaaaagggagggaaggacugacuugucuuaugguuuuagggccagcuuagccucaguaaaauagaacaccagguagauuucuaagguuuuuuccuccaaucccuagcucccagacagcaucucuggacccacccagggccugggguaacuugcuucccugaaggaaaggacaaaaaccuggcuggcuuccccaccugcuaauuguagagcccuagggccuugaguaaagauaggugguagccagguagugauugcagugggccuugggcgagacccagugcuguacuggcuccagauacaacccagugcagucccaguggugguggccacaggguuuuugcaucacuccaccccaggauccaaguggcucagcacaggagagacuccauuuguuugggagaaaauaagggaagagaacaagagucucugucugauaauccagauaauucuucuggaucuuauccaagacuaccaugucacuaccucuaugaguuuucaagaaccacaguguuauucggcuugggacccaauucucuuccaauaccuggaaaaccuuaccaagaaaaaugggcacaaacgugcccaaauugcgaagacuacaauaaauucuaacucuucaauguuuaaacgccaaugacuauccacaaucaucgagaucauccagggaaacacaaccucaccaaacuaaauaagacaccagggaccaguccuggagaaagagauaugcaaccuuucagagaauucaaaauaacuguuuugaggaaacucaaagaaauuuaagauaacacagaaagcaaauucagaauucuaucauauaaauauaaaaaagagauugaaauaauuaaaaagaaccaagcagaaauucuagaguugaaaaauggaauugacauagugaagaaugcaucagucucuuaauagcagaauuaagcagaagaauuugugagcuugaagacagacuacuuaaaaauacacagaggaaacaaaagaauaaaacacacuuaaaagaucuagaaaacagccucaaaagggcaaaucuaagaguuauuggccuuaaggaggagaucgagaaagagacagggauagaaaguuuauucagagggauagugucagagaacuucccaaaucuagaaaaagauaccaacauucaagcacaagaagguuauagaacaguuuuaaccuaaagaagacuaccucaaggcauuuaauaaucaagcucccagaggucaaggguaaagaaagcauccuaaaagcaucaagaaaaaaagaaacaacauauaauggagcuccaacacaucuggcagcagacuuuucaguggaaaccuaaacaggcuaggagagaguggcaugacauauuuaaagugcuaaaggaaaaacaaacaaaaaaaaauuuacccuagaacaguguaucuugugaaaauauccuucaagcaugaagaagaaauaaagacugucagacaaacaaaagcugagggauuuugucagcacuacaccuguccuauaagaaaugcuaaagggaauucuucagucagaaggaaaaguauguuaaugagcaauaagaaauuauaugaagguacaaaacucacugguaauaguaaacacacaaaucagaauauuauaacacuguaauuaugguuuguaaacuacucuuaaguagaaagacuaguugaugaaccaaucaaaaauaauaacuaggauaacuuuucaaaacaugggacaauaagacauaagcaacaaaaaguuaaaaagucagagaauuaagugaaaauguuuuuauuaguuuuuuuuugccuauuuguuuaugcaaucaguguuaaguugucaucagcuuaauaauaauggguuauaagauacuugcaagccucaugauaaccucaaaucaaaaaacauauauacaaaaauaaaaagcaauacauuaaaauauaccaacagagaaaacuaccuucacuaaaggaagacaggaagcaaggaaagaagaaagagaagaccagaaaacaaauaacagaauggcagaagcaaguccuuaccuaaucaauaaugacauugaauguaaauggacuaaaaacucuccuaucaaaagacauagaguaggccgggcgcgguggcucacgccuguaaucccagcacuuugggaggccgaggcggguggaucaugaggucaggagaucgagaccauccuggcuaacaaggugaaaccccgucucuacuaaaaauacaaaaaauuagccgggcgcgguggcgggcgccuguagucccagcuacucgggaggcugaggcaggagaauggcgugaacccgggaagcggagcuugcagugagccgagauugcgccacugcaguccgcaguccggccugggcgacagagcgagacuccgucucaaaaaaaaaaaaaaaaaaaaaaaaagacauagaguaacugaguggauuaaaaaaucaagacccaaugaucuguugccuacaagagacacacuucaccuauaaaguuacacacagacugaaaauaaaggaaugcaaaaagauauuccaucccaguggaaacaaaaaaagagcaggaguagcuauaguuauaucagacaaaauagauuucaagacaaaaacuauaagaagagacaaggucauuauauaaugauaaaggggucaauucagcaaaaggauauaauaauuauaaauauauaugcauccaacacugaagcacccagauacauaaaggaaauauuauuagagguaaagagagagagagaccccaauacaauaguagcuggagacuccaacauaccacugucagcauuggacagaucuuucagacagaaaaucaaagaaacaucagacuuagucuauacuguacaacagugaaucuaacagauauuuacagaacauuucaucgaaugacuguacaguacacauucuucucggcacauaaaucauucucaaggauagaccauauauuaggccacaaaauaagucuuauucaaaaacugaaauaauauuaagcaucuucucugaccacaaucaaaugaaacuacagaauuuaguuugcuacuauuuuuuugaggauuucugaaucaauauucaucagagauacuggccuguaaauaacaagaauaauuuuggaaacuauacagagacauggaaauuaaacaguaugcuccugaaugaccagugagucaaugaagaaauuaagaaaauugaaaaauuucuuuaacaauggugaaaacgaaauauaccaaaaccuguaagauacagugaaagcaguaccaagagagaaguuuauagcgccugcaucaaaaaagaagaaaaacuuccaauaaccuaauggugcauccuaaagaaccagaaaagcaagaguaaacaaacccaaaauuaguagaagaaaagaaauaauaaaauaauaaauaaaauaaaaaucagagcagaaauaaauaaaucaaacugaaaugaaggaaagaauacagucaucaaaaugaaaacuugguguuuugaaaagacaaauaaaauugaccaacuuuuagccagacuaaaaaaaaaaaagagaagacccaaauaaaaucagagaugaaaagguagacauuacagccaauaccacugaaauucaaaggaucauuaagugacuacugugagcaacuaacuauaugucaauaaauuagaaaaucuagagaaaauggggaaauuuguagacacauacaaccuaccaagauugaaccaugaagaaauccaaaaccuuaacagaccaguaacacauaacaagauagaagcugaaauaaaguuuuccaguaaagaaaaggcuaggaccucguggcuucacugcugaauucuaccaaacauuuaaaaaagaacuaauaccaguccuucucaaacuauuccaaaaaaauugaggagggaagacuuccaaacucauucuauaaggccaguauuaucaugauaccaaaaccagacaaagaucaaaaaaagaaaacuacaggccaguaucucugaugaauauugauucagaaauccucaacaaaauaguagcaaacuaaauucaaugauacauuaaaaagaucacucaucauaaccaaguugguuuuauuacagggaugcaaggauggcucaacaugugcgaauaaaucagugugauacauuauaucaucagaaugaaggacaaagaccauaugaucauuucaauugaugcugaaaaaguauuugauaaaauucaauauuccuucaugaaaaaauccuuaacaagcuagauauagaaggaacaucuuaccucaacauaauaaaagucuuauaugacagacccaaagcuaguaucauagugaauggggaaaaacuguaagaucuggaacaugacaaggaaacccauuuucaccacuguuauucaacaugauaauggaagaccuagcuagagcaaucagacaagaaaaagaaauaaagggcauccaaauuggaaaggaagaagucaaauuaucuuuguuuaauuuaucauaagauuauaggaucuuauauuuuggaaaaccuaaagacuccaccguaaaacaauuagaacugauaaacaaauucaguaaaguugcaggauacaaaucaacauacaaaaaucaguagcauuucuuuuuuuuuauuuuugagacagagucuugcucugucacccaggcugaagugcaguggugcaaucuuggcuuacaaaaaucaguagcauuucuauaugcaaacagucugaaaaagaaauuuuaaaaguaauuccauuuacaguagccacagauaaauacccaggaauuaaccaaagaagugaaagaucucuacaaugaaaacuacaaaacauugaugcaagaaauugaagggaacacacaaagguggaaagauauuccauauucauggauuggaagaaucaauauuguuaaaauguccauacuacccaaaguaaucuauaaauucagugcaauuucuaugaaaauaccaaugacauucuucacagaaguagaaaaacaauccuaaaauuuauauggaacuacaaaagacccaguauagccaaagcuaugcugagcaaaaagaacaaaacuggaagggucacauuaucugacugcaaauuauacuacaaaacuauaguaacaaaaacugcuugguauugacauaaaaauagagagauagaugaauggaacagaauagagaacccagaaacaaaucuauacaccuauagugaacccuuuuucaacaaaaguaccaaaaacauacauuggggaaaagacagccucuuuaauaaacggugcugggaaaacuagauacccguaugcagaagaaugaaacuagaccccugucucucaccauguacaaaagucaaaccaaauggauuaaagacuuagaucugagaucucaaacuaugaaacuacuacaagaaaacauuggggaaacucuccaggacuuuggucucuguaaaaauuucuuaaaaccccacaaacacaggcaaccaaagcaaaaaugaacaacugagaucacaucaaguugaaaagcuucugcacagcaaaggaaacaaucaacaaagugaaagacaacccacagaaugggagaaaauauacaagagauuaauaaccagaaggagcaaaaaaaaccuaauaaucugguuuuauuuuauuuucauuuuuuuuauuuuuauuuuuugagacaggaucucgcucugucacccaggcuggagugcaguggcaugaucucagcucacugcaaccccuaccucccagauucaagcauuucuccaaccucagccucccagguagcugggauuacaggugugagccacugugcguggcuaauuuuuuuauauuuuuuaauagagaugggguuucgccauguuggccaggcugcucuugaacuccuggccucaagugauccaucugccucagccucccaaagugcuagaauuacaggcgugacccacacgcuuggccuaauaaucagauuuuaaaaugggcaaaugauuugaauagaucuuucucaaaagaagacauaaaaauggcaaucaguuauaugaaaagguggucaauaucauugaucaucagagaaaugcaaaucaaaauacaaugacguaucaucuuacuccagugaaaauggcuuauauccaaaagacaggcaauaacaaauacuggcaaagauguggaaaaaagggaacccuuauacacuguugugggaauguaaauuaguacagccacuauggagaaccguuuggagguuucucaaacaacuaaaaauagagcuaucauaggauccagcaaucccacugcuggguauauaccccaaagaaaggaaaucaguauguugaagggauauacauacaccgauguuuguugcagcacuguuugcaauagccaggauuuggaggcaaccuaaguguccaucagcaaacgaauggauaaagaaaauaugguacuuauauacaauggaguauuauucagucauuaaaaagaaugagaucuugucauuugcaacaacauggauagacccuggagaucauuauguuaagugaaauaagccaugcacagacaaacuuugcauauucucauuuauuuguaggagcuaaaaauuaaaauaguugaacucauggagauagagaguaggaggauggugaccacuagaggcugggaaggguugcagggguauaggggagaagugggaugguuaauggguaugaaaaguaguuagaaugacuaagaccuaauauuugauagcauaacagggugacuauggucaauaauaauuuaauuguacauuuuaaaaugaguacaaacuaaaagcacaauuggauugcuuguaacacaaaggauaaaugcuugaggggauggauaccccauuuaucaugaugugaauauuacacauagcaugccuauaucaguaccucauguaccccacaaauauauauaccuacuguguacccacaaaaauuaaaaaauuuugaguuuaaagaaaaacagugaggaaaaauuaaaguaguguauucauucucucauuucaugaacauuuauugagcacacaguauaugcaagacacugagcuaggcacuggaugaaagacguaguacuugccuacaagaaguuuauagucucaguggaagagauagauaagaacauaaaguauguguugugccacaguaguagaaaagaggagcaccuaaccguacuugaggagucaggggagguuuccuuaagaaggugaacugagucuuaaagguugggggauuucauuuuccugcaggauuccagacuaauaauaaucucaaaauucucccaccacaaaacacucagaaaugcagaauaaaauauaauaagcaccucuuuaaaugcauagacaagcuuacaaaaaagcaacucaacucuccaagggccaaaauaagcauagcuaaaaacaaaauaggaagcuuuaaaauaguuuuuuaaauaaacaaagcuuuaaaaacaaagugguaaguuuaaaccaacacugggcugcucugaaaggauuuggcagucucaauaccuaugggguagagaucucaaauaauaccaaccacccucagaguagacugaaaaauucuacccacugacagaauuggcauagagaguuugucuuagccugugcuccaaguccgggguugggguggcggugaagguggguuugcucuuuuuaaauuugcacuucuuaaguuuucaaaaaucccgcuaagaagucaacuaagugaucuuaagcugauaauauaucugggaugcuugacagaaacaaaagcaaaauuauucuggagggacagacccucaaucuagggagcacaguacagauuuuuucaaagauaaaaccccccuuaaaauaaacuuauaguccagaaucaaaaagcauauaggaaucaauaaguaggugucagccagcacaacaaacaucacucugcuuccccucccucaguucaaauaaaagaaauauagggacuauaaaauaagucaauuuaaaauguucaaauauaucaaagaauuuuuuaaacaugagaaaagagcaagguuuuaucuuuaaaauguugagggacaguuuccagacagagcaaggagcauucacagcuaugggaguccagauaaauauuccuuuuuuuucuuucuuucuuuuuuuuuuggggggggggggcggagauggaaucuuacucugucacccaggcuggagugcaguggcgcuaucucagcucacugcaaccuccaucuccuggguucaagcaaucccgaguagcugggacuacagacacaagccaccaacgccuggcuaauuuuuuguauuuuaguagagacaagguuucaucauguugcccaggcuggucuggaacugcugagcucaggcaauccgcccaccuuggccucccaaagugccaggauuacaggcaugagccaccgcuccaggccccagauaaguauucuuauaggaauuggcagucacaaaauugggaagagaagguauugggagagagaugagcaaggcuugguucaugaaaugccuugcauucuggguuagugaagacucuuguuuacaagugacaaaaagaucacacuugucuagggaguauuuugcuguuauuggcuuaccuaaccaagaaaaaauauuguugaaaugacaagaaccagagacccucauucucucuccaugucucaccacuacuuuuuucuuugugaauacuuauucucuucuacugcagacugauuuucaccccaaaguagagaacauugccacuugcaguuuuuggcucauacccuuuucuaauuuucuuucuuuuuuauugugguaaaauauauuuggaauuuaccauuuuaaccauuuuuacauguacaguucaguggcauuaaguacauucacauuauugugcaguuaucaccacuguucaucuccagaacuuuuccaccaucccaaacugaaacucuguacccauuagacaagaacuccccaugcuucccuccucccugccccugguaaccacuauucuauuucauguuccuaugaauuugacuacucuagguaucucuuauaaauggaaucacacaauauuuguccuuuugugucuagcuucuuugaccacacucucuuuuuuaaaauugacacauaauaauuguacguauuuauaggguugcacccuuuacuuuugaucagagaggaaagaaccuucugugugcgcacacuucuaucuuauagcuccauuuugaaaaauuuugaaagaaaacuaauugucuuggcuugaguaacuugcauacuuucagacaaggaagaugaccagugcugugauuugcccauuuuggguugcaugaccaccuuaguaucuuccccaguucuccguguaaacauaccuucuuauagaguccuuucuaucuaaaauagcacccacaucagucucgucucucacucuguuuugauuguuuuccagcguacucaucacuuccuaguauuaaauauauuuauuugcuuauugauucccuagccacuacaacauaagauuuauaacauuagagaccucugucucauucauuucauuguuuccagugccuagaacagugacuggaacauaauuggagcucaguaacuauuuuuaacuaauuaauuagaaauugagguagagauauagauuuaguauucacugguaaaugugauuaaaagaaauagauuaugcuuucuuccaccuccauagucaagaugaagaauuagaaauugaaaggaaaugaacuuuaaguauauaugaacacagugauuaaacaugaaaguuaugcacaaauagugaaagaacuaugcuuucuaaagauacauaauuguggaaaauacaaccuugcaugauggaugccuaaguagaauccugaaauugcaguagauuaagcuuuuucugaaauugcuuccuaaugcaggacauucacauuuaaacuauaaaugugaaugcauaaacccaucaggaguuugcauguaugugugugugugugugugcgcacucacgcacacacacacacacuuucauugauuaacauuggaagcugacaaauauagauaugagucuuaagccauaauggucaguacuguucuuuugaaauugcccuuagcuuucccaaucaagacaacauucucuugagcagaacuucacauugucaggcugcccugcauaagaaucacucagauacuauucacuauagcugccuuagcucucuuccccuaccuguccuuaaucucaagggcagggcaggucaaaggggagcaagauaaagguuguaucuaaaaagacaagaaaaaaaaguaggcaaaaaugaucucuuguguuuccugacuuuuucaugcugcuuuccaucuuuuacuuuucuuagaguuuauuaucuuuaugaugcuuccuggacaucccaaacuuagcauaguugcaucuuagccaaguguacccuacccugacucccugcuaaaauuacuucuuucauaucuccucucucccauguaauaagcaccuuaccuccaaauccaaucagaccuucauuccacaguaggaaaacaaacuacauugccucaagguugucccccugccaugacuuuuuucuuacuaccuaucugaaccauaaaauaaguucucuguggcagcuucuugcuuuucuuucuaggagauaaauagggagacccauugccaaaaaguuccagagccaaccuccaccccuacauucagcuguuaggaagugggaaaagcagauauggguacccaagaauaguuuggcuggcauaacaucacccuuccaaguuauucagauuaacaguuucacauuuauucucaauuaccaggggcaugacggccaugcauauuacaaagugcuuaugaaguuaauuacuaaauugugcuuuucacuuguguacuuugauuauuuguugcucauguaaugugauuagcugcucucaguuuuaagagguggcauugcuaaaaaguacucaacugcacuacaauuaauaguauauauaguuuucuugguuuuaaaggaaaauaacugaaauguuggaauuuccuaaguauucuauggcaacuuuuggcuuucuuaacaacuucugggacuuuguaugcuuugaaaucacauuacuuuaugauauuugaucugguuaugaaacccgguguuauuagccuggaauuugugagucuuugaaaagggauaaaaagcuauccacuauaaaucacagaaucgcuagauagauuuggggacaagcuuaggaaaaaaaaaauccuaauacuggccaagauaaaugagacauagugucaauuuuucugccaugaacuagguaaccaaacugccucacuuuaagaauuucucuuuggauuauuaccugcagauaucuggaguaacuggucauccuguuacuccauuguagcugcuacagugcacaaguuaucauucuuuauucuucaggauggugagcuuggucaaaaguuacggugaagcucaguuaacugacuucuuuuccuaagucugauaaaccuauggaacuuugguauaucagauaaauuugcuacaguuuauguacuuucauacuuuugcaauuacuuagacuucuaaaauguauuauuuguuucuuuuauaggacaaugaaggccaaacagcucuacauuaugguaagaaguuucuaaauuauuaaguaaucauauuugaacauauucucuauuuguuuauuucaacuuuguccauuccuauauagugcuuagauagguaccuggcagcuagcagagauacaauaacuuuuuguucaaaaaaauguauuaggccgggcgugagggcucacaccuguaaucccagcacuaugggaggcugaggcgggcagaucacuugaggucaggaguucaagaccagccuggccaacaugcugaaacccugucucuacuaaaaauacaaaaauuagccagggcugauggcgggcaccuguaaucccagcuacucaggaggcugagacaggagaaucgcuugaaucugggagguggagguugcagugaaccgagauugcaccacugcacuccagccugggugacauagugagacuccaucucaaaaaaaaauauuaauaacuuaguaaguugaagauguauuaaaauucuuauggucacauuuauaauaaauuguuucuauacuagcaacagaaauagagaccgugcuagcccccuuugaaaauucauuauuucauucuuaguucuauuaaugagugacaagaaagauguuaaaaucauggucacuguaaaaucuagcaucucuccuacaagaaauauuuucuugaucuaauugaagaaaaagaaauuugauuuuuuaacuaauuucuccuacuaacugauuagcuuaaguaaucuguaaaauagaaaaaaaucuguaagauggaaauaauauggcucuuagagagcugcuugguaaauucagugagauaaaagauauuacaguauuuuguaaaauguaaaguccuaguaaauaugauuuaaagagucuguguagaguugggcgcaguggugcacgucuguagucccagcuaccaggaggcugaggcaggaggaucacucaaauccaggaguuugaggccagccugagcaacacagacccugucuccaaagaaaaaagauucuauuugggugugaauauggcugaaugaaagacagccaucgguauuuacaccacauuauggaucaaccuuuugggaaggaauacacuugccagucuuggcaaccuuagacugcgauucaguaacaaguggcucaaaugacccuggacacuuuugucuacugcuuuggacuuuaaauuugcacucaaguguucaaaaaucccaagcuaaaaaaucaacuaagguauuucaagcugauaguguuucugggaugcuuggcggaaacaaaagccaaaucauucuggagggauaaugcuggagaaaccucgcugugcuaucuaggagucuuaaccuauuggacuagcuauuauacuaccuacauaugucagccuaauaauugagguugaaaugucugucaccaacugccagccucaacucacuuaugaauuugucuagcauaaccuguuuaccaaaaccagcaggagaaaggaaaauugugagucagucuuacuuaugagcauagaugcaaaaaucugaaauaaaauauuagcaaaugaaauccaucaacauauuuuuaaaagaaagaaagauaugugcugaccaaguuggguucaucccaggaauucaaggaugacuuaacauuuaaaaaaucuauuaauguaaccuuccacaucagcaaauuagguaaaaaaacuguaugaucaaaucaaaugcagaaaaaagcauuugaggauguucaacacucauuuuaagagugguaaaguaguuaauuaagccugcucguaagccagacuucugcguucaaauucuaguucuaccccugaccugggauaaaauacuuaacuuacacuguaccucaguuuacucaugaugaaauagggauaguaacuucagagauuuguuauaaugaguuaaucuguguaaagugcuuggaacaaugucugacaccuggcauauacucaauaaauguuaguuaauuauuuuuaugauaaaagcucuuaaacuaggaauagaaggagacuuccauggccugauuuacucaucaaaaacccagagcaaacauuauuauuaaagauggaaugugugaagcauuuucuuuaaaauccgaaacaagaaaaacaugcauaccauaacugugucucuucaauacuguauuagaauuguagauaacacaaaaugaaaaacaaaauaaauaaaagguacaugagauggaugaaacaaaaucaucaucauucucaaacaauacaguuagcuacacagaaauccaagaaacucuacaaauuauaaaaacuauacaauuuagcagggaugcugaaugcauuaguuuuuuuaaguuuauucuuaagcauuauuguaaaaagcuaaaaaaaauuuaaaacauuuuuccaauauuauuuacaauagcaacaaaauccuaggacucaaccuaacaaaaggcacguaaaaccuucauagaaaaaaauagaauuuuuaaaagacauuuuuaaaggaccuaaguagaaggagaaauaaucuacguuaaugaauaggaagacucgauuucauaaagaucauuucugccaagucaaacuacaaauucagagaauuuucauaagaauuccagcagauacuuuguggaauuuaacaagcuuugcccuaaaauucauauggaagauaaaggagccaggaauaucuaaggcaauuugaagaaaaacaagaaagaaggacuuguucuuccaaauaucaagauguuaucuuacagcuauaauaaugaaggcagagacugacuuccaacaugacaaugugagaagcuccacugauaugcucccuugucaaacuggugaaaauuauuuuuggaacuacagacauuuaauagcuucuagaaaugguacuaaggacaaaaagcaaaugaagagacaucuauucaagaaaaucuacaaaaauuugguaagaaggaaaacuuugugauauuugaaccaagauuacucccuccuuucugucuucccaggucagugauguggagacuccacuccacaaugcuguagccaagaacacagagcucccucuccucccagcugcuagucagagggcuuucuuccugggagaagcaggacaaacauuuucugccuugccuccagcuaccuuuugcuaaggcuguccugggcaaauauggucccaacuacuugagaggcugaggugggaaaaucacuugaguccaggaguuggaggcugcagugagucaugauuaugccacugcacuccagcuugguugacagaguaagacccugucucaaaaaaauuaaaaaguaaaagcaaaaaagaaagaacuaugaauagucugagauuguauuuugcuuacaagcuagcaaguuagccugacaguuugaugguugcuggcaaaagacacaaaacuuuuggaucagagacgaaagacuuucuuauccauggcacagcuagcagcaugagcuucauguuuuugucauuuccucuugccuccaaagucccaucagagcgaugcagagaggcccacguagauacuacacacaccgugugucauggcuuaggaauccuaaucuuagggaacucucaucuuuuauaauggguugcaagcaaaccuuugcucaggaggagguauuauguuuauuauucuggaugguaaacaaaccugcccucuguucuggaaagaaacacuaucucuguugucaaaucuguucauuacacaaacauccuugaaaguuagucuagaacaaaagcugucuuaugucuucugcacaucuuauguaccuuuguacauaagacgugcagaaacacgagagacccuucaagaauugucucccaacaauaauuaauuggggaaugcagauuaaaacauuuagauacaacuucauaccgaucagauuggcaacauguaaaugucuacaaauauuaauauuaggcuguagaacaacaagaauucucauacauugcugaugagagugucaacuguuacagccauuuugagaucaguuuaguaagauuuaguaaaguucaagguacacauacucuacaacccaguaauucugguucuagguacauaccagagaaaaacuccugaacaucuguauaaugaaacaugauuuagaacauuuauugaagcauauuuguaguagucaacaacuuguuuuauuagccucucuauuccucugcaugccaugcuuguaauauuuguuaauuaaaauugcacauauauacauauaugcacauacaaauacauauuuuaugguaucaaaugccuuugaaagaaccauuaaaaugagcauauaaaauaguaaaauaauaaacuauuuaaucuguaagccccugucuauaaauaggccucuaguaggguuuuuuuguuuguuuguuugugagucaguguuucacucuugucgcccaggcuagaguguaguggcgcaaucauggcucacugcagccuugaacuccugugcuugagcaauccuucugccucagccucccaagcagcugggacuacaggcacgcaccacuacaccuggcuaaguuauuuuguuuuuguugagacaggaucuagcccaggcuggucucaaauucuuggccuccagcaauuuucccacaucagucucccaaagcauauguaguaguuauuuuuuuuuauaaaugaggaaaccaaaacucaaagagauuaacaagcuugccuaagggaauuggaaauucaaacccaugugucuauauuuacuaggaaaagacagaaaaauuaaugcuuucccauaccuccuuccacagcauucacaucacuuacuccucaaacauguuuauauaguauuucugucauaugauuccucuuguauuaucaagagcuggcuguucuaaacccuaauuuuccacccagaaaaaaauuugucucagccacccccacagcuaugauggcaaucugggauaaccaggcuuaagucaaauaaccggagagucaaaaaagaggaaaaauaaacucuucacagugguugugaggccuucagcacaaaauucaaggcuacucauuuuuccugaugccuugcuucaagaugccagccuucuuuuacuccacaauauuugcccuacggucuagaguucacugcucugcuuauaaagacaaccacugccagugcacccacaugcccugcugaaucagcucuuauuuccauccccuuauuccuucuuucauucccucauucagguguuuuucagugccuucucuguggcaugugcuguguuuuccuuuuauuucucccuuccagaaacuguagcaacagcuaaaccagauugaaugugcucuugagaauuuagaugagucacucugucaucccuaguuaaccauuaggagugaaugccuuuauggauguaggaauguguccauuuaaguuugauauauuuaaaaugcauuuauagauagcaacaggguagggauuuuucaaaaagcauuucugacuggauucaaauaagcucuguuuucuuuauguacugguacagaaaaaucucuuaacauauauuguugaacaaaaagguuaagguguagcacgguguauauagugugcugccaugaauauaucuauacauacuugcuaguaaauauauaucucugggaggauacauaaaaagcuaauaauguuaauugccuuagggaagaggagcuguggggcuagaaauacacgaauaagaugaaaaccuuuuucuguaaacccuuuuauaacuucuguauuggaccuauaugcauauauuaucuguucaaaaguuaaauuauuuuaaagguucuauuaguacuaugaauaugauacaccuuaauuauauuucauucauucaacaaauauuugaaugccuacuauuugcuggauaaaauacaucaaacauucuuuuuaagauaagagauguccccagauucauuuacuucccacccaauaaagaacccaguaucuauagcgguaaaugggugagcaaacacucuaacugggagaacucugagcuuggauuucaaugccaacgcaaccuggaaauaagaccucuugaacuagaaguaaucaggacucaaaacugagauccugcacaugagccaggaccuucaaaaggcuauauccuucguuuaaaagaggaggcaaagggguagagauuagaacaaguuggccuauugguaaaaagaagacaaagaagcuucucugcuucagacuagcauuugaguggaaacaaaagcccuauaaguuucggguucacauuuauauucugauuauuucaggaauccucaagucaagaaauuaacauaaguguacugggcugaugaaugcuaaacuucccuugagaaacacauccucaaccuauacaguacaaaguucguccagaaugaagccccacugagaauaauauuguucacaauccaaaauuacaaaauacacuugagugaaugacagcagacauaguaaacuacaguauuagacuuugaggaacuucaguaaaacuuggauaaaaauuaucagaauaagucuguauaaaaucaaagaaucaaaaacacaagaaaagacauuccaaaaaagaacaggcagauuuggaagagaaccaaauagaacuuauguaaauuaaaaaaauacagaaauuuuacagcggauaaguuaaagugaagaauugacacaaguuaaaaaaaauuuggugaaaauauuugucuaaagaaauugccaaaaaggcagcacagaaagguaaagaaaugauaaauguaaagagacauuaagaguggaacaagagaguucagcauuuauuuaucuuaauuuguuuuuugagacagagucucgcucugucacccaggcuggagugcaguggugugaucucaacucacugcacccuccgccucccagguucaagcgagucuccugccucacccuccagaauagcugggacuacaggcaugcgccaccauacccagcuaguuuuuguauuuuuaguagagacgggauuuuaccguguugaccaggcuggucucaaacuccuggccucaaaugauccgcuugccuuggccucccaaagugcugggauuacaggcaugagccacuguacccagccuaauuuuuuuauuuuuaauuuuugugggugcauaguagaugcauauuuaugggguacaugagauacuuugauacagggauccaauguguaauaaucacaucaugauaaaugggguguccauucccucaagcauuuauccuuuguguuacaaacaaucuaauuaaacucuuuuaccuauuuugaaguauacaauuaaauuauuauugacuauaaucauccuguugugcugucaaauacugggucuuauucuuuguaacaauuuuuuuguacccauuaaccauccccauuuccgcccucaugucccuacaacccuucccagccucuuguaaccaucccucuacucucuaucuauguagcuuccauuguuuuuauuuuuagcccccacaaauaagugagaauaugugaaguuugccuuucugugccuggcauauuucacuuaacauaaugaccuccaguccaucuauguuguugcagaugacagaaucucacucuuuuuuauggcugaauaguguuccauugugcauauauaccacauuuucuuuauccauucaucuguugauggacacuuagguugcuuccaaaucuuggcuauugugaacagugcugcaacaaacauggcagugcagauaucucuuugauaugcugauuuccuuucuuuuggguauauacccaugauugggacugcuggaucguauaguagccuauuuucaguucuuugaggaaccuccaaacuguucuccauagugauuguacuaauuuacauucccaccaaugguguacaagggcucccuuuucuccacauccucgccagcauuuguuauugguugucuuuuggauaaaagccaaguucaguauuuuuaauaguuccagaaggagagauugcaaaaaauuaauauuugaagauauacuuacuaauaauuccuagaauugauuuaaacauugggaccuucagauucagaaauuaugagcucugguuaguaauaaucugugauguucaucugcuagaauacuauacagcagugagaaugagcuacaucuacaugcaauaauguaaaugaaucuuacacaugcuacugagcugagaugccagacacaaaagaguacauacaguaugguuuccauuuauauaaaggccaaaaaugggaaaaacuucucucuagcauuaguaaaggggauaaugauuaccuugggugaaguaaggagguagcaggcaacuagaagggguuaacagggcacgcgugcuucugagagucuaauaaugaccugauuguugauaugugcuaguuacauggauaaauuuccuuaagaaaauuuauauacaguugacccuugaacaacauaggugugaacuguguguguccacuuauaugcaggguuuuuuuguuuuguuugguuugguugguuuuguuuguuuuuuuuuuauuauuauacuuuaaguuuuaggguacaugugcacaacgugcaguuuaguuacauauguauacaugugccauguuggugugcugcacccaucaacucaucauuuaacauuagguauaucuccuaaugcuaucccuccccccuccccccaccccacaacaguccccggggugugauguuccccuuccuguguccacguguucucauuguucaauucccaccuaugagugagaauaugcgguguuugguuuuuuguccuugcgauaguuugcugcgaauggugguuuccagcuucauccaugucacuacaaaggacaugaacucaucauuuuuauggcugcauaguauuccaugguguauaugugccacauuuucuuaauccugucuaucguugcacauuuggguugguuccaagucuuugcuauugugaauagugcugcaauaaacauacaugugcaugugucuuuauagcagcaugauuuauacuuuuuuggguauacacccaguaauggaauggcugggucaaaugguauuucuaguucuagaucccugaggaauugccacacugacuuccacaaugguugaaccaguuuacagucccaccaacaguguaaaaguguuucuauuucuccacauccucuccagcaccuguuguuuccugacuuuuuaaugauugccauucuaacuggugugagaugguaucucauugugguuuugauuugcauuucucugauggccagugaugaugagcauuuuuucaugugucuuuuggcugcauaaaugucuucuuuugagaagugucuauugauauccuuugcccacuuuuugaugggguuguuuguuuuuuuucuuguagauuuguuugaguucauuauagauucuggauauuagcccuuugucagaugaguagauugcaaaaauuuucucccauuccguagguuaccuguucacucugaugguaguuucuuuugcugugcagaagcucuuuaguuuaauuagaucccauuugucaauuuuggcuuuuguugccauugcuuuuggguguuguagacaugaaguccuugcccaugccuauguccugaaugguauugccuagguuuuaaucuaggguuuuuaugguuuuaggucuaucauuuaagucuuuaauccaucuugaauuaauuuuuguauaaaguguaaggaagggauccaguuucagcuuucuaugacuagccaguuuucccagcaccauuuauuaaauagggaauccuuuccccauuucuuguuuuugucagguuugucaaagaucagaugguuauagauauguggcauuauuuccgagggcucuguucuguaccauuggucuauaucucuguuuugguaccaguaccaugcuguuuugguuacuguagccuuguaguauaguuugaagucagguagugugaugccuccagcuuuguucuuuuggcuuaggauugacuuggcaaugugggcucuuuuuugguuccaugugaacuuuaaaguaguuuuuuccaauucugugaggaaagucauuuguagcuugauggggauggcauugaaucuauaaauuaccuugggcaguauggccauuuucaugauauugauucuuccuaccaugagcauggaauguucuuccauuuguuuguauccucuuuuauuuccuugagcagugguuuguaguucuccuugaagagguccuucacaucccuuguaaguuggauuccuagguauuuuauucucuuugaagcaguugugaaugggaguucacucaugauuuggcucucugucuguuauuguuguauaagaaugcuugugauuuuugcacauugauuuuguauccugagacuuugcucaaguugccuaucagcuuaaggagauuuugggcugagacaaugggguuuucuagauacacagucaugucaucugcaaacagggacaauuugacuuccucuuuuccuaauugaauacccuuuauuuccuucuccugccugauuacccuggccagaacuuccaacacuauguugaauaggaguggugagagagggcaucccugucuugugcccauuuucaaagggaaugguuccagguuuugcccauucaguaugauauuggcugugaguuugucauagauagcucuuauuauuaugagauacgucccaucaauaccuaauuuauugagaguuuuuagcaugaagcguuguugaauuuugucaaaggccuuuucugcaucuacugagauaaucauaugauuuuugucauugguucuguuuauaugcuggauuacguuuauugauuugcguauguugaaccagccuugcaucccagggaugaagcccacuuaaucaugguggauaagcuucuugaugugcugcuggauucgguuugccaguauuuuauugaugauuuuugcaucaguauucaucagggauauuggucuaaaauucucuuuuuuuguugugucucugccaggcuuugguaacaggaugaugcuggccucauaaaaugaguuagggaggauuccaucuuuuucuauugauuggaauaguuucagaaggaaugguaccagcuccuccuuguaccucugguggaauucggcugugaauccaucugguccuggacuuuuuuugguuggugagcuauuaauuuuugccucaauuucagauccuauuauugaucucuucagagauucaacuucuuccugguuuagucuugggaggguguaugugucgaggaauuuauccauuucuucuagauuuucuaguuuauuugcguagagguguuuauaauauucucugaugguaguuuguauuucugcgggauugguggugauguccccuuuaucauuuuuuauugcaucuauuugauucuucucucuuuucuucuuuauuagucuugcuagcagucuaucaauuuuguugaucuuuucaaaaaaccagcuccuggauucauugaguuuuugaaggguuuuuugugucucuaucuccuucaguucugcucugaucuuaguuauuucuugccuucugcuagcuuuugaauguguuugcucuugcuucucuaguucuuuuaauugugauguuagggugucaauuuuagaucuuuccugcuuucucuugugggcauuuagugcuauaaauuucccucuacacacugcuuugaaugugucccagagauucugguauguugugucuuuguucucauugguuucaaagaacaucuuuauuucugccuucauuucguuuuguacccaauagucauucaggagcagguuguucaguuuccauguaguugagugguuuuaagugaguuucuuaauccugaguucuaguuugauugcacuguggucugagagacaguuuguuauaauuucuguucuuuuacauuugcugaggagugcuuuacuuccaacuaugugaucaguuuuggaauaagugcagugggaugcugagaggaauguauauucuguugauuugggguggagaguucuguagaugucuauuagguccucuuggugcagagcugaguucaauuccuggauauccuuguuaacuuucugucucauugaucugucuaauguugacagugggguguuaaagucucccauuauuauugugugggagucuaagucucuuucuaggucucuaaggauuugcauaggcucaaaauaaagggaugaaggaagaucuaccaagcaaauggaaaacaaaaaaagacagggguugcaauccuagucucugauaaaacagacuuuaaaccaacaaagaucaaaagagacaaagaaggccauuacauaaugguaaagggaucaauucaacaggaagagcgaacuauccuaaauauauaugcacccaauacaggagcacccagauucauaugcaggguuuuuuuuuaaaugaauauauuggaaaauauuuuggagauuccugacaacuugaaaaaaacucaguuuugcagccuagaaauaucaaaaaauuaaggaaaaguuacaugucaugaaugcauaaaauauauguagauacuagucuauuucaucauuuaccaucauaaaauacagacaaaucuauuuuuuuaauuauacucuaaguucuagguuacaugugcacaacaugcagguuuguuacauauguauacaugugccauguuugugugcugcagccauuaacucaucauuuacauuagguuuaucuccuaaugcuaucccuccacccuccccccccaauaaaucuauuauaaaaaguuaaaauuuaucaaaacuuauacacucaaacacagaccguucauggcaccaaagcugagaaaaguguaaacgauuguaaaaaugcaauauuaaaucauaacugcguaaaauuaacuguaguacauacuguucuguaguaauuuuguauauaacuccuguugcuauuacagugagcucaaguguugccagucugugcuuaaagugccaggugaugcuggucaucucuacaugagcaguuugucccuccaguaaauuguguauuacaguuaaaaagugaucucgcaguucuuguguauuuuauguguuuaguacacuaccauaaaccuugaauaacacaaggggggcccauacaaaaugccacuagugaugcuggaaguguucccgagaaggaaaguaugacauuacaagaaaaaguuaaguugcuugauauguaccauaacuugaggucugccaccacaguagccaccauuucaaacagaugauucaucuuggaaacaggcaacauaaacauacagcaucaauaaauacaguacaguacuauacauguauuuuaucuuaugauuuucuuaauagcauuuucuauggcuuauuguuaagaagacauauaacauacaaaauauguguuaacugacaguuuauuuacugguaaggcuacuagucagccauagaauauuaguaguuaaguuuuuggagagucagcaguuauauguggcuuuucuaauucauguggaguuggcacaccuaacccccauguuguucaagacucaacuguauaugauuuugguacucuucugugugcauuuuguacucuuuaaaaaguauacagacaccaaaaaagucuaaaccuaggcagauauacaguagugguguuauuguuucuguguaaaaucucauuuagccuuuucuacaaauguuugagcuagguacugccuucccccauuuuuaauugaaaaacuacaguucagagauguuaccuugacaggguaauccaagcuguagguugcagagccaagacacuuguauaggucuucugauucuacauccagaccucuuuucacaauuucauaaauaauugcaguccugcugucuuuuuaaggaagacauuauuuuguggaagauaaucuuucauagaaaucaaauuaaagaaaaucuuuucuuauugguuaccuuggucagugauucaaggcuaguuuucaagacuguacuugggaguaaauguauaucaauauuucugucugugugcuuuuauauuuuuauuucuguucaccaagaguuuauacauuaauaaaaauuaucccugauucaaaaaucuugccuaaaauugaucuagaacuucuguuucucucagguuauauuaaucaucauggaaagaacaaaacaaaugacauauauguuaaaaucaagauaaucaaauacuaaauaucccuauaaguucuggcguuacaaauauauaaaacuaaaauauucugacaauucaggaauauuuaauaaaaauuacuauuuuaaguuuaauucguaaucacuuauaggaguggguuauuuuuaauuuauaauuuuucacuaggucacuggauucuugccaguuuuuaagguagucaaaacagucuugcauguaauaauaauaauaaugauuuauuaagcaccuauuauaugccagaggaucugcugggcauauuuguuauucauuuaaucacuuaauauuauuuaacccuuuuuauuuagugggcagucaguuauuauuuguugauuuuauuuuauuucaggacucuuaaccuacucuuggaacuuuccuaaaacuauaaguaucguuaaauccagugagugcagacaguguuggggaugucuuuggggauuuaguuauuauuuuuuaugaauuaugguugggcuugacagcuguccuuguguugacagcucuucugauuauagcaguugucaaacuccauccuuaagcagguuguaaauccuggcuccuuccgauuaaaacuaggucagagccaaucgcagguuaacuagaggccgguauucuacuacuguacguccuuacuaguucauucuaaauaggcuuuguguggcagcauacuaaaacccuuaugugccuauauuuuaccuggguuuuuuuuuaaucuucagauauugguccuccuguuacuucaugauuaaacaugguccuugcugaagaguauauugguauaaguauggucuuacuuauaaauggccuguuagccuuccccuccucuuccuccacugggaauacuaauaucauugcaucugugucucccaggggaaaucaaggcuuuuccuugcacgugcagucaugugauuucagagugggcaggcuuuguauccucaugagcccucagucuuccacgcaaagcaccaucuguucuguuaccuccacacuguuacagggcagugggaggaggcauuagagugaaaauaaauaaaauaaaaaaaaaaagaaauucauuaucaaaacccugaggauuaauggagucagaaggcucacugcucugaauggaaauucaucuucaccugugccagugucagggcugccucuauggcacuugacaaauagagguucccaggguaccauaaauucagcaacuguucuaaucccuauagacuugcucaagcuuuucugagaugggcuuaugacuguuuuuguauuucccagcacauugugggcaccaguauauccccucauuaauuugguaaaauguuagcacccuuuccuccucauuuuucucucauauucuuugccuuugucuguuuugaaagggugggcagaguacacauuucugaaagaugacucuacauuaugacuuguguuucacugaacaugccaaaggcagagaaaucaauuaacuaaugaauuuugagcaaacaguaagugcccagcauuaugcuagauggagaagagaauacaaaaagaagcauauacucaaguaguucagcaucucauugugggguacaaagcauauuuuuucaacaacuauuuguugggcaacuauaugugcaaguaggcucugugcuaacauaaacauaauggaugccucucaacagugagucuccaacagauacugcaaguggccuccucauaucaggauaagaugcaccugugugguuuaaaaggacccuuguccuuuaaguuauucagucucauucuuuuuuaucuauauaacuuccucauuguuuaugcugucauguaagucugucuuugcauaacucccaggcauuuguuaauaaaaccccuuucauaugaaugccauauuucuugcucugaauuacuguuuugccaccuuaaauuccaaauucauaucucacauuauaguuagaccugagcuaaaauuucauucacaucugucaaguuagggaauuauuauuagccucagguagcauuuucauagcugguugacuagaguucccuagauguggaacuuaaauucuuaagcuccauaccuggguuggugcccauagauuauaucauaucucaccacuggaauggucacaucaucauacagcauaaauguaauuaaugucccuuugucugagauggccaucuuuugugucuucagccauagcacacaucuacuuagcccugaucuucucgcguaacuguuggguuggaauugagccaagcgugaucugacagaucaugaugguuauuauuguguauuauagauuuauacaaugggaaguuuauucccaugauacugcuaaagguccuauuuuaaagccuaaguguuucuuacaauaaguugagacuaauaacugcaguguaaagguuaaaguagcuaguucuaugcaggauaaauagccuuuuuuucacagcuacuugauauaaggcaaugugucuucaacuuuguuguauuuuauaagagauugucuuucauuuuaauccaauuugguauacagugauucaugauaaaacccuucagaaguuuaaaauuaaaauguugacuaaaauuauuuuugggccaggcacaguggcucaugccuguuaucccagcacuuugggaggccaaggcaggugggucaccugaggucaggaguuugagaccagccuggccaacauggugaaaccccaccucuacuaaaaaauacaaaaacaauuagcugugcuugguggugggcaccuguaaucccagcuacucagaaggcugaggcaggagaaucgcucgaacccgggaggcagagguugcagugaaccaagaucgugccauugcacuccagccugggcgacaagaguaagacuccaucucaaaaaaugauaauaaugauaaaauuauuuugggaggcaauuuuaaagucucaaaaagauacuauaauccuaaacacucucuugaauccucggccuugguaaagaugauaccgucucuuccucccugucuguggcaucccucaagaugaagaauagcucuugagucucaggagcuacccaaaacuaugaucucagccaaucagcagugacccugggguuggaacaggcaauucuugccugccucuauguuuucuccuauucuccauucaucagauauuaauaucuguaucuugguagccuucuaagaaaccccacaucgcugaaggcagagauagcauucacaaaugcucugauuuuagcucacaaaaaaaucuacccuccacuuugauucacuuagaagcaccucugaguuuauaugguuauggauuagaguuuggugccuaagcuugucaggauaaguaauguaaaggaucacaaaauauaucccaaguaccuaucacaaccugguuuuggcugucggcucugugcacacuucacagcacauagccgugaagcccugagcuggaaguacccacacaaggagaaaagauggucaagggaaccagagaaacuacuuuaucuuuaccuaaguaccguuagagagcaaaagaagaaauaucacugcuaaaucauuuaaaacaaaccccuggggaguucugcuuccacuauuaagauguagaaaacugcaagagaacuucauucucacccuaacaaaagaagcacaagccaccacacccagcuaauuuuuugcauuuuuaguaaagaugggguuucaccguguuagccaggaugguuucgaucuccugaccuugugaucugcccaccuuggccucccgaagugcugggauuacaggcgugagccacugcgccuggcugagaguucaccuauucuuugaagacaggcauuguuuucuccuuucuaguuaugaaaauccuagauggcaucuuuuuccaguaugaggcugauuugucuacacugaaaaucuguuggcuggacaugguggcucaugccuguaaucccagcacuuugggagccccgggugggcgggucacuugaggucaagauuucgagaccagccuggccaacauggugaaaccccuucucuaccaaaaauacaaaaauuagccagucaugguggcacauggccaguaaucucaccuacucaggaggcugagguacgagaaucgcuugagcccaggaggcaaagguugcagggagccaagaucgcaacacugcacuccaaccugggcgacagagugaaacucugucuaauagaaaagaaaaaaagaaaaucuguuguguaguauagccauccucaucaguuaucuuuaucuuaguuagaucuucuggauaacuugcucucacuucugcaucagcacuuacugcuuuaccuugcacuuuuauuuuauggagacaacuuuccuucaaccucaugagucagccucugccaacuccuaacuuuucuucugcaguuucuucaucucuuucagucuucguagaaugaaagagccagagccuugcuguggauuagacuuuggcuucaggggauguuguggcugguuugaucuucuacccagaccacucagacuuuuucuaaaucagcaauaaggcuguuuugcuuuccugucauuuguauguucacuggaauagugcuuuaauuuucuucaagaacuuuuauuuggcauucacaaguuggcugacuggcacaaaagccuagcuuuuguccuauguugguuuuugacaugccuucauuacuaagcuuaaucauuucuagcuuuugauugaaaauaagagaugugugacucuuccuuuuacuugaguaaaaggauuggaguucauuguaggauuauuggccuaauuucaauauuauugugucucagggaauagggagacccaaggagagggauagacgagggauuggcuguuccaugguacagucagaacacauaaaacauugauugaugaaauucauauuauaugggugcaguucauggcacccccaaaaaauuacaauaguaacaucaaagaucauuuaucauagauccucacaacagaaauaacaauaaugaaaaguuugaaauauugugagaauccccacagugugacacagagacacaaaaugaacaaaugcuguugggaaaauggcaccgauagacuugcuuaaauauagaguugccacaaaucuuuaauuugaaaaaaaaaaugcauuaucugugaugcacaguaaaguuaagcacaauaaaauaaguuaugccuauauaaaauauuuugaacugaaugaaaaugaaaacacucuugucaaaacuugugggaugcuugggaggcugaggcaggagaaucgcuuaagccaggccagggaggcagagguugcagcaagccaagauugcaccacugcacuucagccugggcgacagagcaagacuccgccucaaaaaaaaaaaaaaaaauugcaggaugcagcuaaaccagugcuuuaaaggaaauuaaauacuauuagaaaagaagaaagauuucauaucagugauccaagcuucuaucucaaaaaaagaagggcaaauuaagcccaaaguaagugugaaacaauaaagaucggagcagaaaucauugaaauagaaaaucagaaaacagaaaaucagugaaaucaaaaacugguuguuuguaaagaucaauaaaacauaguccucuagccagaccaaggaagaaaaaaaagagaagaaacaggcuggaugcuguggcucacaccuguaaucccagcacuuugggagaccagugcagaaggaucacuugagacuaagaguucgagacccagccugggcaacauagcaagaccccaucucuacaacaaauguuuuaaaacaugccaggcauaguuguuugagccuguaagucccagcuacucaggaggcugaggcaggaggaucacucaugcccaggaguuccaggaugcagugaguuaugauugugccaccgcacuccagccugaguaacaaagugagaugugacaccaaaaaaaaaaacaaaaggcaaauuaccaguuucaggaaugaaaggauaucaguacauauccuaaagauauuauaaagcaaauaaggaaacauuauacacaauuuuauaccaaugaaauagauaacuuaaaugaaauggacaaauuuauuauuauuauuauuauauauuuuuuuaagucagggucucagucacccaggcuggagugcaguggugcgaucucagccugcucacacuucaggcuccaccucccagguucaagcgauucuccugccucagccuccggaguagcugguauuauaggaaugcgccaccaugcccggcuaauuuuuguaguuuaguacagacaggguuucaccauguugcccaggcuggucucaaacuccugaccucaggcaaucugccugccuuggccucccaaaaugcuacugcuaggauuacaggcaagagccaccgcaccuggccaggacaaauuuuuuuaaagacacaaacuaccaaaguuuucugaaaaagaaauagaaagccaggugugguggcucacaccugugaucccagcacuuugggaggcuggggcgggcggaucaccugaggucaggaguucgagaucagccuggccaacauggugaaacccugucucuacuacauacacaaaaauuagccagaugugguggugcgcaccuguaaucccagcugcucgggagccugaagcaggagaaucacuugaacccgggaggcggagauuucacugagccaagaucgugccacugcacuccagccugggcaacagagccagacuucaucucaaaaaaaaaaggaaauagaagugcaugccuuuagucccagcugggaggcuuggggaagaggaucacuuggagccaggaguucaacacugcacugcacuaugaucaugcuugugaauagccacuacaucuagcuagggcaacauagccugacuccaucuuaaaaaaaaacaaaaauaaaaaauagaaaaucuggauagcucuauauuuauaaaagagauugaauuuguagcuagaaacuuucccacaagauuuccaggccuugauuacuucacuggugaauucuacugaguauuuaaggaugaaauuggccaggcacaguggcucaugccuauaauccuagcacuuugagaggugaggcagccagaucaccugaggucaggaguuugagacuagccuggccaauguggcaaaaccccgucucuacuaaaaauacaaaaauuagcugggugugguggugggugccuguaaucucagcuacucaggaggcugagguaggagaauugcuugaacccaggagguagagguugcagugagccaagaucaugccauuugcaccauugcacuccagccugggcaacagagugagacuuugucucaaaaaaaaaaaaaaaaaaaaaauucuacacacaaacacuuccagaaaauagaaggggagggagcacugcccagcucauucugugaaaccagaauuacccugauaaccaaauccagacaaagaccuuagaggaaaagaaaacaacaggccaguauuccuuaugaacauagaugcaaaaauguuuaauaagauguuagcaaauugaaccuaguaaauacaaaaagguuaauaaauuuugugcaaguguguuuauccuaggaaugcaagguuuguuuggcaauugagaaccauaguauuucaccauaugaacagaucaaaaaagcaaaaugugauuuuaucaauuuauguagaaaaggcugacaaaauucaacuucccuucaugauuaaaacaacaacaacaacaaaaacucacaacaaaauagaaauaggaaauaguagggaauuucuuuagccugagaaaaucgacaguuaauaucguccuugaugaugaaaggcugaacacuuucccucuaagacuguggacaaagauauccacucucuccacuuugauccaacauuguauuaaaaguucuagccaaugcauuaaggcaagaaaaagaaaugaaagccacauagauuuaaaaagaagaaauaaaacuuccuuuucucguaggugauguguccaucuauguauaagaccccaagaaucuauuaaaaaaaaaaaaccuagaauaagugaguucaccaaguucacaggauguaaaaucaauauacaaacaugaaaaguauuccuauauacuaguaaugaacaauugaaaauuaaaauucgaaaacaccagggauaguauacaaaucuuaauuguuuuucuuuaugcuuacaguaaauugaauuuuuaaaagauauuauuugcaguagccucaaaaacaugaaauucuuagggauacaucaaacaaaauaagaguaagauuuguauguguauaauuccuaaauauuaucgaaauuaaggaaaauuuaaauggaaagagauaccauuguucauggaucaaaagacucaguauuguucagcuguccauucuuuccaaauugauucauagauucagcggggucccaaucagaaucccagcaggaucuuuguaaaaacuuauaaguugauucuaaaauuuauauggaaaagcaaaggaccuagaauaaucaaaacaacuuugaaaaagaauaaaguuggaggccccacacugguuucaggacuuacuauaaaguacagaaaucaagccaauguuguauugguauaagaauagguauauagaucaaaggaacaugauagauaaccuagaaauagauccaaucacaaauggucagcugauuuuugacaaaaaugccaacauaaaauucaguggagggaagacuagccuuuucaacguauagagcuguaacaauuggacaucaaaaugcaaaacaaaacaaaaaggugagccugaagccuacucaaaaauuaacugggaagguaagaucuuagauguauauguaagaggaauaaugauaaagaacuagaagaauaucuuugugaucuugguguaggcaaaguuuuuuuuagauggaacacaagcacaaacuauaaaagaaaaaauaaauugcacuuuaucaaaauuuaaaaauuccacucuucaagauacucuuaaaaaaaaugagaagucauauacugggagaaaauauuuauaaaacauauauuuggaaaaaaaaauuuuguguccacaacauauaaagaccucuuauaagaaaaugacaaccuuauuaacaaaugaacaaaagauuugaacagauaaaucaccaaagauagauaguuggcagauaagcacaugagaaauguucauuguuagacauuagggaaguacagauuagaaaucacaaugaaaagccaccauagaccuaacuagaauggcuaaaaaauauuuuuaauaauaguaaagugcugguaagggugcaaaggaacuggaauuuauacuuauuggugugagugaaaacuuuagaaaaguuugguaguuuccuggaaaguuaaacauucacuugccauaugacucagcaauucuacuucuagauauuuacccacaagcugugaaaacauaaaacaggacaacacaaagaccuuuacccaacuguucguaagaucccuguucauaaugccaaaaauuggaagcagcccagaugacugcauacaugcauacaguagaauacuacucagcaaucaaaaggaaagaacugauacuugaagcaauguggauggaucacaaaagcaacaugcuaagugaaagagaccagauacaaaagacuaugcuauaugauuucuauuucuggaaaaagacaaaacuauagggacagaaaucagaucggugcuugccaaauuaugccacuccacuccucauaaaugccuguggaucacuugacaaaacucagacuucuuagugugaccgauucaaggcccuagauaacuugacuucaauccaaccucuguacuuucaacucuuuguacugcuucccugagccagcagagacaguucuccagcauuccuugucaugccucuccuagugguauuuucgcauucugcaaugccuuuccuucucagaaauuuugcucgauccuucaaagcucaucuuacaucuuacuaccaauuuguaguguuuccugaucccucagucuccuccuuccucccugccuuugcaguguauguauuucugccacauuucuuauucauucuuuuguguuagaauugguuguuuacauauuuacaauccauucugaauagcaggaaucuuaccuguauuccugacuggacugguacaguaugugcucaauaaaauggcuauagggccgggugcagugguguaugccuguaaucccagcacuuugggaggccaaggcgggaggauugccugagccuaguaguuugagaccagccugggcaacaaagugagacucccaaagugagagccaagcaugguagcacacaccuauauaguuauaacuacucaggaagcugaggugggaggauuugcuugagcccagaaggucaaggcugcagugagccaugaucucgccacugcacuccagguugggagacagagccagacccugucucaaaaaguccgugaaauucagcuccauacccuuucucuugaaacaaaugagcaacaacaacaacaaaaacccacacacuguguugugugauaaucaugcugcaaaagaguauauaaaauguauaugaagaauuuaaacaaagcuuuuaaaaauuuacccacuacuuagcuuaagaaauagaacaucaccaauaucuuugaaccuccugugcaugccucucaaucauauggccuucccuagugguaaucuuugagagauuaccacuaucccaaauuuuauauuaauuaaugauuuccuuuguaguuucaguacauauuuguaugucugaaucauauucuuuaguuuuaccgguuugcaaaauuuuguuuaaaugaaaugauaucauauguauucuucucacuuguuuuuuucccuucaacauuauguuuuggagauaaacccauguugugugaagcuauaguucauuaguuuccaguguucuacaggauuucauuguacaagugaucaauacuuuauuuauauguuaccauuaaugagcguuugggcuguuuacauuuggggucugcuguguacaugcuugcaaauaucuccuggagaacauaugcaaaaguauauaacuagaaguagaauuacuagguuggaggguauauguguguuuagguuuaaccuguaaugcucuaguguugucuaaaauagcaacaccaguguacacucugacaucuaaagggguuucucugcuccaguccuuaucagugcuuggcauugucaaaguuaauuuucaccaaucuaguggguaugaaaugguaucuccugguuuuaauuuucauuucccugauaauguggaaugcucaucuuuuuauauguuuauugccauuuauguuucaucuggugccucuuuuugccuuuagugagucccaguugucucuacaccaucuaaucauugggucuuuauuuccccacugaucugccagcuuugucaugaauuaaguuuucauaugugugcagaagaauagaucacccucuguucuaagcuucuggucuguuuuuccauuuuggggcaauaccauaccauauuuauaagucuugauaucucuacgcccuuuuuuccccuuccuguaccuugaacuuaucaguuacacccauuggugccuuuuuuuuuuuuuuuuuuuaguuccuguagaagaauggucugauuacugggccagcuuuuuuuuaaaaaauuuacaaauuguaaaguucaguuaguuacccacuuauccccucuucaaaaacaaaacaaaaccuuuuauuugacauuuacaguauuuuuagccuuuugacauauccugcacauguaucauuauucugaaauaaagaucaaaguaaaauagauacuuaaauacuauuuuuuauuccuuuccuuaaucccauucuuaaagacuagagcccaaaagccucacaauuuagaauauauauuuguuugcguguguguuccuagacaaccaaaaagguaaauuugauuuuccuaaggcuugaaaaucuagcauaauaccacaguucucauuaccaggccugaccauccuucagucacuguaacauugcucauuguucaguauuccuuauugcucagcacuuuccuuuccugcugaaguagaggaguuucucugucucuugguaaacuuguuuucauauuugucaauuuuccuuucagccucugccugugaguuucuggauauuguagagcugcugcuccagucuggugcugaccccacucuccgagaccaggauggcugccugccagaggaggugacaggcugcaaaacaguuucuuuggugcugcagcggcacacaacuggcaaggcuuaaucaaaagacuggaaaacugcagucuguaauagcauaaggcuuccauuaugaaagaaaacuacaaaaauaauacuucuuuuccacccgucuuugguauguauuggcuaauaaaaucaguucuguggaacugggauuuugaagucuca

SEQ ID NO: 191151 - RNA, 189016 nt, Homo sapiens
uucaauugcacagauauuuauuggguggcaccaugcaaguuaaacaacucuuugcaaggcacugugaaguuaaauacaacaggcaaauaauguccuuucaaagggaauguuguuccuuaguacagaacaauggccaccaggguuuaggcaugcucuccucccaccuggaggcucccacugacaucugaauucuucuuuccacagguugccuuggauucagugaccuguauuuggggaaucaaaguggagagaauagaaauguggguaggaaauuaacuagcaagaacuguaugauaaaggaaaauauucugguuucauuuuaaauuuuucauuugaaaaauuauuuucacugaguacuauagccauaucagcauaaauuuauaaaaaagagaaacaaaucaccuaauaucuuacagccauaacacaaucacuauaacauuuggacaaauuacucugauuauuuuuuucucuaugaaucuaaaaauuguuuuagauaaaauuuacaugaaauuucccauuuuaggccaggcgcaguggcucacaccuguaaucccaguacucugggaugccaagguggguggaucgcuugaggucaggaguuugagaccagccuggccaacaugguguaacucuugucucuacuaaaaaugcaaaaauuagcugggcgugguagcacaugccuguaaucccagcuaccagggaggcugaggcagaagaaucgcuugaacccgagaggcagagguuucagugagccaagaucaugccacugugcuucagccacgaccacagagcgagacucgaucucaaaaaaaaaaaaaaaaaauuagccagggguguuggcaaaugccuguaaucccagcuacucaggaggcugaggcaggagaaucacuugaacccgggaggcggaggcugcagugagucgagauugugcauugcacuccagcccgggugacagagugagacucugucucaaagaaagaaaaaaagaaaugucacauuuuugcuauuuuaaacugugguuuuaguauaauauauuuacuaagggguacauccauuacuauuaucuaauuucagaacauuuucaucaucccgaaaggaagccuguacuuguuaagugggaaucccccauguacuccuuaaucccuggcaaccacuaauuuaguuucugucucaauggauuugccucuucuggacauuucacauaaauggaaucauacaauauauggcuuuuugugucuggcuucuuuucacuuagcauaauguuuucaacguucaaccaugcuugagcaugaaucaguacuucauuacuuuuuaugaucaaauaauauuucauugugaggcuauaccacauuuuauugguucaucagcugauggacauuuagguuguuucugcuuuuuggcuaguaugaauaaugcuacagcaagcauuaauuugcaaguuuuugagugaacacguuuucaauuaucuugggucuguaucuagaaguagaauuacuaggucacaugguaacuccguauuuaacuuuuugaggggcagcuaaccuguuuuccauauaugcauuuuuauaguuauaaucagggucaaaagacaauuuuguaccuuuuaugcaauacauuaagcguuguucuuauuuggucaguuguacccuuuucaaaaucaauucuucucuuuuauaaacuuggaugaauuccccuuaucuuuauuaucaguaguguggcucuucaagccauuguucaaauuuauuaguuggggcuuagauuauauccuaagcggaaaaacugagcacagcucaucaauacaaaaccugcugugcugauaaugagaaacuacagcucuacuguagcaucagcaauaauacaaaacugcauuugaggcaucgaccuuggagaucugccuacuuuugaccucagaagucuaggaauggcacacucuggucacuccaaauuugcuacucaucaugagacagcaguagagaggcuugcaagucugugugaaagcuuuggccccuaaaucauggcugcacaccuacauaccugcauucuuucuuuuucaguaaagaugugagguugccagcugggcuucagcacucacuggcuguggaggcugaagcgcaaagacaagccaaagugcgggugagcacuccauccucccacccagacugcccuuuaggaaggccugcucguggagaacauuuccccuuugcuuccuuacuguccauucauuaggcacugggcagaagcugucuugggcccuuacaacucuauuaaaauugcucucuuaaaguguguuaauaguccccugacuaaugcaacuccucucccucucugaagcuacugauaauagugaccacucacugcuugagucucaccuucccucucucuccuuaaaggcaucuccuccacacacaucaaucccucuucucuagugcuggcaucuuuuccuggguaaucguagucacccuaacuucuaacuucuagguauccccuagaacuguaucccaagcuuggcacaaguuuuagagggacaaccacgaucagggcccaguucccucaaugcuagagccaagagaaggcugugcuacucggcuccacucaggcaugacagcaagaggcaaagauguggcagcuagcagcuucugguaacugaggugugggugagggggccuugggaagaggaaagugaagaaugaagggaggcagauuucucugaaagaacagagagcaggugaagauaaaaaccugaaccaguaagaggaucauugccuguggaucacugaggggaggcggggaugaggaaggggaggaggauaguccccagggcaguugcuucuagaucucugagugaaguccucuucacccacuuucagguagcauuuguguagugagcucagcacuuucacuucagaaauguuuacccauucacuuucccugaguugggggucacccuuucauaacgucaugccuuugcauggaaugcuggcuaaucuuuucucuauguuggcaaaauccuaaucuuucaaggcccaccagaugcuaauaacuccccuaauacuucauuuauacuugugauggcuccuaacgcauuccaccuuaaauugugauuaacaguuuaaucugucuccccagcucaagacccuucagaaagaagaauaaacauguucuaugcuuaaccgugcuugccacauaguagaugcucagugcuugucugcugagucauacugcauaguggugaagccuucagggaaugaagaacaaucacuuugcuuucgucacauguuuucuagaugauugcugcagaagcggaaaaggcugcuucugagucccugaggauggcagcugagauucugucaggcaccccugcugccguucagcuucgauaccuccacacccuucagucucuguccacagagaagccuuccacugugguuuuaccuuugccauuugaccuacugaauugccugucuucucccagcaacagaacucagggaagccuccccuucccaaguccuuccaaaccuguugagccacuaaauccuaaaaagaaagacucucccauguuauaggaaggauggggcauaaugugacuguaaaggggccugccauagaaaagucacaugccugagggagacacucuguccucauucccugcccuuccuuugguugccauauggaauggccauggaaugcacgaagucacaaugcaccauccaugagaagacggugaaaugauguaaugacagagaaggcagacaacauguuuccgugacucaucuagucagagcaauuaugggaaacagcuuuggucaacauucuacuuuggaaagaauuuugagucuagaugugguuaaauuuugacuucugggaacuugguucagaugucccuuucacuguauguccucugaccccuuuggcaagguugccacagcucccacagcccuuccuacaagcaccuaucauugggcuugucacacucuauugcucuucugucccaaagaugcagucuucucuccaaugauacuaccaagucuuaguuuuccucaaccacacucaaucuuuuugcuccacccugaauuccucacaccuaacccugauaguuaccuaaagugacacuuaaauguuucagagugaaugcaaaaaagagagauguacuuggagucggauauacaauuuaucccuaauuaaagcauuuaaaaggaauucuuuuuguggagauuccuuuuuuaaauaaagaaauaaauaaaaggacaaaaacaucugacacauguggcuuaaaaucugagggagaaucacuauaaauagugggccagagaguaaucuauuuucaguauagaacuuaccagcuuguuuauuucuucgaacaguaauaauauuagguaaccuacacaugcccugacauauuguuuucuuauacagauauuucuuaauauagauacauuucucuaagucuuauuuuccauuaauuugcauuauacaauuagaaaugcauaucugcagaaaaaauaagccaauaagaaagcauaucuauacuuacagcaaauucucuauaaacuuaaaaaagucacuaacauuauaaaacauuacuaacauuacuaaaauaauguuaguaaauucugaagccaaaggaacaggcaaaucucuaaacuaugcaggggugccgaaauauggaaauccaaauguggaauccaaauggcucucauauccaaauaagucaaaggcagguaacaaaaucuaccagacccaggaguauggugucagaaacaagaaagcaaacacugaugaagcagcaacaggacauggguuggggaacuccuaggugauuuccuagaaugucucaucaucuaggauguggagcuugcuuucauggaccagccggggcaugaucauaggugguuuagcccauuuaaagggucaauggcaaucagagcacuccugaagugggaaauauuucucauuaucacuguguuggcccacacccauuccaguguauugguuauuggaauuaagauggcaccgaggguuguuggucacuuuucacaccauauaugacgguuccugaucucaggauagcaaauuuuggcauguguaaugaagaagaagguagagucaugcugggucaggcauaacagaagccaaaagcagaacaagcagaagugaacaccaggguaaaaauggcuuuuaugacucuucauacuuccuuauaacacugguuuuuugucaaaggcagauuuugcuugcauaucuggggagugccuaugguaucuccuauuguuugguuuccucugaugucuggcacaggucaauauuuaaauuucucauuggcaugccagagggcuuucaggucugcuugcuggcaugcguugucuuucaaauuaaccaacuguugcaguuggugggcuugauaagaaggaaaucauagcgauaaguugcuauaaaacuguguuuaggugaaagaguauaguggauagucaaagguaaaauucuucagaaacuggcuaggugagcugacccaggugcugcauuccaacugguuacuaauugugaaaugauggcuggaggacaagcuggagaguacaaucuaaaaccaugauauguucuaggaauaguuuuuuuuuuccugauaauuuaauauuaauagaguggcaauaagcugauaaacagggauaagauguuccaguuuggcauuggagccugccaugaccaaaaugacaugccccugagagugggagaagucuauggcacacucuaugacaaugguguuccagggcauuuggagcugacagugauguggcauugguguauucagaccugaauuuauuaugcaagcagcuagcuuaagggcugguauacugcagauuguugggcucaaaaucaucagaaauguggaggcuuugaaggccuuccuuagaaauucaagggccaccauggcucaccagugguguuauggugcaaugggcgcucugcaguuuggacucuccuaucuagaaggcucagcaggucauucugccaauacgccugcauuccacauccuuggggaccaugucuggauggcucugaguaaguaugcaucuccuugauggacuguuccuggccacuacaauguucuuuggcagagagucuauuggaauuaugagguuccaauaauucuggcuuuugcacgguagcugagcugagcauuaaguaaaggacauggaagccaaauccuuuaaaagagaggucaucaacacacuuccaacggcuucuucugggcuuggaaagauauuacagcacuauagcugggagcuuggggucugcugucagacauauuagauuugauucaggcucuaccauuuacuaacuguuuaaccuuggacauauuacuaauccuguguauaaauggggauaaaaguaggauccaccucacagaguugugauuaaauaagauaaugcauaugauaugcuuagcacaaugcuugcacaagguaaauucuuaauaaauaauggugauuacuauuauucugguuuuacuucaguagcaauaaaugacagccaugaggcugcauccaaauaagagccugcuggccccuccacauguugccuccaugugugaaaggcagccccgauggccaguagugccugcucccagggugguuguucuaggacagaaccagcuuuaaaacuugcacauauggucuccuguuuuugauucccaccaugauauaacaagcauuuguuucaaagugcacagcuguucgggaucauaguagagcaaaaacaggacagaaaaguuuuuccucuuggugggcaauaguuacagccaaaacucagacaaucccccuuucuuucuuucuugccuggguuugacuguuuggauggccagaguggaaaaugagagcugaauuaccaguaguaccuugugaacuccaggaucugucagacuucuggguaggggguagggauggggacaguuugccuucuaaaaaucaguuugccuuggcaagacagaucauggaaacucuuaaucuucagacuuucaaaaguguuucucaagcuggccuagagguagccuaaaguauaacucugccaggucaggugcucgugggacccaaaccuggcaaauaccagaggaugcccuccaaaccgacagaagccacugcagucuugcaggugcccuuucauuggacauuuaagaauagaagcauuguccuggcagaauggcacauugcuguauaaugggacugcuuagggcacuucuggaaggcugccuuacacguucuuugcugcaccauuuuagacaagcugcacuucucaaaaaccugcacucugcauaguucaucuuugaggucagagggauuaguaggcuugcuuagcaauccugaaugggagcuugccuugaggcuguggcagaccuggcuagaaugagcucuacauuuuucugaggcagugauggaaauccugaugaacccuagacacagcuucauaucaauauagcuacagaaugccucagccucaggcucaccuagcaagcacugcaguuuugcagguaugcagggccuacgcagcagggcuacagcaguuuuauuccuaauuuuagagaaacuccucugcuuccucuggggaaauacuugcugguagauggauacuuauuugauuucaggaauacccagacagugaucuagagcuuuggggccugcaagcagaauuuccagcaggcuuuaaaagugaaaugcaagauauguuucccaaguaguaucugggucauugaccuccagcuaggaaaggccaaggacaagaggaaagugcagucacugaaugcuacaagguagcagacaagugaccugaccauagucaagucagugagaccaauugugagagugggaccagaucucucaggggagaaucuccuggagcccacgcgcacugaguugcuguagguauguggugaagagccaggccuggugguugagggggacuguccacuaagcuuucuaagauccuuaaguacacuaugguaugcacucccaaaacaguaccaacucggcacuacaggacauggaaccugucgccacugagauugggggcugggacacagaggaguaugaugaggcuaaccaguuuccucucucugaagggccagagcagcuuucuagaaaaauggacagcauggcucggucuggacaucuaaguacagaauggcuagucucccauaugcaagcacaacagccucacucggcagccugacugccagugaugagcagcagaaguuccucccuccacucugcuugggagaccacuucagggacacccugagaagguguggcagggucucaaggacuauuuaaaccuucccacaaagcaguuacuugggagaguggaacuggccaggcuaacuugcagagagcagcagugcaggugcccucccuggggcauacuuuuuuuuuuuuuuuuuaaccaccuaacacucauuaugucuuccuaaccccacccugauuuccuuuccccauagugugucccaucuuaguggaagagcaccgcaaggcguccuuccuucacuuuaaggaagccagagagaccugugaagucuucucaacaucccugguucauccauagggagguuugugaccacaggguagcuuuucucucucuugggacuuugagacuuuggcagaauaauguaaggaugaaauaaaugauugguguuuguuuggugguagcacuggaacagauggugaggaacuauugugccugaucuaaagcuagcugguuccugucuguucccagccuaguucuucaaaacuucccuucaaauccuugaaccccccagcauccuuucaauacauuaucuuuuuucaugggcuugcaagaguaggugcuuguaacaaaaccaccucagcuaauguggguccaugaugccaaucaccucauucuaauuguaguggcagcagauauaacucuggaauuuagagacuaagccuucuacgcaauggagcugacaugguauuuggcacauucuaagggacaaggcucauguucagggauggggccuacugauuuguauggaaaugacaacucaugccugcaaaguggaaaaucaauaaaaauuauucugcaaccccacaaaaaguccccaaauuuucuagagcuauccaggaauuucucugggaaggagcaaagauaaggcuggcucuguuccgucaggcagcagcuguaauuaugagccaacagcuucagcucgucugucauuugggccaggagcacugccaaguuucugaagaauuucauguuuucuuuucgcagagguaaagaguggaacugaccagacuccaucuaguagucuuagguauauacuaaggaauguugaaacccaucccucacacaguuuaaugauggccaaugacaggccuggccaggguuggcuuaaauaaagauggggacucuagaguugggauuucugaggcuagaagaacagguaaaggucuaaaauucuaggagauaaacccaaagaaacaccaaauauguggaaucaaugcagguguagaaaucuugccacagguguucagagauaagagcaaaggcaagugagccaggagcagugaggcagcagggagcccuugcugagugacugcccagaacauccaguugucacuugcaacugauuuuugcagguuaguccaucucuugugccuagauggauucagggucaugaacagagcagacaaaugagacaguaaaagcaagaaauagagauucugggugaaucuucagcaacacaggccccuaugaaggaaaccaucugaacaauggccugguggcccuucacuauugugaaacagucuagacaugaguccagugagcugggggcucugacaccaaucagcucugugaccgugucuuauaaucacugggccucaguuuuaccuucugagaauaucuccuccaccuacuuugcaggguuauugcaaagaucagauaaauuauaaaaaugucagaaaucauaagaaauccgaaaaugcugcagaaaccuaacagcaucgucaagauuuucucucuucucucuuuuuuucuuuuucuuuuuuuuuuuuuuuugagauggagucuugcucuguugcccagguuggagugcaguggcgcgaucugagcucacugcaaccuccaccuccuggguucaaacgauucucaugccucagccuccugaguaagcugggacuacaagugcgcaccaccaugccuggcuaauuuuuguguuuuaguagagacgggguuuugccacguuggcgagucuggucucgaauucuucaccucaagugauccucccaccuuggccucccaaagugcugcgauuacaggcgugaaccaccgugcccagccuagaucuucucuuuuaaauugaaaaacuaauguuuuuuuauuugccagucuugucugcagaguucaaaguuuucaaaaagcauuauuuucucgagagaaacugacauuucacagaccucuguuaggaaaucaauugaagaggcuaacaaacuugcauaagcuauuuuuaaugcgggaagugagcuaaugcaccugacucccuacagccaucgcugugacuuaaagagaaaaugcucuugcguuguagguuauggcuuuucuaguggcuguuacaaagggggucccuccaacugagccacaucagcucuauaacgcagugauaucugggguguguucaguggauagagccauugugaaccccagagcucuguggacacuacuuggguuuuguuuugucauuggauguagucuggauuccagauuuaauguugagagcaccguccuugcaugguaccucuaaaaagacaaaaacagcuagaauauuguaguaauaauaucuuauauuuacuaaggguuuuuaauuuuacaaagcaguuuuacauuuuuucugccuggguaacccucaagcuacaaauaagcuaugugccacaaauuugacucuaaauugguuauuggcauucagaaugcauuucccaaguucaaguguggucauuuaacuguuugaguucuggguccuggggcaggacagaauguggucaaggagugaagaagagaaagaacaucuccuccuucccucuuguacacaaccgaagcuuggugaaaaaaaauucaaauggaaacagucuucagaaucuucccuuaaccauuccugagcccuucuguugucuccccaacccuuucuuuccaggcuccugugcacagaccuugauggccucuggccaucaagccugcuccccccaacaugcacgugaaaaacagccccgugacgcugcuucccaauuugaauccuucagacuggcugcugccaucuccaucuuacaugugguugccuuuguauuacuauuugcacuuuguauuacuguuaguguaacuucuccacacccaacuguagaccccacugagauccaggacuaagccauauucaucuuugcaaacuucccucuugauuccuuuuucagucacagcucagagcacagugauuugcuaauuauuaaaaauacugacauaaaaauaaaaauaaauacauccccuacucuguccaggucuucucuuuacucagcauucacaaggcuccugccguuaccacaauauaauuuucuauuccuucacugcacaacccucaggaaaaaagugauuuuauugcacuaauauauauaaauauagcagugccagauugcuccagagguaucugcauuuuuuucaagggguuaccugcuaacucuaaggauggauuuaaccuauggauuuucuggagacucuguuuaggucccuugcagggcacagggacugccgugaguaggaggcagcucuccugagcuuugcaaggcgucucaucuuccacuucagagcccccuggcaaugauuuugcuggugguuuuuggaaggagggggaaggguggcugggugucuguguaaauuacuguuugcaggcuggggacuaacuuuauguagcuauucucuaccuuaaauaauuaaaacuucucaguucuggauuuaaccgaauccucaagacuuucgugggaauggacaaaacuaaagucccacauuccauauugagguaaccucucuaguuuaacaaguaggcuuuuugggugguuugcuuauuuaucuuccuaaaucuagaaaagguccaguuuucaaauuaucaggauaaaaguacauucagaauauaagaagaugaaauuuuaaaaauucaugaaaacucucucacaugcauucaaaccuaaaacuaaggacugauugucagacuuguaauaaaugacauuuucgccaguucagaguugaaaggaguagaaaaaaugaauucacacucuauaggguuaaugucccuguaccuagggccaggggcugcgagcaguuggcuaacuucacugcuuuugcugaggggcagguggagauaggacugacagagaaaaacggaaaguagaugucuuuccaguacuauccuuugcaccaggaacuguccugggaacagaccacagguuggagaugaaagcaaaaauaaaaaaauagccucuaauauuagaaauauugagaacugcuugugggcauauugcagcacuaauuagaaauaagaaaaugaacaauuaaauuccucucccuauaacauaaaguaucuguaaaaaucauaugaagucaaacacguaccaaaaaauaaagauaaaacuuccuacaaaccucuauuacccagagacaaugucugugaauauuugggcauauuucuuucuggucuuuuuucugccuuuaaaaaaugaugucauauccuguuucuugcauuugauaguuaacauaaaauuucccaugucacuaaaaacuccuuuaaacaccauuuuaauaguuguguaauauuuauguauauuaauacagcaugauuuauuuaaucuuucaugauugaacacguagguuguuucuauuuuuucuauuauacacaaugauacacugaacaucuuuguauauuaauuuuguguauuuaggauuauuaagauucucacgugugaaauuauuaugcauauauuaucaugcauauauuaucaugcauauuaucaugcaauauuauuaugcauauuaucaugcauauauuaugcauauauuauaaauauaugcauguuuuaaagggauagccauacauacuaucaaauuauuuucuaaaaugguuguauguguuugucuacucacaaguauuaccuguauaacuauuauaugcugcuacuucuaaucagcauuguguucuuuuauuaaaaaaaaaaaaaaaacaaaaacggauuuuccggcaagauggccaaauaggaacagcuccagucuucagcucccaguaagaucaaugcagaagacgggugauuucugcauuuccaacugagguaccugcuucaucucauuaggacuggcuggacagugugugcaggccauggagggagagccaaagcagggcagggcgucgccucauccaggaaguacaaggagucaggguauuucccuuuccuagccaagggaagccaugagagacuguaccaggugcgacgguacacucuugccaaaauacuaugcuuuucccguggucuucgcaacccacagaccaggagauucccucuggugccuggcucagcgggucccccacccacggagcccagcaagcuaagauccacuggcuugaaauucuugcugcuagggcagcagucugagauagaacugggaugcuggagcuuggucgggggaagagcguucgcuauugcugaggcuugagcaggugguuuuaugcucacaguguaaacaaacccauugagaagcucaaaccagguggagccuacugcagcagugaggccaacugccucucuagauuccaccucugugggcagggcauaucuaaacaaaaggcagcagcccaagucagggacuuauagaaaaaagccucaucucccugggacagagcaccugagggaagggcaguggugggcacagcuucagcagacuuaaaugccugacagcucugaagagagcagugguucucccagcauggcgaucgagcucugauaacagacagacugccuccucaagugggucccugacccccguguagccugacugggagauaccucccaguuggggccgacagacaccucauacaggagagcacuggcuggcaucuggcaggugccccucugggacgaagcuuccagaggaaggauugggcagcaauauuugcugcucugcagcauccgcugaugauacccaggcaaacagggucuggaguggacccccagcaaacuccaacagacuugcagcugaaggaccuguuagaaggaaaacuaacaaacagaaaggaauagcaucaacaucaaaaaaaaggacauccacaccaaaaccccauccauaggucaccaacaucaaagacaaaauguagauaaaaccacaaagauggggagaaaccagcacagaaaggcugaaaauuccaaaaaccagaaugccucuuauccuccaaaggaucacaacuccucaccagcaagggaacaaaacuggauggagaaugaguuugaugaguuaacagaaguaggcuucagaagguggguaauaacaaacaucuccgagcuaaaggagcauguucuaacccaucucaaggaagcuaaaaaccuugaaaaaagauuagacgaaauggcuaacuagaacaaccaggguagagaagaacauaaaugaccugacggagcugaaaaacacagcaugagaacuucgugacgcauacacaaucuucaauagccaauuagaucaagcagaagaaaggauuaucagugauugaagaucaaauuaauaaaauaaagagagaagaaaagaucagagaaaaaagacugaaaagaaaugaacaaagccuccaagaaauaugggacuaugugaaaagaccgaaucuacguuugauuggcguacccgaaagugacggggagaauggaaucaaguuagaaaacacucuucaggauauuauccaggagaacuuccccauccuagcaaggcaggcgaauauucaaauucaggaaauacagagaacaccacaaagauauuccuugagaagagcaaccccaagacacauauuuucagauucaccaagauugaaaugaaggaaaaaauauuaagggcagccagagagaaagguuggguuacccacaaagggaagcacaucagacuaacagcagaucucucagcagaaacccuacaagccagaagagaguggaggccaauauucaacauucuuaaagaaaagaauuuucaacccagaauuucauauccagccaaacuaagcuucauaagugaaggagaaauaaaauccuuuacagacaagcaaaugcugagagauuuuguuuccaccaggucugccuuacaagagcuccugaaggaagcacuaaacauggaaagaaacaaucgguaccagucacugcaaaaacaugccaaauuggaaagaccaucgacacuaugaagaaacugcaucaacuaaugggcaaaauaaccagcuagcaucacaaugacaggcucaaauucacauauaacaauauucaccuuaaauguaaaugggcuaaaugccccaauuaaaagauacagacuggcaaauuggauaaagagucaagacccaucagugugcuguauucaggagacccaucuccugugcaaagacacacauaggcucaaaauaaagggaugaaggaagaucuaccaagcaaauggaaaacaaaaaaaagggguugaaaucccaguaucugauaaaacugacuuuaaaccaacaaagaucaaaagagacaaagaaggccauuacauaaugguaaagggaucaaugcaacaacaagagcuaacucuccuaaauauauaugcacccaauacaggagcacccagauucagaaagcaaguuuuuagagaccuacaaagagacuuagacucccacacaauaauagugggagacuuuaacaccccacuguuaauaugagacagaucaaugagacaguaaauuaacaaggauauccaggacuugaacucagcucuggaccaaguagaccuaauagacaccuacagaauucuccaucccaaaucaauagaauauacauucuucucagcaccacaucacacuuauucuaaaauugaccacauaauuggaaguaaaacacuccucagcaaauauaaaagagcagaaaucacaacaaacugucucucagaccacagugcaaucaaauuagaacucaggauuaagaaacucacucaaaaccacacaacaacauggaaacugaacaaccugcuccugaaugacuacuggguaaacaacaaaaugagggcagaaauaaagauauucuuugaagccaaugagaaugaagacacaacauaccagaaucucugggacacauuuaaagcaguguguagagggaaauuuauaucacuaaaugcucacaagagaaagcaggaaagaucuaacauugacacccuaacaucacaauuaaaagaacuagagaagcaagagcaaacaaauucaaaagcuagcagaagacagaaauaacuaagaucagagcagaacugaaggagacagagacacaaaaaacccuucaaaaaaucaaugaauccaggagcugguuucaugaaaagauuaacaaaauagauagaccgcuagcaagacuaauaaagaagaaaagagagaagauucaaauagaugcaauaaaaaaugauaaaggggauaucaccgcugaucccacagaaauacaaacuaccaucagacaauacuauaaacaucucuaugcaaauaaacuagaaaaucuagaagaaauggauaaauuccuggacacauacacccucccaagacuaaaccaggaagacgucaaaucucugaauagaccaauaacagguggcaaaauugagccaauaauuaauagccuaccaaccaaaaaaaguccaggaccagauggauucacagccaaauucuaccagagguacaaagaggagcagguaccauuccuucugaaacuauucugauuaauaaaaaaaagggaauccugccuaacuuauuuuaugaggccagcaucauccugauaccaaaaucuggcagagacacaauaaaaaaagagaauuuuugaccaauaucccugaugaacauugaugagaaaauccucaauaaaauacuggcaaaccaaauccagcagcacaucagaaagcuuaucuaccacaaucaagucggcuucaucccugggaugcaaggcugguucagcauaugcaaaucaauaaacguaauccaucaaauaaacagaaccaaugacaaaaaccacaugauuaucucaauagaugcagaaaaggccuucaacaacagcccuucaugcuaaaaacucucaauaaacuaggugaugauggaacguaucucaagauaauaagagcuauuuaugacaaacccacagccaauaucauacuggaugggcaaaaacuggaagcauucccagcacaagacaaggaugcccuuucucaccacuccuauucgacauaguguuggaaguucuggccagggcaaucaggcaagagaaagaaauaaaggguauucauuggaaaagaggaagucaaauugucucuguuugcagaugacaugauuguauauuuagaaaaccucaucaucucagcccaaaaucuccuuaagcugauaagcaacuucagugaagucucaggaucaaaaucaauguguaaaaaucacaagcauuccaugcuauacaccaauaacagacaaacagccaaaucaugaaugaacucccauuuauaauugcuacaaagagaauaaaauaccuaggaaaacaacuuacaagggaugugaagaaccuccucaaggagaacuacaaaccacugcucaaugaaauaaaagaggacacaaacaaauggaagaacauuccaugcucauggauaggaagaaucaauaucgugaaaauggccauacugcccaagguaauuuguagauucaaugcuauccccaccaaguugccacucacuuucuucacagaauuggaaaaaucuauuuuaaauuucauauggaaccaaaaaagagugcacagagccaagacaagccuaagcaaaaagaacaaagcuggaggcaucacgcuaccugacuucaaacuauacuacaaggcuacgguaaccaaaacagcaugguacugguaccaaaacagauauauagaccaacggaacagaacagaggccuccgaaauaacaccacacauuuacaaccaucugaucuuugacaaaccugacaaaaacaagcaauggagaaaggauucccuauuuaauaaacgguguugggaaaacuagccagccauaugcagaaagcugaaacuggaucucuuccuuacaccuuauacaaaaauuaacucaagauggauuaaagacuuaaauguaagaccuaaaaccauaaaaacccuagaauaaaaccuaggcaauaccacucaggacauaggcaugggcaaagacuucaugacuaaaacaccaaaagcaauagcaacacaagccaaaagagacaaaugggaucuaauuaaacuaaagagcuucugcacagcaaaagaaacuaucagcagacuaaacagauugggagaaaauuuuugcaaucuauccaucugacaaagggcuaauauccagaaucuacaaagaacuucaacaaauuuacaagaaaaaagcaaacaacaccaucaaaaagugggcaaaggauaugaacagacacuucucaaaagaagacauuuaugcagccaacagacacaugaaaaaugcucauuaucacuggucaucaaagaaugcaaaucaaaaccacaaugagaggccaucucacaccaguuagaauggcgaucauuaaaaagucaggaaacaacagaugcuggagaggauguggagaaauaggaacacuuuuacacuguuggugggaguguaaauuaguucaaccauuguggaagacaguguggcgauuccucaaggaucuagaacuagaauuaccauuugacccagcaaucccauuacuggguauauacccaaaggauuauaaaucaugcuacuauaaagacacauguacacguauguuuauugcagcacuauucacaauagcaaaaacuuggaaccaacucaaauguccaucaaugauagacuggauaaagaaaauguggcacauauacaccauggaauacuaugcagccauaaaaaaggaugaguucauguccuuuguagggacauggaugaagcuggaaaccaucauuaucagcaaacuaucacaaggacagaaaaccaaacaccgcauguucucacucauaagugggaguugaacaaugagaacacauggacacagggaggggaacaucacacacuggggccugucagggggucgggggcugagggagggauagcauuaggagaaauaccugauguaaaugaugaguugaugggugcagcacaccaacauggcacauguauaccuauguaccaaaccugcacguuguacacauguuccccagaacuuaaaguauaauaaaaaaaagaaaaaaaaaaccuuugccaguuuuguaaauaaaaauuguaucugagcuacuuuauucauucacaauuguuauucauuugguuuuccuuuuugugaguuguccgaauaagaugguuaugugauuaaaauaugcacauuccuaugagaaguauaaacuaguagauuagcaccaaauauauuaauguucuucuacaauauuuguggcccagucaaauuuucuuucauaaauacaaccugaauaaagcaaaauacgaagcaauccuuaccuuucuuuggagauuuugaggaauuuucugcugaccugacuucuucuucuucuuguuguucuucuucuucuuuuacuucucuuucaucuugauuuucuuucucuucuuuagacuccuuucuugaugucaugacuaauuccucuagaucuuuauuuuuuauaaggguaugaugaaguuucucauaugcaucuucaaacuucuccucugccugucuggcucuauuuucaaccucccugauauggaagagaagacacaacaaaauagaaaggguugaaaaaguauuuuugauuucgaaacucauuuucuaaaaaggcagugagauuagaugaaugugucugaaggguagaaauaagggaagcaacagcaucaaugauuaacugagaacugggggcccaggagcgacucugaaugcuaaugucagaguagaaaucaugcugcuauuuaagaauauauuuaucacuucuuaguaaaaucugauuugggguaucuggaauucuccaucaauggccagggaacucccuuucaagaguuaauuuuggcuucucuuaauugaugugauccaacaaacuaaauucaacagagucacuucuuuucuagcaccucuaaaaccaaauuuuuuacaaucaaagaaaccagcuugagaugugcuucuuagcuacuacagcacguuauaugucuacauggcuacgcucuucuccuggcauccccagccaucuuaacuauaccgcccuuucuacucugaguuauguaacauucuuucccaagcacaauaguuucuccuaguuucaucuauuucccuaaguuaucucuuagaaacaaacauugaacuggaucacucuaacaacccccuccaacacacacaaauaguuugacuuccucuaucuuuccacuguaguuaagaauggauguuuccaccagggcaguguaguuuacugccucuagcagaacauguggagauacacaucccccuaauguggauaaagaaagcaggagagccaaagggaagccaaaaagugugaauuucucagucaaaccuucuggccagccauuuucauccucuuaccauuguguugacucauacuuacaguaacuucuccugcauauguucaauuacagccauugcuucaagauauuuuugggccaauguaccuugcuuagcugacucucucugacagaggaaauaugagauaugaaugaacugacagucucaacaauuaguauucuacuuuuuuaggauguucuggaucaaaccuucuagaauauucuuugucuacuacccauaucuaucuaauagaugguuaagcacacccuuaauaccaaaaaaaaaaaaaaaaaagggauugucucuggucaaauagcauagaagcuuccaaauuacucgugcuucaggugaauaagaauuugauuugaauuguaaagaagaagcaggggaaacaguaacaacaaaaagaaacagagaaauaaaaaaagauuuaaaaaauaaggagaaggaucaacauguuucuuuauaagucaaguuaaagaucaaggaagcuaacuuguauaucugucuuacuaauaauuuacuucacuaagaauguaacauugcaaaauccaaugaagucguuaaauuccuuaggggacuucauaaauaucaguuaaagauguagaucuugccaggcaaagaaaauauagaaaaaagauaaccucuuuaauuuauuuugacucuauauaagaggaaggugagagaggaaauuuagaggacaaaaacuauaagcauauuuuuaauugaauauuaacauuuucccagaacaauauacuuuuaaagucucauuuauccaugucucucaagcagugucagguauaagguaaagucuaccuuauagacggaaggagagauagaagaggguggacagccugccacaaucacagcaugauccggugggcuaaagcaagccugcaucuaagccucucauccucaaucacacaucccaucauaccacuauaccuuuuucuaaaagagaaaagaaccuguguuagucucuucacuauuuauuuauuuauuuauuuauuuauuuauuuauucuuuuucuuuuauagagacuggaucuugcucugucacccaggcuacagugcaguggcacaaucauagcucacuguagccuugaccucacaggcucaagcaauccucccaccucagccucccaaguggcugggacuacaggugcacaccaccaugcccagccaguuuuuaauuuuuuuagguagagauugggucuugcuauguugcccaggcuggucuugaacucuuggccucaagugauccuccugccucagccucccaagugcugagauuauaggcacuggccaccacacuuggccaacuucuucccuuuuaugcuagauauuagacucuuauuuucucugucacauauuuuucucuuucuguuuuguugcuucuuuuggguaacuuguuuggaaaguacacacuaucauuuuucacccugaaccuaagguaugugguguggcugugcccgccuggcacacacuacuaacuuauuuguucuuuuaaaagaaaggguuucagagcagaggcuucuagaacuggaauuccacacaugguuuacagcccuaugaaacaacuaaaacuaucaguagaauccaagguaaaccaggauuguccacuacuaccugcgugcauuugagccuucugacucucuccucauucugucaauagauauaaauuuaguuacgauaugcuaggaaaacaucccuuucuuuugauacuggcaaguacagauuaauguuuugugguccauuucaaguccuucaauaggagagcuucagaccguggucugaaaugacauuuuggacauucccauggucugaaaugcugguuguggggcugcuagcauccuccaugugugccagauggcaaucccccaugcaucaaccauauacugaugcagaugccucaaggcuaauuacaguuacugccacaagccuucuucucagacuccaaaccuuccucuggcuuuugugcuauuuuacucacuauaugacagagacaaacauggaccaugcggcucuuguaaucaauugcauuggacccuccuugcuugugccuaugugcuguagcuuccaguuagucuccgucugacaucaauucugccuuuagguuuuuuagcuugguccuccugggguuugacucuacuaaugggcuuuggguugcaucucuauggcuugggcaugccucagggaagaucccacuccaggcucugcuccuugggauucaguucuggaccccuaguuggacugggugcuccuaucagcuuuggacuauucucugaguaccaauauccccaaauaucaaucaaccucguccccuacuagaauagcacaauuaggccccuucuguuugagcaccuggugauugaagccacuuuugcaaaauuaugaugguaagauaaaucugauggggcugacuccaucuugcuugagucucacaggcuggcugacuuggcucauuccugggcaugggcaaaguuuaaaugauaauagcucuuccccaaaacuaaacuacuaaacuacccuuguaaaacuaaugaaaggccaccaaguuaggaguaugagagggaccugaauucagccauuauuccagaggucacaagauuugcaacuucccuaauuaugccuauaaauaacaucauuauuguagaaccuaagguugguauuuugagaugucuuuucaagcuucugacaacaggauggugccacucugacucauaacucagguaguccuguggcccccacaggacuguuacaccaaaacuccagcaucaaaucuuagaauauggacucagugcaugaggaccauuuuccauaccccaugauugcauccccaaccaauaagcaacacccauacccuggcccccugccuaccaaacuaucuuggaaaaagccuaaccuuugagccuucaagaagaucgauuugaguaguaacuccaucuccuacgugguguggccagcuucaugucaauuaaacucuuucuuuacugcaaugcuguggucccagcuaauugauugugucugugcaauggguaggaaggacccacugggaaguuacaugaucccauucuacuugugcaguacuccagccaccauuccacaggaagaaugugauucuucuuggcuuccaggaacuugcaaguaauuguacauccagauggcauuuuaguucuuucuccagauuuuuugguuaaucagaaccuagacaguuuggucuuuagugaucuguaguagcagcagcaacuuuucaaaagcuuagacuuuugaacauggacuuacugguccauguucuccuuaccugggcuauccacauggcacugccagugucacacagaauggcaguaucugggagcaguggaccucacacuaucaaagacaugugauacuccugaguuuugucccaggcugcaggcuccuaguuuccugacugcuuccugccuggcuccagggccuagccuggacggcauaccagaguucuaacuuuagagaagcaagucugaggcaggagggcuuguagcugggacugguggggguuagcagauaaaaagcuucuaccuguugucuuugucuccuuuuuaaaaaauuuuggccgggcgugguggcucacgccuguaaucccagcacuuugggaggccgaagcaggcggaucaugaggucaggaguucaagaccagccugaccaacauaaugaaaccccaucucuauuaaaaguacaaaaaauuagccgggcaugguggugggcaccuguaaucccagguacuugggaggcugaggcaggagaaucgcuugaacuugggaggcagagguugcagugagccgagauugcaccauugcacuccagcccaggugacagugcgaagacucugucucuaaauaaauaaaucucacgacauuguauuccauucccacugcucccucuuacauauuugccucacagucuuagugaccaacauagugaugcauuauuuuuaaaacuuguugaaaguucucugaugucucccaaggcaccacuuugggagaaugugccaaaggaaauuaaaauauauuaccccccaaauauauuuauuugacauauuuugaaauagccgcugccuggccaggaaacaaaaguggccuugcaaagcugucuuuugugggaaaaauuugcaucuguagagaaucuccauuaaagcagucaccgccgcuuccccuuucuaugccuuuccaggacccaggagagauugagagucugaugccuuucaaagucugaaaagaaacaucuuuauucucucugagggagacuucaucuacauaacaaggccaccuuugccagccaagcuucuuccuuuucucucucucucaaccagucuuuucacuaaccugauucaccaagguaaccuguuucuagccauacucagucuguauucuuuacuauggccucaggaugguauaugagcuucuggaucuucauucugaaggcucuuauguacacauguuaaacaaauuuauaugccuuuucuccuauuaaucaauuugccucacaucagugauuuuucaacaaauuuguagggggccaagagccuauggcucccacaccccuaauaaugaaaugguucuuaacuuuaggauggagaaauuugacaaaaucuauugaucccccaauccaagaaaaugcacaauaugaacauacacacaaaauauuaccaccacuucagggaauuagugggauaaagcccauccauaaacucuuaaagucacaguguucuguagagaguaagacacugaucuagagcuaacugaagucuaccaugguccuacaaccaaacuucuguggagacauuuuaaaucugcuuucuugcugaguguccacagcuacugucucuaaguucccaguuucccgacaguuauuguucuuauggguaugugcuuauuaucauagcacucaauaaagucuacuaaaugaauguuuaacaauuagucaaauacugaccaagagauaguuaaacuaaggaaagagaugaaauacugauguuaaaaugggguuuaggccgggcgcaauagcucgcgucugcagucccagcucuuugggagguugagguggguggaucaccugaggucgggagauugagaccagccuagccaauauggugaaacccugucccugcuaaaaguacaaaaauuagccgggcaugguagcaggaaccuguaaucccagcuacuccagaaacugaggcaggagaaucgcuugaacccgggaggcagagcaaaacucugucaaaaaaaaaaaaaaaaaaaagagguuuaaagaugagaaugagaagcuuuuguaaaguuacggugaaaaaaggaguuuuccaggaauuauguuggaagaaaaauaucuguaaaauacaugacuuaggaaucccugguccccuuagaguagcuaaaaguuauguuagcaccauaucauuuuuaugcaauguuaaauaguguugaauucccuagcuggguuucagauacauacccaggaagacaacacaucuguuucaaauagagguuuggaaugaacauuuucaucuucuccaaugaaucgaaugaguuuuuccuucucuguagauguugaagguugcuagaacacagaaacaugcggaccuguuagcaagcugguguagcaccccagcaaguuuccuggcacgguagcaaguuuccuggcaccauguuggaagcuuacauuuuccauuuccuuuaaucacacaacaagaauuuuugaagacuuucacauagcaaacgcugugaaaaacugguaggauggggaguguggacaaggggauauaacuaugggaaaaacaaagaggauuucuuccagcuuccaggaacugacaguacuauaggagagauagauaauaaaaugaauaauuaugguauaacaugauuacuguuagcauaaaagugugcuccaagggcugugcacacccagaaaagggucaugccuucuuccuagguacuucaggaauuauuaacagagaaagugauauuuaaaggccgaacaggugcuuguaaaauagagaggacaggggcucaacuaagucuacaggugguaguaguaauagcaguaguugcaguaguaaugguuuuguuaccagaaaaggggucuuaucccagaccccaagagcagguucuucgaucucacacaggauaaaauucagggugagucucagaguauaguaaaguaaaagcaguuuacuagaaauuacucuauuacagaguuggguauccucagaaagcaagaggagaaaugcccuuaacauaaacauaaugcuugcuuauauaggauauuaacacuaagaauaguguacuuuauuauaaaggcuggugaucagcuugugacaggcuauuaguauuauuauucucuaguguaacuguugacuucagcaauaauuuaugaguauacugucagagacguaugaaccagaaaaacuccaucuuaaagaguagcuggguacaaugaggcuaaaacccacugggcugccuccccagaugguuaaggcauucuaagucauaggaugagacaaaaggucagcacaaaauacaggucauaaagaccuugcugauaaaacagguugcaguaaagaagccggucaaaacccaccaaaaccacaauggccacaagagugaccucugguuguccucacugcuauacucccaucagcgccaugacaguuuacaaaugccauggcaaugucaggaaguuacccuauauggucuaaaaaggggaggcaugaauaauccaccccuuguucagcauaucaucaagaaaaugggcaaccagcagcccuuaaggcuacucugucuauggaguagcuguucuuuuauucuuuuacuuucuuaauaaacuugcuuucacuuuggacugcaaacucgcucugaauucuuucuugugcaagauccaagaauccucuccugggcucugaaucaugacaccuuuccuguaacaguaccauuaucuuuaaagugaaacccauuuuuaaacugagaaugccuuuuuccauuaacucguuuccucaaccauaaacaucuugugacuaagaguguccaauuuccugggaaaguaacccaguagguuuugcuuuaucuggacuuuauucaagauggagucacucugguuaagacaccucugacaauuuccauuuauucugugccuucuacauaccaagcacuuuaccagaaauaaaacagaaaaugcugauugaaauaggcuuggguguuauauaauauuuuuguucuguuguccugccugugcagugaguagaagaccuauuucagagccuggagucaugccaacacuuaaacuauauacagagaagaaauauaucaaagaaguaaaucaagacauuguagagaguguuaggcaaucaugaguucuaggaagccaaaggcaguaguagucaaucuaagaauuagcaaggggucuugugccagacuuaacuggguuugaauaucgguucugccacuuacagcuauaugauuuugaguaaaucagucaaccucucugagcuucaguuuucuuaucuguaaaaugggggcaauaauauaaaccuugaaguuguguugcauagauaagagauaauaugugcaaaguauaucacucaugauaggcacucaauuuuugguaaucaucguauuauuauuauuauuacaaaugucccaggaaggguuuuuauuacuacaaaugccccugcggggguugagacgggguaaagagaggagaggucuggugaugggccugggaggagggcaaaaggcagcucagaaugggagcugaagaaguagaaauauggaguuuuaaaguguuaucugaaaaaauguggcaaugaagggcuaaaaaaauaguaccagagugagaaguagauuguguaguuaauaggaauaaaaguauaaaugaggcuaaugggaaauggcuggauuuagaagggaaaaggaacauucccuuccucugaaaauaaagugacaaagauaaauauuucugcagguuuggcuaaaucuauaugaggaaaagaaggaaacuggaguucacuccagaccaccuacuucuauucuccacugucugugugugucuauaauuuuccccccacuauauaugucuguguauauauauauauaugguccaagcaugguggcucauaucuguaaucccagcacuuuaggaggcugagguaagaggaucgcuugagaccaguucaagaccagccugggcauagcaagaucccaucucuauaaaaaaaauuuuaaaaauuagcuaggcaugguggugcaugccuguaguccuagcuacucaagaggcugaggcaggaggaucauuugagccccagaguucgagguuacagugagcuaugaugauaccacagcacuccaaccugggugacagggcaggacccugucucuaaaauauauguauguauguauguauguauguauguaggaggaaaaacaaauaccaaauaaucuuacuucuucugcucucucuuuauuuuccuccugaaguuuccuauccuccuuacuuucuucuucaucuucuuuaaaagacucgucuauuucaggcucaaugaauucuuuuacagccuccugugagaugaaccaauauuaugauuaaaggguguauauaaauauuagcaauuauuuguucaaaauauuuaaugagcacuaauccugcagcuggguacugugcuagugacaaggauacaaagguugauaagaauagucccuguccuuaagaaacuuauuaauuucacggacaagaaaauacaaugaaugcauacauucacauaguaggagcaccuaauuuagaccagguaguggacuggguaaaagagggaguugguuaggaagguuuccugaaggagauaauguuugaguuuuuuucuugaaggauggggaaggaaaagaagcagcucugggcagaggauguuccaugcacaugauuggaucugagagagcauaguucaauaggacaaaaacugggagacaaaugaauaggagugcaaucagagagaaagggcuagacugucaagccagggagaugauuggcucuuauccugaaggcaaugaggcucuaauaaauugguugauuugcuuugcauuucaaaacaaucauucuagcaacaggagaauagcuuuaaagaagaggaagaaagggaagcagaggaagagaaaaggagcgugaacaaaacaguggcugcgggaaugaagagaaggaaaaggaggauuuaagagauauuuaagaggcaaguccuagugauugacuggauggacacgggaugguuagagaaaaugugcaucuugaaugacacuuaguuuacaguuuagaccacuagagagaugacaaugccauucacagagacaaugaacaaaacuggauaaauagguuuggagagagagaugaguucagauuaggcugugagaguuggagguaccacugagauacccaagugaaaauacccagcaagaaggugaauauauggaucuggaguuuaagauggaagaauuugggcuaaaaauagagaucugacagucaucugccuuuaauuaaagccaagaaaguaaauuauauccuaaaggcaaacuugugaaguagccagagaauuagacaguaacccaguuacauaaaaugcuagggaucuauggaaaacaguguagugauuccuuaaagaacuaaaaguagaucuaccauuugauccagcaaucccacuccuggguaucuacccagagaaaaagcagucauuauaugaaaaagauaauuuuacaugcauguuuauagcagcacaauucacaauugcaaaaauauggaaccagcccaaaugcccaucaaucaaugagugaauaaagaaaaugugguauauauacaccauggaauaccacucagccauaaaaaggaaugaaauaauggcauuuggagacuguuauucuaaguaaaguaacucaggaauggaaaaccaaauauuguacguucucacucauaagugggagcuaagcuaugaggaugcaaagccauaagaaugauacaauggacuuuggggauucaggggaaaagggugggaggugaggagggauaaaagacuacacauuggguacaguguacacugcuuggguaaugggugcaccaaaaucugagaaauuaucacuaaagaacuuacucauguaaccaacuaugaccuguuccccaaaaaccuauugggaaaaaaaaaggaaugauguucugaugcaggcaacaauguggcugaccucugaaaacacuaugcuaagggaaauaagcacaaaaggccacauauuauauaauuccauuuacaugacauguccagaauaggcaaauccauagagccagaaaccgugugguguuuccagggccugagaagaaaggggaaauuugagugacugcuaaccaguauggauuuucuuuuugggaaugauuaaaauguucuggaauucaauagugauuaucacuguacaacuuugugaauauaccacaaacuauuacugaauuguacauauuacaugaauugugucucaauaaagcuguuauuuuuagaaaaauaauuuggccacuccacauuguacacauacuucaaaacaucauguuguacacaauaaauauauacaauuuuuauuugucaauuaaaauaaauaaauaggaaauugcugccucaaaaaaaaaaaaacaaaaacaaucagaugaaaucaaaagccuauacucaaggaaaacaauaauagauuuucaaaccucugaaaaaaauaaaaugcuagggaagaaagaggagccugaaaaggcagccagaaguagccucugaaguaugagaggccacgaggaaagccaaaagagaagaaagaaggagucaucaguauugaacaccucaaaggagucuacucauauagauuuaaaaacauccucuggguguuuacagcagcaauauuuauaaaagcaaaagcuagcaauaagcucaaugcccacaauaggaaaaugcacaaauaaauuaugguguaagccauauaacaaaauacuuuauagcaauguuaaauuaugcuauagaaauauguguacaguauagaaaaauagucacaaugugacuaaaaaauuaggauauuuuuacaaaaugaaaauacuuuuuuucuugauaacauucuugcuauaaaauauuugaacacuacagaggaauuaagaaucuuaacucucagaguuaacaauuuuuaucauuugcugaauauucugcuagacugcuuuuugcaucuauaaacauuuuaauauaaaugagauaauauaucuuauauucuauaaucugcuuuucucaauaauauaucauggauuauauuuauuuaacuacuuaaacaucuacuuuaucugcauagaauuccauuauuucaauguaccauguuguauuuaacuaaucuccuacugaucaacauucauauuguuucuaguauuuugcuauuauacuaugcuguaauaaacauucuuauacagauacaucauauauuagaauuaucaaacagacuacaaaaguuauacuuaaccuauuuaaagaaauaagagauugaaaauaugagcaaagacagaaagauuacaaaaaugaugagacuugaaaaagaaucaaauaggacuucagcaauuuaauuuaaaaacucaacagaaagguuuaauggcagaugaaauucaauuggagggcaaauuagugaacuggauaguaagccagaaaaauuauucaggaugcaaugcagagaaauagagagagaauaugaaagaagguuaagagacaugggggauugauuccaacacacauucauuuagaguucuagaaggaaagaagagagcaaaugcaguagaggcaauauuugaauagaugacugagaauuuuccagaucuaacaaaagauaccaaauuaaagauucaggaaaucaagagaaucccaagcaaaauuuaaaagaaaagaaaauccaucuccacauuaaucagagcaaagacaaaaagacgaccuuaaaaauagagagaagagaugaauucacuucaaaggaacugacagcuggauucucaauggucaguucaauaacaacaaaauccagaaaacaguaaaaauaauaacgaugugcugagagaaaagaauaccaucccagaaucaauagcauacccagcaaaaaaaaaaaaaaaaaaauguaagaaugagggugaaauaaaggcauuuucagacaaacaaaaacugaguuugccaccaggauaucuucacuaaagaaaauucuacagguuaagguagaagacaaaugacccaagguggauaucugagacuuuugaagaaagaacaaauaaauuaaauuauaaaucagcuccaaugccagcauauuucuuaaagguaaaucacuaaaggcauuccugcuaaagucagaaacaagaaaaggaugcuuguuaucuccacuacuauuuaauauugaauuagaagaauuauucaauauaauuaaaaaagaaaaagcaacuagaaguaucagaauugaaaagaaagagguaaaacuaucccuauuuguaggugauuugauuaaguaucuagaaaaccccaaagaauccacugaaaaacuacuaaaaacaguaagaggaagagcagcaggaggaggagagagaaauacaguaagagaauuuaguaaagucacagcauauaaaauuaaaauaggaaugguggugaacaucuguaagcccagcacuuugggaggcugaggcaggaggaucacuugagcccaggaauucaagccagccuaggcaacauagcaagacccugucucugcgaaauuaaaaauuagccaggcauggugccacgcaccuauaaucccacauaguccggaggcugaggugggaggacuucuugagcacaggaagucaaggcugcagugaaccauaacuggaccgcugaacuccagccugggugacagaguaugauccaaucucaaaaaauaaaacaaaauuaaauuaaauuaaauuaaaauacagaaauugauuauauauauauagucuguauauauauaauauauauaaauaugcuguauauauauauaacuguauauauauauacaguuacuaguuagaagauauaauggaaaagaaugucucauuuaaaauagcaaaaaauaaaauauucaggcauaaaccuaauaagaaacguacaaaauaagcaaacaaauaagauaugauuuaaaggcauaaaaguagacauccuauauuccauauucuuggauaauacaauucagcaucauaaacaugucuacucuaaguuaauauauaaauuuaauauuaugcuaguuuuaaaaaaucuuauuuuuaagaacuagcuuauaaaguuauauagaaaaauagccaggugcaguggugcaugccauagucccagcuacucuggaggcugaggcaggaggaucacuuaagcccaggaguuugagaccagccgaggcaacaucaagacccugucucuaaaaaauaaauaaauaaauaaaaggaagaauaaguaagcaagaauagcaaugaaaugccugaaaaagaucagugaugagggcugguccuaccagauaugaaaauguaucguaagaaagucaaacuaucccuguuugcagaugacaugauccuauaucuagaaaaccccauugucucagcccaaaagcuucuuaagcugauaaacaacuucagcaaagucucaguauacaaaaucagcaugcaaaaaucacuagcaucccuauacauuaacaauagucaagccaagagccaaaucacaaaugaacucccauucacaauugccagaaaaagaauaaaauaccuuaggaauauagcuaacuaggaaggugaaagaucucuaaaaggagaacuacaaaccacugcucaaagaaaucacagaugacacaaauggaaaaacauuccauacucauaaaaaggaggaaucaauaucguuaaaauggccauacuggcaagggcaauuuauagauucaaugcuauuccuaucaaacuaccauugacauucuucacagaacuagaaaaaaacuauuuuaaaauucauaaggaaucaagaagaagccugaacagugaggcaauccuaagaaaaagaacaaagccgaaagcaucacacuacccaacuucaaaguauaguacagggcuacaguaaccaaaacagcaugguauaauacaagaacagacacauacaccaauggaacaaaauggagaacccagaaauaagacuucacaccgacaaaccaucugaucuucaacaaagcugacaaaaacaagcaauagggaaagaauucccuauucaguaaauggugcugggauaacuggauagccauauggagaaaacugaaacuggaacccuuccuuaugccauauacaaaaauuaacugaagaugggauuaaaggcuuaaauguaaaacccaaaacuauaaaaacccuggaagacaaccuuggcaauaccauucuggacauagaaacgggaaaagauuucacaaugaagaugccaaaaacaauugcaacagaagcaaaaauugacaaauggcauaucuaauuaaacuaaagagcuucuggacaguaaaagaaacuauccauagaguaaacagacaaccuacagaaugggagaaaauuuuugcaaacuauguauccgacaaaggucuaauauccaacaucuaugaggaacuuaaacaaauuuacaagcaaaaaacaaccccauaaaaaagugggcaaaggacaugaacagacaguuuugaaaagacaaaaauguggccaauaaucauaugagaaaaagcucaacaucacugaucauuagagaaauacaacucaaaaccauaaugagcuaccaucuaacaccagucagaauggcaacuauuauaaagucaaaaaauaacagaugcuggcaagguuguggagagaaaggaucacuuauauacacuguggugggaguguaaauuaguucagccaugguggaagacagcguggugauucuucaaagaucuaaagacagaaauaucauuugacccagcaaucccauuacuaaguauauaccugaaggaauauaaaucauucuaugauaaagacacaugcaugcauauguucacugcagcacuauacacaauagcaaugacauggaacuaaccuaaauauccaucaaugauagacuagauaaagaaaaugcaguacauauacaccauggaauacuaugcagccauaaaaaagaaugagaucaugucauuugcagggacauggauggagcuagaggccauuauucuuagcaaacuaacacaggaagagaaaaccaaauacuacauuuucccuguuaagugggaccuaaaugaugagaccacauggacacacaaaggggaacaauacauacuggggccuuucggaugguggaggauggacagagggagaggaucaagaaaaacagcuaauggguacuaggcucaauaccuaggugaugaaauaaucuguacaacaaaccuccaugacacaaguuuaccuuugugacaaaccugcacauguaccccgaacuuaaaagucaaaaaaaaaaaaaagaaaaaggaaaauguaucauaaagccucaauaauuaaaauauugugguaaugacccacuaauagacagaucaauagaaaagaauagaaaaucaaaaaauagacuuagguugaauacagcuguuuuuaaauguuggaaauauuaucauauggaagacaaaucagcccuguucauauuaaccagaaaagacugaacuaggaccaguucgcagaaaaagcuaaagcuacgaggagacauauuacauuuaguucaauagaaagaauuaauguucuaauacucagugcucaccaaaaaugaauggagucuuucugaaaguaguucucugucacuucagauauucaaacuuaagcauaaugaucaaguauggauguuauauuaagacucaucaucagauaaaagagaagaucauccugguggaugggaaguaggacuagauuguagcuccaacucagauggacagagcaguguguggaggcucacgugagaaauuuuagcuccagaaugacugcaagaacaaagcaggaaucccgagaggacccaaagacccuccgaaggcaguggacugcuccugcaggaccugggagacaccccaaauacugugagugcccaaacugcgaaagugggaaagggagacccuccacucccaaacacacccccacuggggaaacugaaggucugguuugcaggagaaguuuccaaccuuaccuggagcugagucaauuuagagagccgagcaaaauacagggguagaggaagcagcaggaaaggcucugggaguucgcaggguccccaagcaggccauuccugccuggcaccacagggauccuucgggagggcggccagaggcacaggggaaaacgccccaaggagaaggaagucuccagcugaacuuuguaacaauuugaaucgggcgaggugccucccgcuagaacucaggggagggcaugaauccaguguacagacuccacagggggaagaacaaccaaaacucuuuucuuuugcagcugggaggcagguagcaugggacaaguucucaaguccugcuugcccacugccuggaaacagccuuaaggcuguuaguaggggcauggugggaguaagaccagcccuucagauuguguggagaccaggugaggucugugaccgccugcuuucccccacuucccugacaaccugcaugacucagcagaggcagccauaauccuccuagguacauaacuccacugaccugggaaacucacccccauuccccacagcagccacagcaagaccugcccaagaagaaucugagcucagacacgccuagcccugccccgaccugguagcugaagacaaaggguggguaggguauaugaagaaauauacucuugggaguucuggggcucugcccaccaccaguuccucuccauacuaucacagcugaugcucuuuggaaagugccaccucccggcaggagaccaagcagcacaaaaacagaacauuaaaccaccaaagcuaagaacccucacgaacuguuucacccccgcugccaccuccacuagaacaggugcugguauccacgacugagggagccauagacgguucacaucacaggacucugugcagauaacccccagcaccagcccagaaccagguaggcuugcuggguggcuagaccaagaagagagauaacaauuacuacaguucagcucauaggaagccacauccauaggaaaagggggagaguacuacaucaagggagaaccccaugggacaaaagaaucugaacaaaagacuucagcucuauaccuucccucugacagagccuacccaaaugagaaggaaccagaaaaccaacucugguacuaugacaaaacaaggcucuuuaacacccccagaaaaucacacuagcucaccagcaaugguuccaaaccaagaagaaaucccugauuuacaugaaaaagaauucaggauguuaguuauuaagcuaaucagggaggcaccagagaaaggcgaagcccaaugcaaggaaauccaaaaaaaugauacaagaaggaaagggagaaauauucaaggaaauagauggcauaaagaaaaagcaaucaaaacaucagggaaauugggcacacuuacagaacugcaaaaugcucuggaaagucucagcaauagaauugaacaaguagaagaaagaaauucagagcucgaagaccaggucuucgaauuaacccaauccaacaaagacaaagaaaaaagaaaaagaaaauaugaacaaagccuccaagaagucugggauuauguuaaaugaccaaaccuaagaauaauugauguuccucauaguguacuuauacaaauggaggguauagcccaccacacacaccuuggcuauaugauauaaccuuuugcucccaggcuauaaaccuguacagcauguacuacacugaauacuguaggcaacuguaacacaaugguuuguaucuguguaucuuaacauagaaaagguauaguaaaaauacagucuuauaaucuuaugggacugcuaucuuaucugcagucuguuguuaacuaaaacauccuuaugcagugcaugacuguaucuugcaauuucuuaacuuuugccaauaugaugaguaaaaaaaaugaacccucauuuguacuuuaacuuacauuauaauuuuuuuguggauuaaaaaaaagaauaauugauguuccugaggaagaaaagaaaucuaaaaguuuggaaaacauauuugggggaauaauugaggaaaacuucccuggccucgcuagagaucuagacauccaaauacaagaagcacaaagaacaccugggaaauucaucgcaaaaagaucaucaccuaggcacguugucaucagguuaucuaaaguuaagacgaagaaaagaaucuuaacaucugugagacaaaagcaucagguacccuauaaaggaaaaccuaacagauuaacagcaguuuucucagcagacacccuacaagcuggaagggauuggggcccuaucuucagccuccucaaacaaaacaauuaucagccaagaauuuuguauccagcgaaacuaagcaucauauaugaaggaaagauauagucuuuuccagacaaacaaaugcugagagaauucgccacuaccaagccaccacuaccaagaacugcuaaaaagagcucuaauccuggaaacacaucaaaacagaagcucuuuaaagcauaaaucacacaggacuuauaaaacaaaaaaaaugaaaauuuaaaaagcaaaaauaaaaaacaaaaaaccaagguacaaagucaacaaauagcacgaugaauggaaugguaucucacaucucaauaguaacauugaauguaaauggcuuaaaugcucuaccuaaaagauacaaaacugcagaauggauaagaacucaccaaccaucugcucccuucaggauacucaccuaacacauaaggacuacauaaacugaaauaaaaagguuggaaaaagcauuucaugcaaauggacaccaaaagcgagcagggguagcuauucuuauaucagacaaaacaaacuuuaaagcaacagcaguugaagagacaaagagggacauuauauaaugguaaaggccuuguccaacaagaaaauaucacaauccuaaacauauaugcaccuaacacuggugcucccaaauuuguaaaacaauuacuaacagaccuaagaaaugagauagacagcaauacauaacagugggggacuucaauacuccacugacagcacuagacaggacaucaacacaaaaagucaacaaagaaacaauggauuuaaacuauaccuuggaacaaauggacuuagcagauauauacaaaacauuuucuccaacaaccacagaauacacauucuauucaacagugcacagaaccuucuccaagauagaccaugugauaggccacuagaugagccucaauaaauuuaagaaaauugaaauuauaucaagcacucucucagaguggaauaaaauuggaaaucaacuccaaaaggaaccuucaagaccaugcaaauacauggacguuaaauaaccugcuccugaaugaucauuuggucaaaaacaaaacucagacggaaauuaaaaauucuuugaacugaacaacaauaaugacacuaccuaucaaaaccucugggauacagcaaaggcugugcuaagagaagaguucauagcauuaaaugccuauaucaaaaagacggaaagaauacaaaccgacauucuaaggucacaccucaaggaacuagagaaacaagaacaaaccaaacccaaacccagcagaagaaaggaaauaaccaagaucagagcagaauuaaaugaaauugaaauaaacaaacaaaaaaaauacaaaagauaaaugaaacaaaaagcuaguucuuggaaaagauaaauaaauuugauagacuauuagcaagauuaaccaagaaaagaacagaaaaaauccaaauaaccuaauuaagacacaaaacuggacauauuacaacugacaccgcugaaauacaaaagaucauucaaggcuacuaagaacaucuuuaugcacauaaacuagaaaaccuagaagagauggauaaauuccuggaaaaauacaacacuccuagcuuaacucagaaagaauuagauacccugaacagaccaauagcaagcaccaagauuuaaaugguaauuaaaaaauuaccaacaaaaaaaaaguccaggaccagaaggauucacagcagaauucuaccagacauucaaagaauugauaccaauccuuuugacacuauuccacaagauagagaaaaaagggaaccuucccuaauucauucuaugaaggcagaaucacccuaauaccaaaaccaggaaaggacauaucuaaaaaagaaaaccacagacugacaucccugauaaacacagacacuaaaaucuuuaacaaaauacucgcuaacugaauccaacaacauaucaaaaagauaauccaccaugaucacguggguuacauagcagggaugcagggaugguuuaacauacacaagucaauaaaugugauacaccacauaaacagaauuaaaaacaaaagucacaugaucaucucaauagaugcagaaaaagcauucaacaaaauccagcaucccuuuaugauuaaaacucucagcaaaaucagcauacaauggacauaacucaauguauuaaaagccaucuauggcaaauccacagcaaacauaauauuggauggggaaagcugaaagcauucucucugagaacuggaaugagacaaggauaccuacccacucucaccacuccucuucaacauagaacuggaagucccagccagagcaaucagacaagagaaggaaauaaaggacacccaaauugguaaagaggaagucaaacugucauuguuuccugacaauaugaucauuuaccuugaaaacccuaaagacucuccagaaagcuccuagaaaugauaaaagaauucagcaaaguuuccggauacaagacuaauguacacaaaucaguagcucuucucuacaccaacagcuaccaagcggagagucaaaucaagaacucaaccccuuuacaacagcugcaaaaauaauaaaauacuuagagauauaccuaaccaaggaggcaaaagaccucuauaaggaaaacuacaaacacugcugaaagaaaucauagacaacauaaacaaauggaaacacaccccaagcucacggaugaguagaaucaauacugugaaaauagccauacugcuaaaagcaaucuacaaauucaaugcaauccccaucagaacaccacuaucauucuucacauaauuagaaaaaaaaauucuaaaauucauaugaaaccaaaauagagcccgcauagccaaagcaagacuaagcaugaagaacaaaucugaaggcaucgcacuaccugauuucaaacuauacuauaaggccauaguaaccaaaacagcaugguacugguauaaaaacaggcauauagaccaauggaacagaauagagaacccagaaauaaauccaaauacuuauagccaacugaucuucaacaaagcaaacagaaacauaaaguggggaaaggacacccuuuuaaacaaauggugcugggauaauuggcuagccacauguaggagaacgaaacuggauccucaucucucaccuuauacaaaaaucaacucaagauggauuaaggacuuaaaucuaagaccugaaacuauaaaaauucuagacauaacauuggaaaaacccuucuagacauuggcuuaggcaaagauuucaugaccaagaacccaaaagcaaaugcaauaaaacaaagauaaauagcuggggcuuaauuaaacuaaagagcuuuugcacagcaaaaggaacagucagcagaguaaacagacaacgcacagagugggagaaaaucuucacaaucuuuacaucugacaaaggacuaauauccagaaucuaaaacaaacuccaacaaaucagcaagaaaugaaacaaacaaucacaucaaaaagugggcuaaggacaugaauagacaauuaucaaaagaagagacacaaauggccaacaaauauaugaaaaaaagcucagccucacuaaugaucagggaaaugcaaaucaaaacgacaaugcaauaccacccuacuccugcaagaauggccauaaucaaaaaaucaagaaacgguagauguugccaugaaugcggucaucaaggaacacuucuacacugcuggagggaauguaaacuaguagagccacuauggaaaacaguguggagauuccuuaaagaacuaaaaguagaauuaccauuugauccagcaaucucauuacuggguaucuacccagaggaaaagaagucauuauaggaaaaagaugcuugcacacgcauguuuauagcagcacaauucacaauugcaaaaucauggaaccaacccaaaugcccaucaaucaacaaguggauaaaaaucugugguguauauacauauacacacacacacacacacacacacacacaccccauauaccauauacuauguauauauuauaccauauauaugugguaguguguguauauauauauaaaaucauauuauguauaugauuggaauauauauauauauacacacacuaccauauuauauauguauauauaugauggaaugcuacucagccaugaagaggaaugaauuaacagcauuuucagugaccuggaugagacuggagaaacuuuuuuuuuuugugggggacagagucucacucugucgcccaggcuggaaugcaguggcgugaucucggcucacugcagccuccaccuccuggguucaagcgauucuccugccucagccuccugaguagcugggacuacaggagacucuuauuguaagugaaguagcucaagaauggaaaacgaaacaccauauguucucacugaugugugggagcuaagcuaugaggaugcaaaggcauaagaaugauacaauggacuuuggggauuuggggggaagggugggaggggggcaagggauaaaagacuacaaauagggugcaguguauacuacucgagugaugggugcaccaaaaucucagaaaucaccacuaaagaacuuacucauguaaccaaacaccaccuguaccccaguaaccuauggaaaaauaaaaaauaaaagacuugucagauucaugcaagguuaaauucaauugccuuuaaauucccuucugcucucacgucucugauucuguacaguuccuugauuuuuuccuagaucugauacaccaagaucaugucggugguauuucauuaaguuucucaaaguauacuauaauuuacaauuuauaauguugauaaaaucauucagugguuauuucacaauaauucuugccaagaucuagacagcacauuuguuaaaggugaauaauuuagaaagaugauauuucuucaguguuuaaauguaaaaaaaaaguuucauaaauguguagauagaaccuuccccuucuuucucagacccaagacacugacauauaggccaucagaucauaccuguauaguaugacucugauaacaaugggagcuucuucagaauuuacuggaggagaacgccuucaaagaggcugaaauacaaacaagaguugaguuugugauggcacaugauagucacugauuugagauucucgguaagcagguggcaaugaaaaccacaggaaacacaguaauagguaguguguacaaaugagaagugaaagcaagccaaggacagaauaucaacauuuaagaggcagaaaagggugaaacucuaaaacaagggugaaauaaagaaguaggagaaaaaccaggacauuguaaaaggagugaaugguuaagagagccaaaugcuacacagaagccagguuaaauacaaaauugaagauacuuggauuuggcaauaaggaaucacuggugaccuuauaguaguucuagaguuuuaaacaaauugauuaugauggaauggaaagagagaaagaaguagcagagagacaaggucaagggacauccuucuuaggaugggagaaaugaccauguuuuagauugcuuuuagauugauaaaauggaacaauuagagaagauauuaaagaggcaaaacagagaagacauuggacaugggauuaagugcucgaaggaagaaauaaccuuaaauggaaagacugagacuggaggggagggaaaagggugagcacagaagcagaugaaccugaggauaugccucaggaaguggcagggagcuucuaccugaaacccauucuuuccuuuauaaaaucaccugcuaaaaacaugacgcaaaaugcugaguggaugauucuauuccuuagagggaagaagagcugugaaagaucuugaucagaaccaaaauucucauauguuaggguaaaugaacaaggauucagaacauugauuggaaaaagcugugaaccuucuguacugaaauacaggaauaaucugaauaaugaccaacgcuaacauguggcaaauaccucuucaaguagccgcucuauuucuucauaugucaauaauguaauuuuucugccuuugauauuagaaaggaggcaagagcauguguugauccauucauaacauucuuucugagaagagauaaaagauuacaagcagaaaaaccagcucauuuauucacucaccgcuauugaggaacugauaaauacaauuccucuaaacauaacuauauucaauuaacuuuauaucaguucaguucaaagaguugugcaguggugacuggcuauuaacauacaccuaaaucauauuaucucuuauugacacggugugggaucuggguuguaaugggacagggaguagugaagugccguaaaaacagauacaaaaagauuguuuuauuuacuaaugucuaaauggccuccuaauaaauuuuaugcaacugaccaggucaacugugauugcauaauaacaacagaaguagcaaacaccuaccuuguacuuaauuauaugccagacucuguucuaagcauuaugcauauauuaacucauuugauccucaguaugagacauuaacuauuauuauccucauuuuuuaagaugaggaaacugagaaauugaguaguuaaaugucuugcucaaggucacaaaaauaguuaaguaugaugcuuggauucuaaucuauguggucugugcuuaaccacuaaaaaaaaaaaucccucuacugcuaauaaagugaauggaucaagauuugagacacuuuuggaaaaggugcucaccuuuuaucuauugagauaugggaaaggucuauagcagguuuuaauccccuaagguaaauaguuaaacuguauuuaccaagaucuccuaacaguuaagagcugguuucaacguuuaaaagguacauuauuccuuauuaguuaauaaaagcccugagaacuaggaaacguuguccucucugggaacagagaucuggucacucuagccaaaaaacggcagcauguggugaaaugacccacuguaggcuccugaaaucaaccacaaugagcaguaauauaccuuauauuucuuucauuauuagccuuuuuuuuuuuuuugagacagggucuugcucuguugcccaggcuagagugcaguggcaucaucauagcucacugcagccucgacccacuaagcucaagugauccucccaccucagccucccaaguagcugggaccacaggugugcaccaccauaccuggcuaauuuuuuuacuuuuucuugcccaggcugggcuuguacuccuggacuuaagcaauucagccucccaaaaugcugggauuacaggcaugagccacuguaccuggcccagauuucuuuuaaauuguguaauuauuaugaaacaucagagccaaaaauuuuagaaaucaaaucuaaauccauauguuguagauaaagaaacugaagccuauagugguaaaguaaguuuacuacagcuuuguuaaugucacugaugguuaaauucuggauucagaggguuagaaugguaucuuauugcauaucaggaagaagaguggacaaggcagaugaagguguuggguuuuaguccuaacuucaccuaauuaguugagaguucuugaguaaaugccuaauaguccuuaucuuuuuuuuuuuaaugaagcuguuuguuuacucuaagugauccauaugcaguggugaccugguaaauguuuaacaaccauuucugagggaguugggggaagcccugauuuguagcaauuucugauuuccauggugaaaacacucucaccaggcaauuucagugauauucaucaauucaguauguuaucacagaauguggacuugagaaggcuuguauauaauugguucuugugagccagugugaguuucuaucacaccacugccccuaaguauccuuccagauauaaagcuugacuaauacauuuuuuaaccuuuuuuuauuguaccuagaacaaaaaaauuucaaaacuagucuguaguugaauuugcacgcuaugaaacagauccuggucauuuucuuauaaaugucugagacauuggagauacugucauaagacuucugaugaggaaaaaaauuauuaggagucuuuuacaguuuuacuguaaacguuuuacaauaaucuauagaguucagcaaguuuuccuucaaaaccuucaauaauaccuuuuuaucagcuauagaccaggauagcuugguugcuaauuaauacccaugaaucucuuuccaugaauauucuuaauugauucuaauaaagacuucuggugugaaguaaaaggacuaaaauucauguuuggagugaaggaguauuuaagaagcaagugauaguccuaaauguuaagccuauuguagcaggagaaacagaaggccacaggagagucuuuuauaggguaccagcaguaagacacuggcuauaaauggagcuauuaagaauccaugauccacagauccccccauaaggaaggaaagcuggggcuugaauuuaccugcuaaaacaucuugagaguaagauuccuacuaccaccaucuucagucauaguccuuuuggaggaccaaauccuggaaccggcagugcuaucucuggugacauaaagaaagccuauugugguccaagguggauggcagacuacacagggcagagaugagaccaaauggcauagaggaaguuuuguuuuguuuuuuugacacagagucuuacucugucgcccaggcuagagugcaguggugcaaucucggcucacugcaaccuccgccuccuaggcucaaaugauccuccuaccuuagccuccugaguagcugagacuacaggcaugccaccaugcccggcuaauuuuugaauuuucaguagaaacggggcuucacuauguuggccaggcuggucucgaacugcugaccucaagugauccacuugccucagccucgcaaagucugggauuacaggugugagcuacugugcacagccggcauagaggaaguuaauuguagcuggaagucaaguuugaagagcgccagcuagagguccucauuuccauuaugguagguauuuauuugguauauuucccucccauauauucucagcacugucaggugcuggucaaugugugucuuuuuugucagucuuggccugcugaaggauaucucagaggcccuucccaguaaucugccauuugcucagauuaugacuauucuucaguguaucagugacucuaauucuagguccuuggaacaguagagauagucaaccuaaagcacuugaaaaaaaaaauccaucuagcuuaucuggccuggcuaaguuuccaggcuuucaguagcuguucuaggcugcaguaguucuuguauacucuuacuggaugccaggacucugauauagugccuccaagucucacaugaagccuuauaacaaggaauucucaucuccaaguggagugguugcuauacaaugacaucaguuucugucugaaauaggcacaggagcaaggauucucagaacugaguccuccuaaaaaauggccucccgcuguaugaggucagacuggaucaagcuaugccaggaucagguggaugguaaauaauuagccccuggacugccuuaguacucuuggggaacuagauaaucccuaucuguuucugaagaagcaauuuaccuagacuguuauggaaaguggaguaagaauuuauaucaguaggggugaucaaacuccaaaagaugguuaccuaggagaucuucaauuuuuuucuguuuuucuuuuuucuuuuuuuuuuuuugagauggaguuucgcucuguugcccaggcuggaaugcaguggagcaaucucggcucggcacaaccucuaccucccggguucaagggauucuccugccucaaccuccugaguagcuuggaggcacccacuaccacaccuggcuaauuuuuguauuuuuaguacagacacaguuucaccauguuggccaggcuggucucaaacucccgaccucaggugaucugcuugccucagccucccaaaaugcugggauuacaggcaugaaccacugcaccuggccaagauccucaguucugaacccuguccagcaucaugcaaaucuccuuggcuggaaagaagcagaaacauuagcuugugggaaacucucacuaaugucauccaaauaucagucuaguaggucaaaugcuagaauguggcacaagccacacagcauuaccauagagcugcauuagacaaggcuucucuggaaaaccaucuucuuuucaccuugugggauguggaugaggccauagaaaucccaaagucugaugucauaaagauucauguaccauagagguuugucuagaucaggagaagaugguagcaguccaggauggugaugaauuugaaauaaaaauaaccuucaugaagauggaacuaaccauuuuuuuaaagaguaccucaguauggucugcuaagccccuuaccauaaacucgcuugauauacccuugagaggccucaggcuuagggaaaaggcauaugcauuuucuuagcagaagaaggccuuugcauaggcucaguuacagccuuaccucuggugugagagcagauucucagccuccucugauaagacucccccaguuuauuuaucugaaaucacuagagaacgguuagugagugagaaagagcuuaacagaggaccaaaguagcacuaguggaaaguguagguccucaaagagauggucagguuaugggcauccagucaggggaugggguggcgcagggcaaugaauggccauagcacaaggcuuccacaaaaucuccucaucuggauaauuuuauaaguuccugaacccugaaguucccucaggaagggcuccucaugauaguguccuccauauggcuauagccuuaacuuuuauagggagauacaccucaaaacaucuugaaauccucauuccagauuaccuuuaucugaaaaccuggucucgccacacagagcucuacccacuuuuagguaaaugaggacuaagugugucauagaguuggccagugggucuccaccaccaucuguggcagguccagccugccaaaaucaggauccccaccacauccugggguggacagaagaaggggcuauucgcagcaggccugagaaggcuugaacacauuucuagauguauaguguggguuccaagagacugcuugguucagaaguauaacagccuguugugaagaauccuucugaagccuucccagaaccaaaaugagaacucagacauuucauucaacucuuagaugagaagugauauauaccuauaguagcauauuuucaaauaguaaaauauuauugcuucccugacauacacccuaaauguucaugguguuuuagucuuguaauuuucuaccacauuaaauuugcuauuuuaaauuuggauuuagcaccuauauauuaauacauaagauuuauuuucucuauacucaucuggacuuuuuaaaggacauuaguagcuaugugaaauaaaaugggaauacuuucagucguuaucuaugcucuuacacuguuuauauagcauggggauuacccuacuccuugaaagucugcauaauucucagcaaacuaucacaaggacaaaaaagcaaacaccgcguguucucaaucauaggugggaauugaacaaugagaacacauggacacaggaaggggaacaucacacacuccggggacuguuguggggugagggcaggggggagggauggcauuaggaaauauaccuaaugcuaaaugacaaguuaaugggugcagcacaccaacauggcacauguguacauauguaacaaaccugcacauugugcccauguacccuaaaacuuaaaguauaauaacaauaaaauuaaaauaaaaauaaaaauuaaaaaaaagucugaaaaaaccugucugaggaauccaggcaaaauuuuuagcauuucuaaaaauuagugcauccaauuuuucacugaaaauuggccaauuuucuccuucaaggauuaaugauacuauuuuccuagaaaagucuccaucuccuagagauuuaaaauguauuagcaagauguuguacauaaauuuuauaacauaaaaguuuuuaaacaguuuuauaauaguuauaaaacuguucaaaaacugugagaucugucauacauacagagagacauaaaauacacauaugcaguuuaaagagagaauugcucccuacaugccaguccucauauaccauaauauucauaauauuuauucuacuauuuauggacauuugaguuguuuccaguuugaggauacuucuagaaauaaucuuggaauauccuuuuuuuuuuuuuuuacacggaguuuugcucuuuuugcccaggcuagaaugcaauggcacgaucucaccucaccgcaaccuccgccucccggguucaagugauucuccugccucagccuccugaguagcugggauuacaggcaugcgccaccacgccuggcuaauuuuguauuuucaguagagacggggucucuccauguuggucaggcuggucuugaucucccaaccucaggugauccacccgucucagccucccaaagugcugggauuacaggugugagccaccacgccuggccagaauguucuuauguaugucucuuagucuagagcacuuguguaagagcuuaucuaguauacugacagaugaauagaauuguuuguugcaaaguguguugcaacuuuaacagauaaugucaacugauuuccaaaguggauguacaaauuuauauucuuaccagcaguauagaaguaccuguugcucccucauucuuguuaacacuuguauugccagacuuugcaauuucuuuuuuuuuuuuuuuuuuuuuuuagacagaguuuugcucuuuugcccaggcugaagugcaguggugcaaucuuggcucaccacaaacuuugccucccggguucaagcgauucuccugccucagccuccccaguagcugggacugccggugcgugccaccaugccgggcuaauuuuguauuuuuagcagagacagagguucaccacgcuggccaggcugaucuugaacuccugaccacaggugauccgcccaccucggccucccaaagugcugagauuacaggcguaagccaccacacucggccuagacuuuguaauuuuugccagcuuguuauguaaguagugauauuaguuuguauuucccugaucacuuaugaaauugagcagcuuuucauaaguaugucaaccauugggauuuucucuuuggugagguauacauucaggcuuuuugcccauuuuucuauuggguuguguauuuuuauaauauugauuccuagaaggucauuuucuauucuggauacugguccuuugucaguuauaaguguugcaaauacagucucccauuuuguggauuguuuuuguuuuaaugguauuuucuugacaaaaauaauucuuaaauuuaagguaaucaaaauuaugaaccuuuucccuuugaguuagugcuucuuaucucuuacuuaaaaaaaauuuuccuacccccaagaucuuagauauugucuucuaaaagcuuuauaauuuugacuuucacauguagguuucuaguccauuuggaauugauuuuugugugaaguaaaagucucauuucaucucuccuauauagauagccaauauuccuaguuuuugaguuuuuuuguuguuguuuuguuuuguuuuguuuuaagacacagucucacucugucgcccaggcuggaaugcaguggcgugauuggcucacugugaccuccgccuucccgguucaagcgauucuccugccucacccuccccaguagcuggaacuacaggggugcaccaccacaccuggcuaauuuuuuuguauuuuuaguagagaugggguuucacuguauuagucaggauggucucgaucuccugaccucaugauccacccgccucagccucccaaagugcugggauuacaggcgugagccacugcacccagcccccuaguauuuuuaauuggaaaguucaucauuuccucauuaauucuguaugccaugcuuauauaaaaggccauaaauuuuugguucuguuuuuugauuccauugacauaguuguccaucuuugaacuaacaccaugcuguuucaguuuagcuuuacaagaaguuuaaaauaugggaggaugaguccucucaccuuauuuucaaaaguguguuagcuauucuugguucuuugaauauccaaaacagcuuuuagagacaguuugucaaguugaaaaaaaaacuguuggaaacuugauugugacaccuagauuagugcuguuuaauagaacuuuccauaauaauagaaauguucuauauaugugugguccaauaugaucccugguagcaacauguacuauuaagcacuuaaaauauggcuaauaugacuggagaggugaauuuuuaaauuuaaauuaauucagccaggcaugguggcucacaccuguaaucccaguacuuugggaggcugagacggguggaucacuugagaccaggaguucaagaccagccuggccaacauggcaaaacccugucucuacuaaaaauacaaaaauuagccagguaugguggccugugccuguaaucccggcuacucaggaagcugaggcacuagaaucucuugaacccgagaggcagaguucaagagagcugacaucgugccacugcacuccggccugggcaacagagccagauucugucucaaaaaauaaaaauaaauuaauucaaaugugaauagcaauauguggcuaguggcuacuguauuggacaggaucgcuacauagcauccugaggagaauugacaucuuuacaauauagaaucuuucaguucaugaacaugguguaucuuccacuuaggucuuuuaauguuucucaaauaaaguuugaaauauacucuagaaagaaacugaucaacuuuuauuagauuuauuccuaaguacuuuauaauuuugaaauuauuauaaauauuaccuuuuucauguuucauaacuacuuaaugcuggcaggcaauacacacacacacacacacacacacacacacacacacacacacacauaauguacccugcaauuaauggcuauauauauauauacauauauagccauuaauuuuuuaucaauuggguuguauccaguguaccuauagauacauuacagauguuauauuacgaacuugcauuccuagaacaaaauuaacauguucauaauguguguuaccccucucauuuacugcuggauuugauuugccuguauuuuguucaggacuuuuguauuccaugugagacuggucuauaauuucccuuucuugaacaaucccuuuugcguuuuuguauaaaaaguauucccucuucuuuagacccugaaagagucuguauaagaacagaauuauuuauuuauuaaauguuugauagggcuuucuguugaagcugucuauacuuagagcaucuuuugggggaagauuuuugacgaauuccuuuaaugguuauaggacuacuuggguuuuuaauuuauucgcaagucuucuggguuauauuuauuuguccauuucaucuaaauuuucaaauguuugugauaauguccuucauaaucucuuccuacuaucuuucuaaugucugaaucaucugaguuacucauuccugaaauaauuuuuugcaucuuuuugucuuaauuaaucuugccaaaagcuucccaauuuuagucuuuuagcagaccaauuuugggcucucuugaucaucuccuuuuagucagguauucaaaaacauaugauacacccauuuaaaguguauaauucaaugguuuuuaguuauucacaaaguugugcaaccaucgcugcaaucuauuccuagaauauuuucaucaggccccaagaaagccuguaccuguuagcaguuguucauuucccauuccucccccuccuuuacaagcuccaggcagccacuaaucuuucugucucuauagauuugccuauucugggcauuuuacgugaauaaaauaauacaauaugaggucuuuugaaauauuuuaugugaauaaauauguggucuuuugaaacaucacaauauauuacugacuucuuucacucaacauguuuucaagguucuuccauguuguugcauguaucaguacuucuuuacugccaaauaauguucuauuauauaaauauacugcauuuuguuuaucuagucgcaauugauggacauuuagguuguuuccaguuuuggucuauuauuguuugcucuugugaauagcacagcagugaacaugugaaugcauaugucuuuuugguagaaugauuuauuuucuuuugguauguagacaguaaugggauugcuguguugaacuguagcucuguuuuaaguucuuugagaaaucuccagacggcuuuccacgauggcuagacuaauuuacauucccaacaacagugaauaacaguuuuccuuuuucucugcagccucacuagcaucuguuguuuuuuuuugacuuuuuauaagcuauucugacugguguaagaugguaucucauugugguuuugauuuguauuuacuugaugauuagugaugcugagaauuuuuucauauguuuguuggccacuguguaucuucuuuugagaaauaucuguucauauccuuugcccauuuuuaaguggguuauuugguuuuugcuuguugauuuguuugaguucccuauagauucuagauauuaggccuuugucagacacauaguuugcaaauaucuuccccuauucuggagguuuucuguuuuuccaaugacaguuuccuuucugugcagauguucuuuaauuaggacccacuugucuauuuuuguuuuuguugcuacugcuuuuggagauuuagccaaaaauuauuugccaaggucaaugucaagaagaauauuuuccagucuuguuuucccagauuuuuauaguuugaugucuuacauuuaaaucuuuaauccauuuaucccagcaccauuuaaugaauagggagucuuuucccccuugcuaguuuuugucagcauuguugaagaucagaugguugguaggugugaagccauauuucuaaguuuucuauuauguuccauuagucuacaugucuguuuuuguaccaguaccaugcuguuuuguuuacuuuauuauauaguuugaaguaagguagugugaugccuccagcuuuguuccuuuugcucaggacugcuuuggcuauuugggcucucuuucaguuccauaugaacuuuuaauauuuuuuucaaauucugugaagaaugacauugauaguuugauaggaauagaaccgaauuuauaaacugcuuugggcaguauggccauuuuuaugauauugauucuucuuauccaugagcaugaaauguuuuuccauuaauuugugucaucucugauuucuuucagcaguguuuuguaguucuccuuguagacgccuuucaccuccuuggcuagauguauuccuagguauuugauuuucuuguggcuauuguaaguggaauuguauucucgacuucacucucagccuggacauuauugguguauagaaaugcuauugcuuuuuguauauugacuuaguauccuaaacuuuacuaaaguuguuuaucaauucuaggagccuuuuggcagagucuuuaagauuuucuagguauagaauccuaucaucagcaaagacagauagcuugacuucuucuuuuccuguuuggaggccuuuuauuucuuucucuugccuaacugcucuggcuagcacuuccagagcuauguugaauaggaauaguaagacugggcauccuugucuuguuccaguucucaaggggaaugguucaagcuuuugcccugaauucaguacgauguuggcuaucgguuugucauagauggcucuuauuauuuugagguauauuccuucaaugucuagucuguugaggguuuuuaucaugaaaggauauuggauuuuauugaaagcuuuuucugggucuauugagaugcaguguuaagagaguaauuucauaaugauagagucaauucacucuaaauguauuugcaccuaauaacauagcuucaaaauacaugaagcaaaaacugauagaacuccaagaaaauaaacaaaacauaauuauagucaagguuucaauacuccucucugaauaacugauggaucaaguagacagaaaaucaacaaggauauaggacacuuaaauaagacuaucaaccaauuugauuugaacuccaucaauaacagaauauucuucucaauuguacauggaacaguuaccaagacagauaauguucuagguucucaaacaagucucaauacauuggaaaggauguaagugguacaaaauauguucucugacuacaaugaaaucauauuacaaaucaauagcagaagagcucuggaaaauacucaaauauuugggaacuaaauauacuucuaaauaacccauggaugaacgaagaaugcaaaauggauauuaaaauguauuuuaaauggaauuaaaaugaaaacacaacauaucaaaaucugugagaugcagcuaaaacagaaaguuuguacuacuaaaugccuacggggguaugggggaggagguaaaaaggucucaaaucaauaaucucagcuacacuuuaagaaaccagaaaaugaagagcaaauuaaacccagaauaaguaagaaaauauaaacaauaaagacuagacuggaaauuaaggacguagaaaacagaaaaauuguggagaaaaaucaaugaaagcaaaaucugguucuuugagaucaagaaaauuggacaaucuuuguguagauucaugaaaacaaaaagagagaggauucaaaauuuccauaacagaaugagacaguggacauccuacaauuauuaaaagaauaauaagggaauauugugagcaauugcaugacaauaaacuagacaacuuagaugaaaucgcaaauuccuuacaaguccaaagcucacucaagaaaaggaaauaauagcucuauaugugauaaauguauuuaaacuuguuaaagaaauuagauagcucuauauuuguuaguuaaaaacuuucccacaaugcccagaugcuucacuggugaauucuaccaaacauuuauggaagaaauaaacaauucuacacauauuauuucuaaaacagaagaguaagaaacacuucuuaacucauuuuaaaaggccagcauuacccugauaucaaaaccaaacaaagauauuacaaaacaaaacuauuuaauaaauaucccuuaugaacaucagugcaaaaauucuaaacaaucaaucaauugaauuugcaacauauaagagggacaauacaucacgaucaaguggaguuuauuccaggaauacaauacugguuuaacauucaauuuaaaaaucaauaaauguaauucaccauauuaacgcacuaaaaaagacaacucacgagcaucucaauagaugcagcgaaaggauuugauaacauccaacauccauuacugacuaaaaaaaaaaaaaaaaaagaauuuucagcaaacaugaaauaaagaagaauuuccucaaucuaauaaaggguaucuauaaaaaaaaccuauagcuagcauuauacuuaaagaugaccaauuaauacuuuuucccuaagauggaccaaggcaaggauaucugcucucauuacuuuuucaaccuaguauuauacagucuuauuagugcaauaaggcaagaaaaagaaaaaauauauacagauuggaaaggaagaaauaaaacugucccuaucugcagauaacaugacugcaugacuguguauuaaaaaucccaaagaaucugaaaaaaacaaaauaaaaaaaauucuuagaaggaauaagugaauucagcaaggucacaggauaugagauuaauguacuaaaaccccauuguaauucuauauauuagcaaugaauaaucagaaauuguaauuauaaaauaauaccauguauaguagcaccaaaauaugaaauacuuagggauaaaucucacaaacuauauguaagaucuauacacugaaaacuauaaaacuuugcuuaaagaaauaaagacaaacaaaugaagagauagaccauguucacagauuuaaagacuccauauuguuaagauaucaauucuccacaaacugaucaauagauauaauaucaauuaaaaucucagcaagguuucuugaggaaauugauaggcuaauuauaaaauauggaaagcaaaggaccuagaauagccugaucuugaaaaaaaacaaauuuggaggauuuauauuaccugauuuuaaaacuuauuacaaaacaauaguaaugaaggcaguuuggagacggugacaauguugacaaauggaucaacagaacacaacagaauguccagaauaauaccaagacauauaugguuaaaagguuuucaaucaagauacaaaggcaucucaauagagaaaguacagccuuuucagcaaauggugcuaaaacaauuggauauccaaaugccacaaaaugaacuugaauccaaccccagcaccauauuuuuaaaaguuaacucaaaaugggucauagacuugaauauaaugccuaaaacucuaaaacuucuagaagaaaacauaggagaaaaucuuuaugauguuguuaugcaaaaauuucuuuagauagaauaccaaaagcaaggucuauaaaagaaaaaaaaucagagauugaacuucaucaaaauuaagaacuucucucuuugaaagacacuauaacugggcaugagguucaugucuguaauccuggcuacucuggagacugaggugggaagaucacuugagcucaggaguucaaguccagccuacgcaacauaguaaaauacuaucuuaggaaaaaaaaaaaaagacaaaucacagacugagagaagauauuuuaaaaucauguaucugauaaaagacuugguaucgagaaaaaaaacagcugucuaaacucaauaauaaggaaacaaacaaaucaauacuaaacgggucaaagauuugaacagacauuacaccacagaaaauacauggauuacaaauacacacaugaaaagaaguucaacaucauuggucauuaagaaaaugcaaauuaaaaccacaauaacaucccacuacucacuuauuagaauguauaauuuuaaaagacugacuauaucagccaggcgcaguggcucacaccuguaaucccagcacuuugggaggcugaggagggcggaucacuugaggucaggaguuugagaccagccuggucaacacggugaaaccccaucuccacuaaaaauacaaaaauuagcccggcauaguggugcacgccuguagucccagguauucaggaggcuuaggaagcagaauugcuugaacccaggaagcagagguugcagugagccaagaucaugccacugcacuccagccugggcaacagagcgagacuccaucucaaaaaaaauuuuaaaaagacugacuauaucaagugucagugaguauguaaagcaacuggaacucucagauacugcuggcaagaguguaaaaaugguuuaaccaccuuuuaagaaauugauauaucauauuuguacauauuuuggaguacaugugauaucuugaugcauguguacaauguguaaagaucaaagcaggguaacagggguauccaucaccucaaacauuuaucuuuucuuuauguuggagauagccaauucuucucuucuagcuauuuugaaauauacagcgaauuauuguuaacuauaauuucccuaauguacuaaugaauacuagagcuuauuccuucuaccuaacugcacuuuuguacccauuagccacuuuggaaggcaguuugaccguuucuuuaaaaguuaaacacacacauuccaugugacucagccauuccauuccuagauaucaacccaagagaagugaaaguauacauccauucaaagacuuacauaugaauaugcacugaaguuaucuaguaauaauuuaaaacuggaaacaauucaaaugcauaacaacagagacuaaauaaauugugucuauccauacaaugaaauauuacucagcacuaaaaagcauaagugguugauaaaagcaacaauaugugugaaucucuaaguaaucaugcuuagugaaauaagucagagaaaaaaaaguauauucuuuauaauuccauuuuuauaaauucuagaaaauaaaaaaaaucuuugguguuaguagaucagacauuggugacaagaugaggcuggaaggauaaauaaaagaggaguacaaggaaacucuggguguguuugauauguucccuauuuuucauuuuuauuaauuguuuuuaugaguauaugcauauuuuagaacuuauaagauuguauucuuuaaauaugugagcuuguuguacaucaauugaacuucaaaaaucugauaaaaacaaacaaaacaaaaacaaaacuaaggggaagacagaguuauuaccuucaacuuauccaccucauaaaggucuucaguagcauuuuugugugaguuaguggauuuacucagagccauugcuguuaccaucccuuugcaacaacugcaaaaagggggaaaaaaagaaaaagaaaaagagcaaauacacacucagcauaaccuauuuauugcugguucuucuucuaaguguuuaaaauuuuaaaaauccagacaaaguggaaguucaccauaauaauucagcuacugacucaccaaggagaauaauuugucuccucaauuucuuacccuuguccuccuucucccuuccaucccucuuauucuugacccuuaguaauacugaauugaaaugaagggaaaauuugcuuagaaugcaaaagcuacuuccugaauuuaaaguaaugauagcaucaagcuugcaucucaguuaauagauuacaauuuuccagacuucaucuuuauucaguggaaaucuucuagcuuuucagauauaaggguuuguggguuguuguuuuuuuuuuucuuccauuuuguaaaaagaaguuuugguuggcauuuagugaagcacauaaaaguauacauucagggcugggcaugguggcucauggcuguaauuccaggacuuugggaggccaaggugggcagaucacuugagaucaggaguucgagaccagccuggccaacauggcaaaacucuaccucuacuaaaaauacaaaaauuacccaggcaucguggugcaugccuguaaaucccagcuacucaggaggcugaggcacaagaaucucuugagccugggagguggaggcugcagugagccgagaucacgcuacuacauucuagccucggugacagaagaaaacucugucuaaaaaaauacaugacgguacacaagaaacuacaauauucuucuuaaauccacucccucaccaguauguguaaaaguguaagaugugucuuauuuaugcaagaaagugaguccuuuuuuccuaauucuuacucccacauacacacacuucucauccugcccgugccaacaguuuucaaaagaaaaaccaaaaucucauauuauaacugcucacaguguuaaagcuaguugaaaaacugaacuaguauuucuuucaagguuuuaaaauaacuccuauugcuacuacuucacugucucuucucuguuauaugcgacauucaauucuucaaaagggcaacaauaaaauaaccgcuucaccugcucaaauagcuggaguauugguacaacuuccuugucaguucaaucgcaucuagcuccaaucgcgcaacuccuauaucauguuucucagcacuuuccuccuccaacuuuaggagacagucuuggucaguaaaguuggguaucauuaaaaucagcaaguuuaccauccacuggaucauagauauauguaacucauccaucuguuaaaaaaugaguauaauacaaaugacccacuuuaaauaaaucaaacaguaaaaaucacaccaaauuuuaaaauagaaaugaucgugccuguguccaacuuucaacauuauaauucuuaaugaaaucaagucaucagcuagcaugacccuauuuucuuuugcucacuacaugacacuaagcuacucucuucuuuuuauugauaucuauuuauuuaauuuuuuugaaacggggugucacucuguugcccaggcuggagugcagaggcauaaucauagcucacugcaaccuugaccuccccaggcucaggugauccauccaucuuaaccuccugaguagcugggaccaccaugccuggcuaaguuuuguguuuuuuguagaaaugggcuuucaccauguugcccaggccgaacuugaacugcugggaugaagcaaucugcccaccucagccucccaaagugcuaggauuacaggcgugaaccacacgcccagccacugaucucuucuuuagccuggccauagauaauaaccugugagaaccuacaauucucaaauugcacaucaaggcauuccagggcuccacagcaaacucacaaggaugccauaggauuuuaaauugagggaaauaacaguaauauguaacaucuaccagacacagcaugaacuuaacacaauucacaguuuucaacuuuagaugcccuauauuaauuuugaugacaucauaucuuuuugaaacugguuugauuggugguugugugauaaaaaaaaaaaaaacaaguacugugugaaaauuaacauggaacaggaaaugaaggugguaacguccaaucugauuccaaggucagagaagcuguaccaugccaaaaguacaugccuuacauugguaagugguauugauuaaaugagaauaaaauaaaagguuuuuucuuucaauguauguguaguacuuuuccaaaugguuaauaaauuguuaggacauuaaauauuuaguaagcgguuugaaccuaccuacuuaauaaacuuaacugugagguauuucuuuuggcuuaggagugugaaaauauugaaacccaaagggcacugugaauagagaaaguuugagaaccucugcaugacaguauuugcugaggcuaggucccagaaauaaaaugcagaaaaccuguaugcaaaauucagacacaccauacuuuucaaauacccuacucccuuucgcuguuugguuaguucuggaguauuucucuaggcuuaaacaugaucuacucugagaagacuuaccaguuuccacuggcucuaauuugcucccuuucccauguuuuuacaguacuuuguauauaucucuguuauagucauuugcacaucuaucuccucaauuaaccugucuguaagacaugagccaucaacuuaucccugcauaccacacaguacuuaucagggaguaaguucuuaguaaauguuucuugaaugaaugaauaaaaauaaaauguaguagccuaggccgggcgcgguggcucacgccuguaaucucagcacuuugggagaccgaggcagguggaucacgaggucaggaaaucgagaccauccugccuaacauagugaaacccagucucuacuaaaaauacaaaaaauuagucgggcgggguggugggcgccuauagucccagcuacucggaggcugaggcaggagaauggcuugaacccgggaggcggagcuugcagugagccgagacgguuccacugcacuccagccugggcgacagagcgagacuccgucucaaaaaaaaaaaaaaaaaaaaaagaaaaguaguagccuauccaauaaaaacccaaacuuccugcuucuugauucagacaggaagguuguuaaugaccuaaagcaacguugauuaauguauuugacaccugaauuuauguaucaggaaaaggggcaaccuuuccugagaaagaguuaaaaaggcaagucuuuuucacaagaaaaagauacuacuuccuuacauauucuacuaguuaugucccugcugcuucuuugugaaaauacauaaauuccuaacuauucuuucauauaccaauggccuagauuauacuaucauugaaacaacucauuuuugcuuacauaaaauauuaaucaauccuuggacuauccuuaggaaauaagcacaaauagauguuauuaucuuaauuuaaaaguuauauuagagagauuaaaugguagaaucaaggucaaauaauaaaucauaggugaauuuaaaauuaaaauaaauuaaaaacaaagaauaucuuuuacuuuccuaaagauauguaauucuuuuuaaugagauggaaagugaauauaauuuuugugcuaaaauauagauuuacugugauucuuauauaaaauucuuaaaagacauuuuaagaugaauugacugcuuuucuuuugugaaaagacuucuuccaaauuuacuaaucuuuucagggauaacaagugaguaauuagccacuucuuagcugauauuaagaaauaaaugugccaggugugguagcucacaccuguaaucccagcacuuugggaggccgagacagguggaucaugaggucaggaguucaagaccagccuggccaagauggugaaaccuggucucuacuaaaaauacaaaaauuggccuggugugguggcacgcgccuguaauuccagcuacuugggaggcugaggcaggagaaucacuugaauccaggaggcagagguugcagugagcugagaacgugccacugcaguccagccugggugacagagcgagacuccauuucaaaaaaaaaagaaagagagagagagaaagaaagagagagagagacagagagaggaaagaaagaaagaaagaaagaaagaaagaaagaaagaaagaaagaaagaaagaaagaaagaaaggagagagagagagagaaagaaagaaagaaaaagaaagaaagaaagagagagagaaagaaagauagaucaggccagguaugguggcucaugccuguaaucccagcacuuugggaggccaaggugggaggauugccugagcucaagaguucaagaccagccugggcaauuuggugaaaccccaucucuauaaaaaccaaccaaacaaacaaacaaaaaaaaccacacacauacuuaauuugucccuuucaaauauaugugaaauuuaacaaugagcaaaagaaacuuauacuauggagagguuguuuugaaaaugaauaggaggaaauauuuccaucuuggugugaguuuguugcuaaaaaugaaacacagcucaccuuuuaaaagucuaaaaucuacauauauauaaaaucuggaaguauguuucuaaucuuuuuaaaaaucuuagaaauaaagcauuucaauuggcugggaacacuuuguuaaaauauaggaaugcuacacugucuaauguuuuagacaacuguaagaacaacugauugacauuaugauagauggaaaaaauuacuaguuaauuuaaaaaaaaccuuugcauaacugauugacggaauugaaauuucucuuuuuuuuuuuuuuuuuuuugagacauggucucacucuguuucacaggcuggagugcaguggcacaaucauaguuuagugcauccuugaccucccaggcacaagagauccucucaccucagccucccaaguaguugggacuauaggugugugccaccaugcccggcuaauuguuuuauuuuuuguagagaugaguucucacuguguugaccagguuggucuuaaauuccugggcuuaaagcaauccucccaccuuggccuuacaaagugucgaguuacaggcaugagccaucacgccuggccugauugauggaaaugaaaagugaauauuaucauucuaaugauguauuucuucaauuuggauucauguuucuuucugagcuaucauuucagcagugacugccauuaaaaauuaguauugaaggaaacugaauuuagaagcagaccuucaaauagcuuuauaaucacaaguuuaaucugcaauuuaaaccugcaauuauaaaaaaucaugaagcuuuucaaucaguuuuuugaaccauuaccaaaaaucauuuuuaaauauuguuaauuucauacauuuggcuuucuguauauguuuuauaauguaccaaacaugucaacugaguaauuuuugcaugcaaaucagaaauaguaaguuagaaaggcuugcucaaagacuuuuugcuaauggagguacauaauaaaaaacguuuaguggccaguguuuuagacagccaagcagcacagguaaaaugaaguaaggaggcaaaggaaaaacaaugacaaaaaaacuggagauaagaacauggaucaggagggaaaauaaaugucuguuuuuucugaaauuagaauagcaacucuuguuuuuacaguuuuccauuugcuugguagauuuuucuccauccuuuuacuuggagacuuugggugucacugcaugugagacaggucucuugaagacagcaaacuauuagguuuuguuucuuuauccaacuugccacucugugccuuuuaauuggggcauuuagcccauuuauguucaagguuaguauugauauguguggauuugauccugucaucauguuguuagcuggcuacuaugcagacuuguuugguugcuuuauaguagucuaaauacccaaguguguauuugucguggcugguaauggucuuucuuuuccauauuuagcacucucuucaggaccuccuguaaggcacaucuggucacaaaaaauucccucagcauuuguuugucuaaaaaggaucucauuucuccuuugcuuaugaagcucaguuuggcuagauaugaaguucuuguuuggaauuucuuuucuaagaaugcugaacauaagcccacaauuucuuuuggcuuguaggauuucugcugacaugucugcuguuagccuuauggaguuugcuuugcaggugaccugccccuucucucuaccugccuuuaacauuuuuucuuucauuucaaccuuggagaaucugaugacuaugugucucauguauggucuuauuuuguaguauuuuucaggggcucucugcauuuccugaauuugaauguuggccccuuuagugagguugugaaaauuuucauggaugauauccugaaauaugcuuuccaaauugcuugguuucacucucucucuuucaggaaugccaaugaguuguauauuugauauuuuuacauaauuucauauuucucagagguuuuguucauucaucuuuauuguuuuuuauuuuugucugacugaauuauuucagagaaccagucuucaaacucugagauuuuuuuccucagcuugguugauucugcuguuaauacuugcaauugcauuaugaaauucuuguaguguguuuuucauuucuaucagguuuuuuuuuuuuuuuuuuuuuugagacagaguuuugcuccuguugcccaggcuggagugcaauggcacgaucuuggcucacugcaaccuccgccucccaaguucaagugauucuccugcgucagccuccugaguagcuggaauuacaggugcccaccaccaugccuagcuaauuuucuguauuuuuaguagagaugggguuucacuauguuggccaggcuggucucgaacuccugaccucagucgauccacccaccucagccucccaaagugcugggauuacaggcauaagccaccgcgccuggugguucuuucuuauaauggcauuucaucuaucagcuccuguaucauuuuauuguaauccuuagauucuuuggauugaguuucaacuuucuuguacguugaugaucuuuguuccuauacauauucugaauucuauuucugucaugucagccugguuaagaaacauugcuggggaacaguguggucguuuggaggugagaagacacucuggcuucuugaguugccagaguucuugugcuggcucuuucuaaucuuugugagcugauguuccuucagucuuugaaguugcuguccuuagaaugcauuuucuuuugucuuuccuccucuuugacauccuuggagguuugauucagguauaaguuggguucagucaaccugcuucauuucuggaagauuuuagggguccaaggcucagcuuaggccuucuggacugcaugcucuaacucuagggucugguaucagguccccagcuuuguuaucuggccccucaagguuaggaaccuacuguauuggaagagccaagguguucccagaccacuggucacaacacuccaaugggugaugccagccaaagcaauucauuagguggugacagugggauccgugcuuguuuacacaugccaggagcagcagcagugcagcagggugcgugcucaucagcugugguggggcacuaaugagggcagggauguggacauuugcagugguggcagugcagcauguugcaggggguagcccaccaaugucccugugcauguucacgcaugggggccgagugcuggcagaugcaggacugguaaccucugugcacauacucgcacaggcagcaguggcugcacaaggugggaggcaggucugcuggcauccauguguaguuucaugccagcagcacuguuggcacaguggcggggcacuggcaggcacaagguuagcagucucuguacccaugaacacuccaauggcaauggcagugcaggacagauuguggggccacuggucuccuugcauaccuuugcauugguuaugggguggggagugugaugcacucacaguggcagcaguuggcaugguagggugcaugugcacaugugcacugguggggaaggaggggcaaggucugaauacaugcaaccacacuagcaaagcaauguaggggguggucaugggugagugcacacuggcaaauggcaugggggaggcugugauggguagaguacaugggcgggcuggugcucauuaguugggggugcucugcuggagcucuccaauggucaggcauggucugccaguacaggagcuaugaugcaggccccugggaggcaccucagcugggcauccaaggcugcacugcaaacaggcauggucaggcuggaguccugggagaguccacaagacaggggggugcucaggugaaacuggcccugucuuaggggcaagaucacccuguauuguucaggucugauaguuccccuaagauuaaugucuccuaaaggagcaaggcaggccuugggggauaggcaccccugacugugcuccacuauagaugcuccugcaccaaacccuccaggcuccacacuagcugggaguaccaccccuaccaccucucuaagcagcucucucugccagcucaagugacuguggggguccugggauauccugcugucugaauuccagaugccuacggcaagaguaggucacuucucgccugcuuagcucacuuuuuccccaagagucacuggggaccaggaaggagucccagugugugguaucccugugcaggguuuccagcuuccuccuccuuuagcccagcaucucuaucuucccucuguccacccucaaugccuucccucuaaagauaugcuuggagugcaccagucuuuccaaucuucuagucccucaguggcagauguuucuccuggcugaauuuagucagccaucuugucuccuauauccaacuuuucuguuucuaaauauuaauaagaguuaauauggauacacaggauacacauaauuccucauggaguuuacaaucuugcaaauuuucuacacagauuaauuuuaauaaugcaguguuaaaauugagguauauaaaggcacuuucuaaguaaucccacacuauaaaaauuaaauucuagaaaauaacaaauugagcauaugauuucauggagauaaaucccuaaugguaaaucaagcauuuuugccaaagaagggauuaauguagcagcaccauuagauaccaacagugcuggaauauucuuccuaaauucauucaacaaacauuuacugagucccaccaugugacaagcacucuguuacccuuuuucuuauucauuuugguugucagaggaauuucucccaagccuagggauugccugaauccguacuaccagcuuuaacauauuugcucauugacucuucaauugcaaaacuucauuccagaggcagaaacauucugcuuuaaaaaauccauugaaaauuauuugagaaauuauuauacaagcuucuauuuugcccucucaaccuccugcuucauuuaaauagggagagcauuauuuuuccuugaagaaauuugccagccgaggcaaaauauaacgucaaaaacccuuacaaguacauacguggugcugaaguucaauguuaccguuguuaauuucauugccuaucuucaaaagccauuguugaaucauguuaaauauauacgcuuggaguacccugaaggaaaaaucaaguaaaauaaaagugacuggcugauuuaaaggauaaauguaacuaucagcuaugagaaagaguuuuauuuggcuggguauuguaaacuuagauguugacaacugcuugagaacugaggaaaggggaaucaaagcccugaauuaucuaguaugauaguuuacucacugacaaagcuuuccuaacccccaaguagguagcaagaugcacuuuggacaaagcagaucuuacguucaauauuagcucucuacuguaaaaacuuacacccuuuacauuuacuuccaggccaguacuaugugagaagaaugaauuuuaaaauccucucaaugaaugacuuccagcaugauagugugaggagcaaggcugcccuuuccaccacccaccacccccgaaacugguaacaauuauuuuuuuaaauacaccacuuaaagccucuaaaaauggugcuauggagaaguuccaaaaacaucuauucgagaaaaucuaugaagauucaguaagaaaggcaauaaucuaugguauuugaaccaugacugcuccuuccucuccuuagcucagugaggcagcaacuccauuucagaaugcuguagccaagaacacagagcucccuaacccucuagcucccaaucagauggcuuucuuccauggauuuuuauacugccuccagcuaucugguguugagucuagguacuggguaaaugcagguaacaaguagggguugucuuuuuccacccagccccuauauauauaauaaauacucuacccuaugcauagcaugcugagaaucaugggucccugauugucugggcuuguaaggcagugguucuacuccaugagaggcaauccaagaagaccucaggcugcuacuuuccccucuaaggaguucucaggucugacagugugagugucacucagagagaagcuuuccauugucucuacccccagcucuagagcccuagcucagagauuuugccuggagauagaagaaggcaaaaaaaaaaaaaaaaaaaaaaaaaauuaaaaagcuccuaaucuugucccaaauaaacuaacuucauuugcaacguagccugaagauguucaaaccuaagggugcuuuaaagaacaguggagguuuggugaaaugcaauucaguggagauucaagauauagguuaaacuguaggcuaacuaguuugcaggaaacaaccaggcacuaagacaacuagaagaaggccacuugaguucagaacaagaucaaacacugaucucaggaauuauucuuuccaaggagccaaaacuacaugaaaguaguuuuagcacaauauaugccccagagaauuauugaaaacaauagauaauuuaugcagccaacagacacaugaaaaaaugcucaucaucacuggccaucagagaaaugcaaauuaaaaccacaaugagauaccaccucacaccaguuagaauggcgaucauuaaaaagucagcaaacaacaggugcuggagaggauguggggaaauaggaacacuuuuacacuguuggugggacuguaaacugguucaaccauuguggaaaagaguguggugauuccucagggauccagaacuagaaauaccauuugacccagccaucccauuacuggguauauacccaaaggauuauuaaaucaugcugcuauaaagacacaugcacacguauguucacugcggcacuauucacaauagcaaagacuuggaaccaacccaaauguccaacaaugauagacuggauuaagaaaauguggcacauauacaccauggaauacuaugcagccguaaaaaaugaugaguucacguccuuuguagggacauggaugaagcuggaaaccaucauucucagcaaacuaucgcaaggacaaaaaaccaaacaucgcauguucucacucauaggugggaauugaacaaugagaacacuuggacacaggaaggggaacaucacacaccagggccuguugugggguggggaaaguggggagggacagcauuaggagauauaccuaauauaaaugaugaguuaaugggugcagcacaccaacauggcacauguauacauauguaacaaaccugcacguugugcacauguacccuagaacuuaaaguauaauuaaaaaaauauauaaaauaaaaaaauaaaaaugaauacauuuuauuuuaaauaaaaauaaauaaauaaauaaaagcaaaaacaaacaaacaaaaaagaaaacaauagaccaaucaacuagaaauuagugaaguuuaacagcuugguguggucaaagaaaaagaagcaagccuugacaaaacaccacugucacugcagggugacagugggcauacccaaaaacugcaccuucuugagagcaagaucagagucuuaauacaaggaagagggggguagcaaccaaaguugcuacaguauauuaucuaauauguccaguauccaaaaaccaaaaacaacaacaacaaaaagaaaccuuacaaggcaugauaagaaacaagaaagugugacauauacaccagguaggcaacagaaacugccugugagagugaccagaacucugguuuuucaaaaacuucaaaguagcugauaagguuuggcuauauccccacccaaaucucaucuugaauuguagcucccauaauucccucauguugugggagggacccagugggagauaacugaaucaugggggcggucucccccauacuguucucgugguagugaauaagucuaaugagaucugaugauuuuauaaggggaaccccuuucacuuggcucucauucucuucucuugucugcugccaugugagaugugccuuucaccuuccaccaggauuaugaggccuccccagccauguggaacucugagucaauuaaaccccuuuuccuuuguaaauuacccagucucagguaugucuuuaucagcagcaugagaauggacuaacacaguaaaucgguaccuggaguggggagcuacuguaaauauacccaaaaaugugggagcgaccuuggaacuggguaacaggcagagguuggaacaguuugaagggcucagaagaagacaggaaaauguggaacaauuuagaacuuccuagacacuuguugaauggcuuugaccaaaaugcugauaaugauauggacaauggaauccaggcugaggugguuacagauggagaugaggaacuucuugggaaccggagcaaagaagacucuuguuauauuuaagcaaagagacuggcagcauuuugccccugucuuagagauuuguggaacuaugagcuugagagagauuauuuagaauaucugguggaagaaauuucuuucuuucuuucuuucuuuuuugagauggagucucacuccgucgcccaggcuaaagugcaguggugcgaucucggcucaccgcaagcacugccucccagguucacgccauucuccugccucagccucccaaguagcugggauuacaggcacccaccaccaugcccagcuaauuuuuuguauuuuuaguggagacaggguuucaccauguuagagaggauggucucaaucuccugaccucgugauccgcccaccucagccucccaaagugcuaggauuacaggcaugagccaccacacccagccuuuuuccuuuuuuuuuuuuugagacagaguuucgcucuuguugcucagacuggagugcaauggcauagucucagcucaccacaaucuccgccuccugaguucaagagauucuccugccucagccucccaaguagcugggauuacaggcaugugccaccaugcccagcuaauuuuguauuuuaguagagacagggcuucuccauguuggucaggcuggccucgaacuccugacuucaagugauccacccgccuuggccucccaaagugcugggauuacaggcaugagccacugcacccggccaguggaagaaauuucuaagaaucacagcauucaaggggugacuugggugcuguuaaagguauucaguuuuauuuauuuuauuauuauuuuuuugagacagagucucucucugucucacccaggcugcagugcagugguuugaucuuggcucacugcagccucuaccucccagguucaagcgauucuccugucuuggccuccugaguagcugggacuacaggcaugugccaccacacccagcuaauuuugcauuuuuaguagagauugaguuucaccauguuggccagagcuggucucgagcuccugaccucaagugauccaccugccucagccucccaacaugcugggauuacaggcaugagucaccauacccagccagguauucaguuuuaaaagggaaacagagcauaaaaguucagaaaauuugcagccugacaaugcaauagagacaaauaucccauuuuuuaagagaaauugaagacagcugcagaaaucugcauaaguaaugaggagccaaauguuaaugcccaagacaauggggaaaaugucuccaggucaugucagagacguuuggggcagccucuccuaucacaggccugaaggcuuaggaggaaaaaauggcuucaugggccaggcccagggucccucugcugugcccugcaucccagcugcuccagccaugacuaaaaggguccaagauacagcuggggccauggcuucagaaagugcaagccacaagccauggcagcauccacaugguauugagccugcagaugcacagaagccaaaaaucaagguuugggaaccuuugccuagauuucaaggauguauggaaaugacuggauguccaggcagaaguuugcugcaggaguggggugcuaauggagaacgucugcuagggcagugcagaagggaaaugugaggugggcacccccacacagaguccccacuggugugcugccuaguggagcugugagaaaacggccacuguccuccagaccccagaaugguagauccaccaacagcaugcaccgugugccuggaaaacacguagacacucaaccccagcccaugaaagcagccaggagggagccugugccccacaaagccacagaggcagaacugcccaagaccaugagaacccaccucuugaaugagcaugacccagaugugagacauggagucaaaggagaucauuaugaagcuguaagauuugucugcccugccggauuuugaauuugcauggagccaguagcccuuuuguuuuggccaauuucucccauuuggaaugccuguacuuacccaaugucuguagccccuuuguaucuaggaaguaacuaacuugcuuuugauuuuacaggcuuacagguggaagaaacuugccuugucuuggaugagacuuuggacuguggacuuuugaguuaaugcugaaaugaguuaagacuucuggggacuguuuggaaggcaugauugguuuugaaaugugaggacaugagauuugggaggggccaggggcaaaaugauaugguuuggcuguguccccacccaaaucuuaucuuaaauuguagcucccaaaauucccucauguuguggcaggaacccagugggagauaauugaaucaugggggugguuucccccacacuguucucaugguagugaauaagucucaugagaucugaugguuucauaaggggaaaucccuuucacuuggcucucauucucuucucuugucugcugccauaugagaugggccucucaccuuccaccaugauuuuuugugaggccuccccagccacguggaacugugagaccauugaaacucuuucuuuuguaaauugcccagucuuggguaugucuuuaucaacagugugaaaaugaacuaacacauguuaguucauguucacagaacuaaagaaauccaugacuagauaaacaaaggaagguauuauaacaauguugcagcaaauaagagaauagaaauuaaaaauauaaauuggaaaaaagaaauaaaugaaaauuuuagagugaaaaagaacaauaacugaaaaaaauuuaaaaucacuacuagggcucaacaguaaauuugaacuggcagaagagagaagaauugaacuugaagauaaauauauggaaguaauucaagccaaaaaauaaagaggaaaaagaaugaagcgacaugaaaacagccuugaagaaauaugggacacccuuacauauaaagggaguauuggaaguagagaaaagaaaaagguacauaaagauauucaaagaaacaggaucugaaacuuuccaaauuuauugaaaaacaauaacacauucaagaagcuuaacaaucuccauguaagauaaauacaaagaggucuacaaacuuauauaugagagucaaaaugcuagaagucaaaauaacgagaaaaucuugaaaguggcaagagaaaaacaacacaucacuuacaagggagucccaauaagauuaacagcugacuucucaaaauaaacaauaggugccaaaaagcagugggauaacauauucauagugccuaaagaagaaaaaaaugucaaccaagaauccuauauccaacaaacauguguuccaaaaaugaagguggaauaaagacugccccagauuuaaaaaaaaaaccgaagaauuuguugcuaguagacuuuccuuacaauaaauccuagaggaaauuuuucaggcugaaagcaaugaccacagaugguaauuagaaucuacacaaaaaacaaggcauuauaaacaaaauuaugcaauuuuaaaagacagaauguaugcauauuuucuauuucuuaacugacuaaagaagaaauuguauaaaauaacauaggacauauuguuggaccuacaacauaaaaauguaauauauguguaauauauaugccaaaacagcacacaagagguggaugggagcaaacucuaaugggugauagaaaugaugacagaugguaaauuuauaauuauaacaauguauuuuuguguuuguaauauuguauuacaccaauucuacaaugcuauaaagaaauacccaagacuggguaauuuuuaaacaaaagagguuuaaucaacucacaguuccacauggcuggggaagccucaagcagcuuauaaucauggcguaaggggaaggaaaagcaaguaccucuucacaaggcagcaggaaaaagagaagugcaagcaggggaaaugccaaaugcuuauaaaaccaucauauugcauaagaacucacuaucaugagaacagcagggugaaacagcccccaugauccaaucaccuccuucccuugacaugugagaauuacaggucccucccuuaacacaugaggauuacaauucaagaugagauuuggguagggaaacagagccaaagcauauuauucugccccuggcccuuuccaaaucucauauaauuucacaugucaaaaccaauuaugccuucccaacagucccccaaagucuaaacucauuucagcauuuauucaaaaguccacagugcaacaucucaucugagcaaggcaagucccuucugucuaugagccuguaaaauaaaaaaaacaguuaauuccuuccaagauacaaugcagguagaggcauuggauaaaugcucucauuucaaaugggagaaauugaccaaaaccaaggggcuacaggccccaugcaagucugaaauccaguaggccagucauuaaaucuuaaagcuucuaaauaaucucuuuugauuccacaucucacauccaggucaugcuaaugcaagaggugcauucccauaggccugggcagcuccaauccuguggcuuugcagggugcagcucccaccuggcugcuuucauggucugguguugaaugucuguggcuuuuccaagugcacagugcaagguguugaugcaucuacuauucugaggucuggaggacaguggcccucuucucacagcuccacuaggcagugcuccaguagggacucugugugggggcuccaaauacauuucccuuucguacugcccuagcagagguucuccaugagggcuauaccucugcagcagaccucugccuggacauccaagcacuuccauacauccucugaaaucuaggugaagguucccaaaccucaauucuugacuucugugcacccacaggcccaagaccaccuuuugaagcaauggcccaagcuguaccuuggcccuuuuuagccacagcuggagcugaaguggcugggacacaggacgccaugucccaaggcuucacagagcagugggggcccugggccugacccaagaaaccauuuuuaccuccuaggccuccaggccugugauaagagggguuggucugaggaucgcugacuugcucuggagauauuuuccccauugacuuggcuaugaacacucaguuucucauuacuuacacaaauuucugcagcugucuuuauuuccuccccagaaaacggguuuuucuuuucuaccucauggucaggcugcaaauuuuccaaacuuuuaugcucugcuuccucuugaaugcuuugccacuuagaaauuucuuccaccagauacccuaaaucaucucucucuaguucaaaguuccucagauuucuagggcagagucaaaaugccaccagucucuuuacuaaagcauagcaagggugacuuuuauuccaguucccaguaaguuccucaucuccaucagagacuaccucagccuggacuucauuguccacaucacuaucagcauuuuggucaaaaccauucaacaagucucuaggaaguuccaaacuuucccacaucuuucugucuuccucugagcccuccaaacuauuccaaccucugcccauuauccaguuccaauguggcuuacauauuuucaggcuaacuuuauagcaguaccccaauuccaguaccaauuuccuauauuacuccauucucacacugcuauaaaaaaacuacccaagacuagguaaguuuuuuuuuuuuuuuugagguggagucuugcucugucacccaggcuggagugugaacucggcucauugcaaccacuaccuuccagguucaagcaauucuccugccucagccucccaaguagcugggauuacaggcacccaccaccacgcccgacuaauuuuuguauuuuuaguagagacggggguuucaccauguuggccaggguggugucaaacgccugaccucaggugauccgcccacguuggccucccaaaauguuaggauuacaggugugagccaccacacccagccaagacuagguaacuuauaaacaaaugagguuuaauuugauucacagcuccacauggcugaggaggccucaggaaacuuacaaaacuuacaaucauggcagaaggggagaaagaagcaaguuccuucuucacaagguggcaggaaagauagaggugcaggcaggggaaaugccagaugcuuauaaaaccaucagaucucaugagaacagcguggggguaacugcucucaugaucuaaucaccuuccuccauugacauguggggauugcaauucaagaugagauuuggguggggacacagagccaaaccauaucaaauauuaagagauguaaugugcauaaaauuauaccacaaaaggugggaaaaggaaucaaacuagauagaaguauaucuauaugucacuagaauuaagccaguauaaaucugaagcuaauucuuuuuuuuugagacagaguuucacugcuguugcucaggcuggagugcaauggcgcgaucucggcucacugcaaacuccaccucuuggauucaagcaauucuccugccucagccucccaaguagcugggauuacaggcacccaccaccacacccagcuaauuuuuauauuuuuaguagagacaggguuucaccauguuggccaggcuggucuugaacuccugaccucaggugauccacccccaucuuggccucccaaagugcugggauuacaggcaugaccugaagcuaauucuguuaaauuaaggagguuaugguaaaaucuagagaagccauuuaaaaaacuuuuuaaauguagagaaaagucaguacagaaaugaauucuacauuagaaaguauucauucaauacaaaaaaaacaauaaaagaaaaacagagaaacaaaaaagucaugaaacaaaacaagcaguaagauggcagagguaaauccaaccaugucaauaauaucuuuaaagguaaauggauuuaacaauccaauuaaaaggcagagauugucagacuggauuaaaaacaugaaucaacuauauggucucuauagaagacacacuugagauucaaagauacaaauacauuaaaagcaaaagguauauaacaguauaaaaggaaaagauauguaacaguaaccacaauaaagcugguguggcuguacugauagcagauaaaauagauuuuaaaauuuaaaaaguuacuaaaaauaaggaaggauauuuuauaauuauaaaaggaucacuccaucaggaagauauaacaauuauaaacgugugcaccuaauaacaaaguaccaaaaauacaugaagcaaacaucaagagaaaggaagggaaaaacagacaauuuaagaauaacaguuggagacuucaacaucccacuaucaauaaugguuagaaccacuacacagaugauaaauaaggaaacagaagauuuuaacaauacuacaaaccaacuagaccagacaucucuagaacacuuucuccaauaaaaaugaaauauacauucuucucaaguguacauggaaaauucuccaggauagacaagaugcuaggcuguaaaacaaaccucuauaauuuuaaugcuagaauaauauaaaauauauacucacacuacaauggaaugaaauuacaaaucugaaacuggaaaaaaaugggaaacucacaaauauguggacauuaaauaacauacuccuaaauaacaaugggucaaugaauaaaucacaagagaaaucauaaaaauacuuugagauuaaugaaaaugaagacauaguccgggcgcaguggcucacgccuguaaucccaacacuuugggaggucaagguggguggaucacaaggucaggaauucgagacuagccuggccaaaauggugaaacccugucucuacuaaaaauacaaaaaaauuagccaggcgugguggcacaugccgguaaucccagcuacucgggaggcugaggcaggagaauugcuugaaucugggaggcggagguugcagugagcugaggucaugccacugcacuccagucuggguggcagagcgagacuccaucucaaaaaaaaaagaaaaaaaaagaaaaugaagacacaacauauugagcaguccuuagagggaaauuuauagcuguaaaaccuguguuaagaaagaagaaaaaucucaaaucaauaaacuaacagcucaacuuaagacuauggaaaagguagaguaaacuaaauguaaagaaagugaaaggaaggaaauaauaaugacuacagcagaaauuaauacaauagagaauagaaaaacacuaaaggaaaucaaugaaaucaaaagaugguuauuugaaaagaucaacaauauuaacaaacauuuagcuaaguugaccaggagaaauagagaaggcucaaauuauuagaauuggaaacgagagaagggaugcuagcacugaucuucuuucagaaauaaaaaggauuauaagggaauacaaugaacaauuuugccaacaaaucagauaacuuggaugaaauugucaaauuucuagaaagacacacacaaaaaacugauucaauaagaaauagacaauauaaauagacuuuuaacaagugaagagauugaaucaauucucaaaaaccuacccacagauggcugcaccacugaauccucccaaagagccaaagaugaaucaacaccaauucuucacaauaucuuccaaaagauaaagauggagggauacuucuaacucauuucaugaagccaguauuacauugauauaacaccaggcgaagacaucacaggaaaauaaaauagaccaaugucucuuaugaauaccaaugcaaagacuagcaaacagaauccugaacugaucaaaaguauuuuacacaauuaccaugugggauuuauccuaugcaagcaaaguuaauuuaauauccaaaaagacaaugaauguaauacaucauaugaacaugaaaaaaauaaucacaugaucaucucacuagauacagaaaaagcauuugucaaaauccaacaacuuuuuuauguaaaagcaugcaacaaauuaggaauagaagaaaacuuccuaaauccaauaaaaggcaucuaggaaacacccacaaauaacauuauacuuaauagugaaagacuggaugcauuucccauaagaauaggaacaacaucuuccauucaacauuguacugagguucuagccaaagcaauuaggcaagagaaggaaaucaaaggcaucuagauuaaaaagaaacuacuuguauuuauagguaugaucuuuuguauagaaaauacuaagaaauccuuuaaaaaauuauugcaacuaauaaaugaauucaguaagguuuugggauguaagaucaauauuuuaaaaaucaguuguguuccuauacauaugcaauaaacaaucugaaauaaaguuuuaaaaaucuuauuugcaauaacauuuaaaaaguacuuaggaguaaauauaacaaaagaaguguacagcuuauacucagaagaaauuaaagaagauccaaauaauuggaaaaacaucccauguucauguagaagacuuaacauguuuaagauagcaauauucccauucugauguacagauccaacaaauucuuuuucagaauccuaguuaaugucuuuguaaaaauugacaagcuuauucuaaaauuuauacggaauugcaagguacccagaaaagccaaaauaauccuguaaaagaagagucaaguagaaagacucacauuucccauuccuuuucaaaacauucuacaaagcaagaauaagcaagacaguguguuacugacacaaggguggacauauagaucaaugugauagaauuaaucauucagaaauaaauccaugacugauuuucaucaaaauugucaauaccauuaaguggagaaagaauagucuucaacaaauggugcugguacaacuaaacauccacaugcaaaagaaugaaauuggacccuuaccacauaccauauacaaaaauuaacuaaaauggaucagagaccuuaauguaagagagcaaaugcuacaaaacucuuacaaaaaaacauagggguaaauuuucaugaccuuggauuuggcaaagaauucuuagcuaugacaccagcacaagcaacaacaacaacagcacagaaaaaauuucccucaaagaaaauacacaaauagccaauaagcaugugaaacaauucuucacaucauuugucauuagggaaaugugaaucaaaacuacaauaaaauaacacuucagucccucuauuauagcuagaaucaaaagucagauaauaaguauuggcaaguauguggagaaaucagaacccacaugcacugcugaugugaauguaaaauuguguagguuuuccaaaaacaccuuggaaaacagucuggcaguuccucaaauuauuaaaaauagaauugccauaugauccagcaauuccacuccuuaggugauauauacccaaagagaaaugaaaacaaauguuuguccacaaaaagcaugcacaugaauguuuauugaaacauuacucauuaaggccaaaagauggaaacaauccaagugucuaucaauggacaaaugaauaaauaaaaugugguauauccauaaguagaauaugauucagucauaaaaaugaacuacugaaauaugccacaacauggaugaaccuugaaaaaauuaugcuaagucaaagaaguuagacacaaagaccacacaguacaaugauuccuuucaaauaaaauguccacaacaggccaggugugguggcucacaccuguaaucuaagcacuuuggaaggccaaggugggcguaucaccugaggucaggaguucgagaccagccuagccaacauggugaaaccccgucucuacuaaaaauacaaaaauuagcugggcaugguggcaggcgccuguagucccagcuacucaggaggcuaagguaagagaaucacuugaacccgggagguagagguugcagugagccaagaucucgccauugcacuccagccugggaaauaagagcaagacuucgccucaaaaaaaaaaaaaauuguucauaacaauacaaucaacaaagacaaaguagauuugugguugcuuagggcuggggguaggacgguaggagaggaugaaggauugcagaaugauagcuaaagugcauaaggcuucuuuuugaggugaugaaauauucuaaaauugaccgguaaugguuacuuauaucuauaaauauacugaacaccacagaauuguacacuuugaaaaagugaauuauauaugaaguguauugcaacaaaccuuuaggaaaauuaucucagaacaaaagaaaccuaugggaacuuacgaaacagaauccacaucuaugugcuguggaacaauaccaguaagguuuaacaauauauccaagugugauuucauuucauuaauuuuuucaucuauuuccugccauucuucaagaggcguaucaggaaacuccagguuuuccaacuugaaagaacagaagucaagagaacuaaucaaacuuggaagaauuuuggaguaaccuagaaaaguaagaaaagcauuaacuuuuagaaauauuuguaagacuacuauuuuaauaccaaauuauaaaauccuacugagcaagggcauuaucuuuuaaaaaucuuuuauuauccuacagcuugacuagcagagaaccuuacaaaaagcaguuccuaaauaaauguuuaaugaauaagcacuguguaauuggugcuuuaaugacuaacaaauuauuuuuucaaugacaguuuauauccuacauuucuugucuuuucagcugagaaucaaaugcauuaaacccagaaacuaucaacuauaguuuucuguaaaagaccuuaauucacuacaucauucuuuuaagaggacaaugauaauaaucagcuucuucaugauuaugggauagugaauaacaaauuaaaauagauuaucauaguucuugagucauuuuuuagguuauugaucaggguuucauaaaguuuauagcuuuuagucugaacaaaacuugaguguggauccuaauguggguccaguggacugauucacuaugagauuauggcaaaauacccucuuuuucuuauuuauuugcaaaauacaaaaugaaaacauucccaucucaaaguuauauaaagacaaguaauuuaaaaggaaacuuuuucuugucuuggaugaaaauauuuucacugccuuccuucaucaguaaauuuugaucuuuuaggaauauucaaaaugaucugcuaauuucaccaccauucauaauuuugacuucuucuuuuauuuuaaaccauuugcuaccucauuuuucucugcccacuguacacagucaucccucaguaucuacagaggauugguuucaggacccccauggauaccaaaauccauggauucucaagucccuuacagaaaaugaugugguauuugcauauaaccuaugcacauccucuuguauacauuaaaucaucucuagauuacuuauauaaccuaauacaaugcagauguuaugugauauuuauuauacuauauuguguuuuuauuuguacuuuuuaauuuuuuuuaaguauuuuugauccacgguugcuugaaucugaugaugcagaacccgcagauccagagggcugacauggauaaguauugccauuuuaucaauaacuauauuauugcugccauagaaaauuaaauuguguuuucccauguagcuuucauagugcaguuuuaaauugaacaauugugccagucaaugguucaggguugccucagacacuugcugagaaggauucuuaagaaacacaugaugcacugagcaaaaauguuuuaaugaauuuuuaauaucuuucauggauuuuggaggauggaacuucaauaucuuucauggaaauuugggauauuaagucacucuacucaggggucgggugguggacaaaauugaaguacagaauuugcuaaggaguagagguccugguaacaccaggauacuauugggaccccuaauucucugaagcauuacaucuuaagaauaacaguggaacagaaauagaacagcccucagaaagcccaaggccagacuucauuucagcucagucccugcuuggauuaaggugauccgugccugcacuaaaugaccugccagaauaaaaaguaaaauccuucuuauguaauauaguaucauccagagucucaaauuaucucuaaaacucuucacacacaauguccaacauucaaucagaaacagaaauaugaaaagaauggacucaaaaccaagacaaaaauacagaaaauaaaauagaacuauaggagaaccaaauauuauccaaucaccagacauggauuuuaaaauuaacugugacuacaacuuucaaguuauaaaaugacaagauggaaaauuucagcagagaacuagaaacucuaaaaguuaauaaauucuaggacugaaaaauauaauaauuaaaauuuuaaaaucaguggauguuuaccagaaaguuaaacuaacacacuaaagaaaaacaccgucaaauuauaauucuuagaaaauaaccauuaaggcccagcgcaguggcucaugccuauaaucccagcacuuugagaggucaagggggaggacugcuugagcuuaggaguucaagaccaagagcagccuaggcaacauaauuagaccccaucucaaaaaaaaaaaaaaaaaagaagaagaagaagaaagaaagaaaagaaaagaggagguuccaagauggccgaauaggaacagcuccaaucuacagcucccagcgugagcaaugcagaacucgggugauuucugaauuuccaacugagguauuggguucaucucacuggggcucgucugacagugggugcagcccauggagugugagcugaagcagggcggggcauugccucacccgggaagugcaaggggucagggacuucccucuccuagccaagggaagccaugaaagacgguaccuggaaaauugggacacucccacccuaauacugcgcuuuuccaauggucuuagcaaacggcacaccaggagauuauaucccgcgccuggcucagaggguccgacacccacagagacucacucacugcuagcacaacagucugagaucaaacugcaagguggcagcgaggcugggggaggggcguccgccauugcuaaggcuugaguagguaaacaaagcggccaggaaggucgaauuggguggagcccaccacagcucaaggaggcccaccugccucugcagacuccaucucugggggcagggcauagcugaacaaaaggcagcagaaacuucugcagacuuaaacaucccuggcugacagcuuugaagcaaguagugguucucccagcacagaguuugagaucugagaacagacagacugucuccucaaguggguccaugacccccgaguagccuaacugggagacaccucccaguaggggccaacugacaccucauacggccaggugccccucugagacgaggcuuccagagaaaggaucaggcagaaacauuugccauucugcaauauuugcuguucugcagccuccgcuggugauacccaggcaaacagggucuggaguggaccuccagcaaacuccaacagaccugcagcugaggguccugacuguuagaaggaaaacuaacaaacagaaaggacauccacaacaaaaccacaucuguacgucaccaucaacaaagaucaaagguagauaaaaccacaaagggggagaaaccagaguagagaagcugaaaauucuaaaaaucagagcaucucuucuccuccaaaggcacacagcuccucaacagcaacggaacaaaccuggauggagaaugacuuugaugaguugagagaagaaggcuucagaugaucaguaauaacaaauuucucugagcuaaaggaggauguucaaacccauugcaaagaagcuaaaaaccuugaaaaaaagauuagaugaauggcuaacuaaaauaaacaguguacagaagaccuuaagugaccugauggagcugaaaaccauggcauaagaacuacgugaugcaugcagaagcuucaguagcugauuugaucaaguggaagaaagaguaucagugauugaagaucgaaugaaugaaaugaagcaaaaagagaaguuuagagaaaaaagaguaaaaagaaacaaacaaagccuccaagaaauaugcgacuaugugaaaagaccaaaucuacgucuauugguguaucugaaagugacagggagaauggaaccaaguuggaaaacacucuucaggauauuauccaggagaacuuccccaaccuagcaaggcaggccaacauucaaauucaggaaauacagagaaugccacaaagauacuccucgagaagagcaacuccaaaacacauaauugucagauucaccaaaguugaaaugaaggaaaaaauguuaagggcagccacagagaaaagucggguuacucacaaagggaaguccaucagauuaaaagcggaucucuuggcagaagcucuacaagccagaagagagugggggccaauauucaacauucuuaaagaaaagaauuuucaacccagaauuucauauccaguaaaacuaagcuucauaagugaaggagaaauaaaauccuuuacagacaagcaaaugcugagagauuuuaucaccaccaggccugccuuacaagagcuccugaaggaagcacuaaacauggaaaggaacaacuggcaccagccacugcaaaaacaugccaaauuguaacgaccauugaugcuaggaagaaacugcaucaacuaacgagcaaaauaaccagcuaacagcauaaugacaggaucaaauucacacauaauauuaaccuuaaauguaaaugggcuaaaugccccaauuaaaagacacagacuggcaaauuggauaaagagucaagacccaucagugugcuguauucaggagaccaaucucauguucagagacacacauaggcucaaaauaaagggauggaggaagaacuaccaagcaaaugggaaaaaaaacagcagagguugcaauccuagucucugauaaaacagacuuuaaaccaacaaagaucaaaagagacaaagaaggccauuacauaaugguaaagggaucaauucaacaagaagagcuaacuauccuaaauauauaugcacccaauacaggagcacccagauucauaaagcaaguccuuagagaccuacaaagagacuuagacucccacacaauaauaaugggagacuuuaacaccccacugucaacaguagacagaucaaggagacagaaaguuaacaaggauauccaggaauugaauucagcucugcaacaagcagaccuaacugacaucuacagaacucuccaccccaaaucaacagaauauacauucuucuuagcaucacaucgcacuuauuccaaaauugaccacauaguuggaaguaaagcucuccucaguaaaugaaaaagaauagaaauuauaacaaacugucucucagaccacagugcaaucaaacuagaacucaggauuaagaaacucacucaaaacugcucaaccacauggaaacugaacaaccugcuccugaaugacuacuggguacauaaugaaaugaaagcagaaauaaagaugcucuucgaaaccaaugagaacaaagacacaacauaccagaaucucuggaacacauuuaaagcaguguguagagggaaauuuauagcacuaaaugcccacaacagaaagcaggaaagauauaaaauugacacucuaacaucacaauuaaaagaacuagagaagcaagagcaaacacauucaaaagcuagcagaaggcaagaaauaacuaacaucagagcagaacugaggagauagagacacaaaaaacccuucagaaaauaaaugaauccaggaacugguuuuuugaaaagauuaacaaaauugauagacugcuagcaagacuaauaaagaaaagagagaagaaucaaauagaugcaauaaaaaaugauaaaggggauaucaccacugaucccacagaaauacaaacuaccaucagagaauacuauaaacaccucuacgcaaauaaacuagaaaaucuagaagaaauggauaaauuccuggacacauacacccucccaagaguaaaccaggaagaauuugaaucccugacuagaccaauaauggguucugaaauugaggcaauaauuaauagccuaccaacugaaaaaaacaggaagaaguugaaucccugaauagaccaauaaauaacagguucugaaauugaggcaauaauuaauagcuuaccaaccaggaccagacagauucacagccaaauucuaccagagguacaaagaggagcugguaccauuccuucugaaacuauuccaaucaauagaaaaagagggaauccgcccuaacucauuuuaugaggccagaaucauccugauaccaaagccuggcagagacacaacaaaaaaaagagaauuuuagaccaauaucccugauaacaucgaugcaaaaauccucaauaaaauacuggcaaaccgaauccagcagcacaucaaaaagcuuauccaccacgaugaagcuggcuucaucccugggauucaaggcuggcucaacauaugaaaaucgauaaauguaauccagcauauaaacagaaccaaagacaaaaacuauaugauuaucucaauagaugcagaaaaggccuuugacaaaauucagcagcccuucauguuaaaaacucucaauaaacuagcuauugauaggauguaucucaaaauaauaagagcuauuuaugacaaacccacagccaauaacauacugaaugggcaaaaacaggaagcauucccuuugaaaacuggcacaagacaaggaugcccucucucaccacuccuauucaacauaauguuggaaauuauggccagggcaaucaggcaggagaaagaaauaaaggguauucaauuaggaaaagaggaagucaaauugucccuguuugcagaugacaugauuguauauuuagaaaaccucauugucucagcccaaaaucuccuuaagcugaucagcaacuucagcaaagucucaggauacaaaaucaaugugcaaaaaucacaagcauuacuauacaccaauaacaaacagagccaaaucaugagugaacucccacucacaauugcuucaaagagaauaaaguaccuaggaauccaacuuacaaggggugugaaggaccucuucaaggaaaacuacaaaccucugcucaacaaaauaaaagaggacacagacaaacggcagaacacuccauguucauggauaggaagaaucaauaucgugaaaauggccauacugcccaagguaauuuauagauucaaugccauccccaucaagcuaccaaugacuuucuucacagaauuggaaaaaacuacuuuaaaguucauauggaaccaaaaaauagcccacauugccaagacaauccuaagcaaaaugaacaaagcuggaggcaucaugcuaccugacuucgaacuauacuacaaggcuacaguaaccaaaacagcaugguauugcuaucaaaacagauauauagaccaauggaacaggacagagcccucagaaauaauaccacacaucuacaaccaucugaucuuuaagaaaccugacaaaaacaagaaauggggaaaggauucccuauuuaauaaauggugcugggaaaacugacuagccauauguagaaaccugaaacuggaucccuuccuuacaccuuauacaaaauuaauucaagauggauuaaagacuuaaauguuagaccuaaaaccauaaaaacccuagaagaaaaccuaggcaauaccauucaggacauaggcaugggcaagaacuucaugacuaaaacaccaaaagcaauggcaacaaaagccaaaauugacaaaugagaucuaauuaaacuaaagagcuucugcacagcaaaagaaacuaccaucagagugaacaagcaaccuacagaaugggagaaaauuuuuagaaucuacccaucugacaaagggcuaauauucagaguccacaaagaacuuaaacaaauuuacaagaaaaaaacaaacaaccccaucaacaagugggcgaaggauaugaacagacacuugucaaaagaauacauuuaugcagccaacagacacaugaaaaaaugcucaucaucaguggucaucagagaaaugcaaaucaaaaccacaaugagauaccaucucacaccaguuagaauggugaucauuaaaaagucaggaaaacaacaggugcuggagaggauguggagaaauaggaacacuuuuacacuguuguugggacuguaaacuaguucaaccguuguggaagacaguguggcgauuccucaaggaucuacaacuagaaauaccauuugauccagccauuccauugcuggguauauacccaaaggauuauaaaucaugcugcuauaaagacacaugcacaccuacguuuauuguggcacuauucacaauagcaaagacuuggaacuaacccaaauguccaucagugauagacuggggauuaagaaaauguggcauauauacaccauggaauacuaugcagcccagccauaaaaaaggaugaguucauguccuuuguagggacauggaugaagcuggaaaccaucauucucagcaaacuaucacaaggacagaaaaccaaacaccgcaucuucucacucauaugugagaauugaacaaugaggacacuuggacacaggguggggaacaucacauaccgaggccugucgugggguggggggaggugggagcgagagcauuaggagauacaccuaauguaaaugaugaguuaaugggugcagcacaccaacauggcacauguauacacauguaacaaaccugcacguugugcacauguacccuagaacuuaaaggauaagaauaauaauaaagaaaauaaaagaaaugaaagaaggaaggaaggagaggaaggaaggaaggaaggaaagaaagaaagaaaaagaaagaaagaaagaaggaagaaaagaaaagagagagagaaggaaggaaggaaagagagaaagaaaaggaaugaaagaaagaaaagaaaagagaaaagaaaagaaaggaaggaaagaaaggaaggaaggaagggaaagaaaagaaaagaaaaagagaaggaaggaaggaaagaaagagagagagaaagaaaauaaagaaaaagaaaagagaaaagaaaagaaaggaaggaaggaaaaaaggaaggaaggaaagaaagaaaaagaaagaaaggaaagaaagaaagaaaagaaaagaagagaaaagaaagcaagccuuuaaacaaaaaguaaucagcagacccaccacuauagaaaauaccaaagacauuucuucaaggaaaaagaaaauuauuccagaaagcaaaugcaaacguaggaagggagcaauaugagaauaaaaagaucuuacucuacaaauucacaaaagggaaagaucaguuauucuuuggccauagacucaagccuuaaacaaguaaucacaaaaucaauuuuaaacuuuuucaugagcauuuauuuugauuauauaaacauuaucuuauccuauguauuaauuuuagaagaauuauauuaugaaaauguauuauauuacauauauaauuuucuuccuauagaaccuaugucuuuuaaacaacuaaauguauucuagccaggcauaguggcaugcaccuguagucccagcuacucaggaggcugaggcaggaggauuguuugaacccaggaguucaaggccauuauucggccuggacauuauagguaaguacuuccuuuaaagaauguauucuugaggugauaaaaacuaauggcuuggaaguauuuuucccauucucauuuuuagguccuuuauugcuuaaguagagaaaaacaauuuacuuuuauuuauuuaauucugauucagucuccucaccaaacugucuuacugauuuuaaucuuuuuuuccuauaguuccagauuuucuaaguauauaacuauaauaucagcacaaagaaauauuuuaucuucucuuuuucaauauucauaucuguuauuuuacuuuauucuauuauuuuauuuucuagaaccaccaaaaaaaaaauaaaaauguugauaucaagcauccucaucuauuuuguuagguuaauuauaaaguuuaaguguuuuuccauucaugguauuacuauugguuuuuuauuuguuuuaguauuauauuuauguaguuuuuuucuagggauauuuaauuuagacuuuuucuugagaauaugcuguauuuuaacaaaacaauugcagcaucucuuauaugaucacacaguuuuuucucuuaauauuuuuaugaaauguauuaugcugaucaauuuccuaauguugaaucgcucaugcauuccuggaauauauucuacuugguuaaaauguuuugcuuuuaaucuuugcuaagcuauaauaauaauuauuauuuuauuuagaacguuugcaccuacugucauaaauaacagaaaauugauggguuuauuuguacuauauuuauuguguuuugacauuaugguuuucuggguucauaaacaauuuggaggauuuuccauauuguucuaaggcuucgaauuauuuaagaaucuuaaaauuauauguucuuuaaaguuuaaauaaaacuuagcuaugaagcuaggaauaaaaaagaaaaucggccuggugugguggcucacuccuguaaucucagcacuuugggaggccaaggugggugaaugacuugagcccaagaguuugagaccagccuggacaauaugaugaaacccaaucucuacaaaaaaauuagccaggagucacagcaugcaccuguagucccagcuaccugagaggcugaggugggaggaucacuugagcauggcaguuugaggcugcugugagccaugaucauaccacuacacucaggccucagcaacagaguaagacugucucaaaaaaagaaaaaaaaaaagagaaggaaagaaaagaaaagaaaaaagagaaaaucagcccaugauauuuccucacuucagaaugucagccaguuagcaacaauccuauucuaguuaccacaugccugaaagucaaucaaguaacaacagccucacuccaaauacaagguauccauggcugaaaguaaaacgaucucuaaauacucuuuuuucuuaaaguuuuucagucuuggaauuccaugcuucugugugaauaucucuugcuuuguucagagagguuguacauuguauuacagggcucccuuccuuaacaagcaaaaauucagcuuuuuuaugguuauuguauuugaauacuuguaucuuucuuagacgaacugaaaauaugaauauguggauaaaucuaaaugaauacuggcuauaugaaauacgaauaauaaugucuugugagauuuaaguauguaaaaagaacugaaacacaaacaaaaauaacacaaaguaugggggaagcuaaacuaagaacaaaauaaauuuugaaauguuuggaaaguaaauacuacaucuucuaaauaauccugagucaaaagacaaaccacaauggaaauuuaaaacugucuugccuuucugccccuggacgccgccgaagaagcaucauuaaagucucucuucucccggccgucuugucuaacucagagucuccuaaagagcccaaacaguugaggaagcucuuccuuggacgguugagcuuagaaacaagcaacgagagccugagaagccauuuugagcaaugaggaaugcucauggacugugugguaaugagauccaaauaccaagcacuccaggggcuuuggguuugucucacaugccacugcggagaagguggaugcagccaugaaugcaaggccacaaaagguggauggaagaguuguggaaccaaagagagcugucucaagagaagauucucaaagaccaggugcccacuuaacugugaaaaagauauuuguugguggcauuaaagaagacacugaagaacaucaccuaagagauuauuuugaacaguauggaaaaaaugaagugauugaaaucaugacugaggcaguggcaagaaaagaggcuuugccuuuguaaccuuugacaaucauaacuccauggauaaaacugucauucagaaauagcauacugugaauggccacaacugugaaguuaggaaagcccugucagaccaagagauggcuagggcuucauccagccaaagaggucaaaguaguucuggaaacuuuggugguggucauggaggugguuucagugggaaugacaacuuuggucacggaggaaacuucaguggucaugauggcuuugguggcagcugugguggugauggauaugguggcaguggggauggcuauaauggguuugguaaugauggugguuauggaggagguggcccugguuacuccggaggaagcagaggcuauggaaguguuggacaggguuauggaagccagggcaguggcuauggugggaguggcagcuauaauagcuauaacaacggagguggaggcagcuuugguggugguaguggaagcaguuuuggagguaguggaagcuacaaugauuuuggcaauuacaacaaucagucuucaaauuuuggacccacgaagggaggaaacuuuggaggcagaaguucuguccccuguggugguggaggccaauacuucgucaaaccacaaaaccaagguggcuauggagguuccaguagcagcaguagcuaugacaguggcagauuuuaauuaggaaacaaagcuuagcaggagaggagauccagagaagugacagggaagcuacagguuacaacagauuugugaacucagccaagcacagugguagcagggccuaggugcuacaaagaagacauauuuuagacaaauacugaugaguaugggcaaaaaacucgaggacuguuauuugugacuaacucuauaacagguuauuuuaguuuguguucugugaaaaguguaaagcauuccaacaaaggguuuuaauguaguuuuuuuuuuuuggcacccaugcuguugauugcuaaauguaauagucugauugugaugcugaauaaaugucuuuaaaaacaaaacaaaacaaaacaaacuaugucuuaaacuaaauaauaaaaauuaugcaaaacaugggaugcagccaaagcuggcuucuuaugacucaauucuauuggguuuccuccuacuucuauuguccuacuaucucucguuacccuuuaaaauguuggggauccauucuuaguccuuaguuauucccauuguauauuucccccccaaggugaucucaucaaaauucauggcuuuaacuaacacauauacuaguaucuuccaaaauuuuuuuuuuaauuuuuuuuuuuuuuuuuuuuugagacggagucucacucugucgcccaggcuggaguacaguggcgcgaucucagcucacugcaagcucugcgucccggcuucacgccauucuccugccucagccuccagaguagcugggacuacaggcgcccaccaccaagcccggcuaauuuuuuuuguauuuguaguagagacggaauuucacgguguuagccaggauggucuugaucuccugaccucgugauccgcccaccucggccucucaaagugcugggauuacaggcgugagccaccgcacccagccucuuuuuuuuuuuuuacuuuuuuuuuuuuuuuuuuugaaacagagucucacucucuccccuaggcuggggugcaagggugcaaucucugcucacugcaaacucugccucccggguucaagcgauucucccgccucagccuccugaauaguggggauuacaggcaugugccaccaugaccagcgcuaauuuuuuucuuuuuucuuuuuuuuuuuuugagacggagucucauucugucgcccaggcgggagugcaguggcacgaucuccgcucacugcaaacuccaccuccuggguucacgccauucuccugccucagcuuccagaguagcugggacuacaggcgccugccaccacgcccggcuaaguuuuuuguauuuuugguagagaugggauuucaccauguuagccaagauggucucaaaccacugaccucaggugacccaccugccucggccucccaaagugcuagaauuauagguuugagccaccgugccuggcgucuuccaaaauuucauccaagauuuuucucccacauuccugacaugccuguugaacaaguccacuuaauugugccauagcuacucgaaagucaguaugucuaauacuaaauacacaaucucccuuccccauacuuuuccuucuccuguauucucuaaucuuaauaaauuggaugacccauuuacaguccaaucaggaacacagccaucccacaauacucucucucacacacacaauuguguagccuacauuuuuuaaaucucuuauuuuucuuuccucuucuccauucccaugucuuaggauagguccucaucauuucucaacuuauuccuguaguagauuccuguauuaguccauuuucaugcugcuaauaaagacauacccgagacugggcaauucacagaagaaagagguuuaauggacuuacaguuccacguggcuguggaggccucacaaccauagcagaaggugaaaggcaugucucacauggagguagacaagagaagaaagcuuguguagggaaacaccccauuauaaaaccaucagaucucaugagacuuauucccuaccaugagaacagcaugggaaagaccugcucccaugauucaauuaccucccacugggucccucccacaacacaugggaauucaagaugagaucuggguggggacacagccaaaccauaucauucugucccuggccccucccaaaucuccacacuucaaaaccaaccaugccuucccaacaguccccccaaagucuuaauucauuucagcauuaacuuaaaaguccacauuccaaagucucaucugaaacaagaccaguccuuucugccuaugagccuguaaaaucaaaagcaaguuagucacuuccuagacacgaaggggguacaggcauuggguaaauacaggcauucuaaaugggagaaauuggccaaaacaaagggccuacaagccccaugcaaauccaaaaucuagcaggagaguccauuuuuuuuuuuuuuuuuuuuuuugagacagagauuugcucuucuugcccaggcuggagugcaacggugcgaucuuggcucacugcaaccucugccucccagguucaagugacucuccugccucggccuccugaguagcugaaacuacaggugcaugccaccacgacuggcuaauuuuguacuuuuaguagagauagaguuucaccauguuggccaggcuggucucaaacuccugaccucaggugauccgccugccucagccucccaaagugcugggauuacaggcaugagccacugugccuggacagcagucaaaucuuaaagguccaaaaugaccuucuuugacuccacgugucacauccaggucaugcugaugcaagagaugggcucccauggucuugggcagcuccaccccugugguuuugugcgguacagccucccggcugcuuucauggucuggcaaugagugucuguggcuuuuccaggugcauggugaaaacuguugguggaucuaccauucuggggucuggaggacaguggcccucuucucauaacuccacuaggcugugccccaguagagacucuguguggggucucugaccccacauuucccugcugcacuucccuagcagagguuuuccaugagggcccugccccugcagcaaacuucugccugggcauccaggcguuuccauacauccucugaaaucuggguggagguucccaaaccccaguucuugacuucuguacacccgcagguucaauaccacauggaagcugccaaggcuugaggcuugcacccucugaagccacagccugagcucuauguuggccccuuucagccacagcuagagcagcugggacacagggcaccaaaucccuaggcuacucacagcauggggacccuggacccagcccacgaaaccauuuuuaccuccuaggccuccaggcuuaugaugggaaggggcugccaugaagaccuaugacaugcccugaagacauuuuccccauggucucgggggauuaacaguuggcuccccauuacuuaaguaaauuucugcagccagcuugacuuucuccucagaaaaugggauuuucuuuucuuuuuuuuuuuuuuuuuuuuuuuuuuugagacggagucucgcucugucgcccaggccggacugcggacugcaguggcgcaaucucggcucacugcaagcuccgcuucccggguucacgccauucuccugccucagccucccgaguagcugggacuacaggcgcccgccaccgcgcccggcuaauuuuuuguauuuuuaguagagacgggguuucaccuuguuagccaggauggucucgaucucccgaccucaugauccacccgccucggccucccaaagugcugggauuacaggcgugagccaccgcgcccggcgggauuuucuuuucuaucgcauugucaggcugcaaauuuuacaaacuuuuaugcucuguuucccuuuuaaaacugaaugccuuuaacagcacucaagucaccucuugaaugcuuuguugcuuagaaauuuauucugccagauacccuaaaucaucucucucaaguucaaaguuccacaaaucucuaggauggggcaaaaugcugccagucccuuugcuaaaauauaacaagagucaccuuugcuccaguucccaagaaguuccucaucuccaucugagaccaccuuagccuggauuucauuguccauaucauuauuagcaucuuguucaaagccauucaacaagucucuagggaguuucaaacuuucccacauuuuccugucuucuucuaagcccuccaaaccauuucaacuucugccuguuacccaguuccaaagucgcuuccacauuuucagguaucuuuucagcagcacccuacucuacugguaccaauuuacuguauuaguccauuuucauucugcugauaaagacauacucaagacugaauaauuuauaugggaaaagggguuuauuggacuuauaguuccaugcggcuggggaagccucauaaucaugguggaaggcaaggaggagcaagucacaucuuaaguguauggcagcaggcaaagagagagcuugugcagggaaacucuaccuuauaaagccaucagaucuugugagacuuauucacuaucaugagaacagcaugggaaagaccuggccucaugauucaauuaucucccaaugggucccucccacaacauguggaaauucaagaugagauuuggguggggacacagccaagccauaucagugaaaauuaauagagaauagaaaaacaauauagaaaaucaagaaauccaaaagcugguucuuugaaaagauccacaaaauugauaaaccuuuagcuaguuugaccaagaaaaaauuaagacucaaauuauuagaaucagaaacuuaaaaguuguagggcauuacuaccaacuguggagaaauaaaaaggauuauaaaguggacgauuuuuuuuuuuuuugaaauauacggacaaccaaaacugaaucaaaacaaaccaagaaaaaaaagacaauauagauagaccucuuaaagagcagguuaaguccguaaucaaaaacccaccuaugaagcuaagcccaggcccagauggcuuuaccacuaaauauuaucaagcauucaaaaagaauuagcaccaguucuuuacaaacucuuccaaaauaacagaaaaggaggaaaaucuucccagcccauuucaugaauccaguauuaugcugacaccaaaaccagauaaagauaucacaagaaagaaaagcuacagauaaauauaucuuauaacuauagaugcaaacuccucaaccaaauaccugcaaaccaaagcuagaaacauauaaaaagaauuauauaccaugaucaaguagguuacguuuuuuugagacagugucucucucugucacccaggcuggaguaaagugguguggcuauaccucacugcagccucuaacuccugggcucaaggcauccuccugccucagccuucugaguagcuauguagcuauguguacaggaucucacuauguugcccaggcugucucgaauuccuggcuucaaguaauccuccugccuuggccucccaaagcauugagauuacaggcaugacccaucacucccagcccgaaguaggauugauccuaggcaaggaagauuggauuaauauccaaaaaucaauguaauauauccuacugauagaauaaaagacaaaagacacacaauuaucucaaugaauacagagaaagcauuuuuaaaaaaaaaucccacacauuuucauguaaaagaauucaauaggaauagaacagaauuuccuaaaccugauaaaaagcaucuaugaaaaacccacagcuaacaucacacuuaaucggcaaagacucaugcuuuccuacuaaggacaagaauaagacaagaauaucuacucccaccauuucuguucaacauuguacuggagguucuugccagggcgauuaggccagaaaaauaaauacaagaauccaggccaccauggcucacgccuauaaucccagcacuuugggaggcugagauggguggaucacaaggucaggaguucgagaccagccuggccaacauggugaaaccccaucucuacuaaaaauacaaaaauuagccuggcauguggcagaugccuguaaucccagcuacuggcagaugccuguaaucaagcuggggcaggagaaucgcuugaacccaggcagcagagguugcagugagcugagaucgcaccacugcacucuagccugggcaguagagcaacacucugucucaaaaaaaaaaaaaaaaaaaaaaaaaaaaaaaaauccagauuggcaagaaacuaguaaaacccucucuucacuauaacaugaucucauaaacagaaaauccuaagucguccacuaaaaaaccagaaacuauuagaacuaauaaaugaguucagcaacauggcaguauguaagaucaauauacaaaaucaauucuauuucuauacacuuuaagugaaaaaucugaaaauagaacugagaaaaaaucuucauucacaucaucuagaagaauaacauacucaaaaaaauauuuaacaaaagaaauauaaaacuccucagaaaacuauaaaacauuguuaagagaaauugaaaaauaucuaaauaauugaaaaaaaauccauguuuauagauuggaagacuuaacauuguuaagauggcgauacuccccaaacaaaucuacagaugcaacauaaucccuaucagaagcugauuucuucauagaaauugauaagcugauuauaaaauucauauagaauuucaagagaugcagaauagccaaaacaaucaugaaaaagaauaaaguaggaggacucauacuucucgauuuugaaacuugcuuuaaagcaagaguaaucaagacaauguggcacaaggacaaacauacacaugaguagaauaggcuuaagacuacaaaauaagcccagagaucucugguuaacugauuuuugacaaggaugccaagacuauuaaauggaggaagaauguuauuuucaauaaauggugcuaggacaacugaacauccacaugcaaaagaaugaaauuagagccuuaccucacacacuauauaaaaauuaacccaaggccaggugcgguggauuaugccucuaauuccagcacuuuggggggcugaagugggaugaucgcuugaacccagaaguuugagaccagccugugcaacacggugagauccugucucuacaaaaaauaaaaaaauuagucaacagugguggcacacaccuguaguccuagcuacucagagguugaggugggaggauugcuuaaacccaggaggcugagacugcaaugagacaagaucaugccacugcacuccacccuacaugacacagcacaacucugucucaaaaaaaaaaaaaauuaacucaaaauggaucaaauaccauuauauaagagcaaaacuauaaaacucuuagaagaacuaaacguaaaucuucaugacuuuaaauuuaggaaaggauucuuagauaugacaccaaaaguacaaacaaaaaagaaaauaaaaucgguaaguuggauggacuucauugaaauuaaaaacuuuuguacuuaaaaggacacuaucaggauguccuggcgagucccaagcugaaggaggcggcuccaggcagugcggagcgcuggcggcgggcccaggcugcagcgugugcgugcccaggagacacacacaaucuuguagaaaauuucagcuguagcccuuggaguagaagcugaaauaacagaagcuguacgaugcauuacgguauugaagaaaauuaacuuuuauauuaaauauuuggaauauaaggaaauaaggaaagguggcugaaaauggugcagaagaaaauacaaaucacaugcauaauggaugaaaggaacugagaggccacuuuuacaaagagagaguuuggauuaaugaagaaagccuaugaacuuagugugcucuaugacugugcauuuucaacagcucuaacaaacucuuucaauaugcuagcacugauauggacaaaguucuucucaaguauacagaauauaauuaaccuuaugaaagcacaaccagcucagauauuguugaggcucugaacaagaaggaacacagagggugcgacagcucagacccugauacuucaugugugcuaacuccauauacagaagaaaaauaauuaaugaggaauuugauaauaugaugcagaaucauaacauugcaccugguuugccaccucagaauuuuucaaugucugucacaguuccagugaaaagccccaaugcuuuguccuacacuaacccagggaguucacuggugucaccaucuuuggcagccagcucaacguuaacagauuuaaacacgcucucuccaccucaaaccauauuacauagaaauguguccccuggagcuccucagagaccaccaaguacuggcaaugcaggugggauguugggcacuacagacuucacagugccaaauggaacuggaagcagcccaguggggaaugaauuuguaaacucaagagcuucuccaaauuugauuggagcuacuggugcaaauaguuuagguaaagucaugccuacaaagucucccccuccaccagguggcaguaaucuuggaaugaacaguggaaaaccagaucuucgaguugucauccccgcuucaagcaagggcaugacaccuccacuaguaaguugaaccuuucuucaacuucauucuuuaaaacauguauuuuauacauagccuguagcuuccuuuggaauuuucugcgccaacuguagaaucuauaccuauuccuaaugaauauuuccauucaaaauuaguauuugaagggacaacacuaucuuaaauacacaaaaaucagauuauggaaauuugcuuaaugguuauuuaaaauuaaagcuaaauaugaacauggauggaacuggagguuauuguguuaaaugaaauaagccaggcauggaaagauagauauugcauguucucacucauguguggaaccuaaaaaauuugaucuuguggagauagagaauagaaugauagcagaugcugggaagggugugugggugggagaagggauaaagagagguugauuaguggguaaaaccauacacuuagauagaacaaauauaccccuguauucaauaggagagaagggugacuauaguuagcaacauuguagaugaaguauauuucaaaguagcuagaagagaggacuugaaauguucccaacacauagaagggauaaauacucaggauaauagauaccucaaauacccugaccuugaucauuacacauucuaugaauguaacaaauacucacauguaccccauuaauauguaauacacuuccaaucaauuuuuaaaaguaaaauauagagagauuauuauguuuaauuuuuaauuuuaccaggcuagaagcauuaaacaugacuuauuuauucuguuuaaaaaaaaaaaaggacacuaucaagaaaauggaaaagccacccacagaaaaagauaaaguguuuagaauucacauaucugaaaagggacuuguauucagaacauauuaagcagucuuauaacucaauaauaaaaagacaaccuaaauaaaauaugggcaaagaaucauuagaguaugugaaaggguguuuuacauuuauguuagaccuagcuacuaauggacucccaauaaaggacauuuuuuaaaaagaaguaugauauguagaccacuggcaacagaaucaccugggaugcuugcuaaaauugccaguuuauggguaucucuguagacacaguguaccaaggagacuggaggcagggcucaggaaucugcauucuucaccgaaucccuaaucacacuaaaguuugagaaccacuuauauagaauguuacuucacagaauaauaucucagauaggucucauucuauuugacauuuucaaagaguuacacugucaguugguggacauuugucuagaauucuaacacaagugauaauagugcacaauaacacacaauauucauuaauguugaacaaugguaucuguucucugguaguaugaaaccuuagaaaauggcuuuucuuucuauacauguuauaaaucaauuuuugucuuagaaaaaaaacauaggcaaaguaccugagcagacauuucuccaaagaagauauauaaguggcuaauaaaccuuuaaaaaaugcuugacaucaguagucaucaggaaaacacaaaucaaaaccacagugagauuuuauuuuacacccacuaguauggccagaauuuaaaagugagacaaguacuagcaaguaugcagagaaaguggaaccuucauacacugcuggugggaauauaaaaugaugcagccuccuugaaaacaguguggcaggcuucaaaaaguuaaagauauaguuaucaaaugaccaagaauuucacuccugugcauauauccaaggaaaaugaaaacauauuucuaccaggaaauguguaauaaaugucuaugucagcaauauucauaauagucaaaaaguggaaacaacccaaaugccuaccaacagaugaaaugauaaaaugugauuuauacauacacuauuauuaggccauaaaaaugggugaaguacugauaauugcuaaaacauggaugaacauugaaaacauuaucccaagugaaagaacccagucaaaagaucaaacagaacaugaauucauucacaugaaaguccagaacagggaaaucuauagagacagaaagcaaacuuaggacugaagugacgauguuggggguaagagggugagagcuaaagaguaugggguuucuuuugagguucauuuugaugaaaauaaucuaaaauugacugugguaauagaugcacacaucugugaauauaauaaaaaucacugaauuauacacuuuaaauaggugaauuguaauguauauaaauuauaucucaaagugaugcucaaugcuuugcuuauuuugcuugguuuuuaaaacuauauggauuuauuacuuuuauuuuaaauauucauuguauugaaaauaauuauuguggaaacauuuuauaccaagaaaucuaauuauuaugaguauuuucuuaccauuguccccauuuauucuuauuucauauucuuuguagaguuuuuguauguuuuugauaauuuccuccauguacugucgcucugauggcaucucccccuccaaacuuuuaugccgauuaaauaucccaagcccaauaucugcccaguuuuccuguaaauguuuaauaaucuugagaguaucguauuuugacaguagaacauccccaguaaacucuucuuuuuucucauucaggaucuaaagagugaaaggaagagggagaguagcauauuauccacuaaugaguuuaucaaagucuaccagaugcuuauuccccagugacucccaauuauuuuggaguugcauauccuauuauuauuaugcuccaaagagaugguauaugacauauaucuuauuuuuaaauuaaaaugaauuuaaacuaauuuugguacucuaugagauaacccauaguuuaccaggaugaaaaucauuauauuaaauccuaugugguuaaaaaaaaaaaaaaaguagugauaagcaauuaaguccuacaaagcuaagcauguuuaauacuauuggcuuuaguaagguuguaauauaucuguuuacaugauccccacuagacugggaaaguuccuagaauauacaaguuguauuuuauucauguuuuguuuaucuguguaaacccaaguccaaguccugaacaugacauaucaauaaauauuuguggaaaaauaagguacaauuuauauauauaauuuggcauuauuugugcucagauaauaggaacauuacccagccuucaauaagaguaauuagcauggggagacaguguagaagagcaauuaggaguaagaacuuugaaacuggagagaucuggacucaaauucugacucugccacuuaccuuuuauagauaacuuagguaaguuacuuaacauccuaggcuucgauuuccacaucugggacauggagauuauaagacuugcaucauagggcagccaugaagaguaaguaagauaauauauggaaaacacauuuucagcuccucacacagaguaagugcuuaauaaaugagagcuauuacuauuccuaaauugaagagguaugacuuuuuucuauuuuuucuaugcaugucaaaaccuccagauaaaaaguaaaaaaaaaaaaaaaaauucacuaaacuagacauguuguauauagaacaggaaauaucuucaauucugagaauauacuguucaaguuauuccuaaagaaaagaaaaugguuuguugggaucuuaugaaauuuuauuagggaaugauuuugauaaucacuuuggaaguauuucaaugucacuuauauuuuccuuugucagacuacuauaacaugauaguaauuugaucaaugaaaucuauuuuccaagcucugaccccuuaaagauuauguuauuaauguauaaacaaaaugugguauauaaauacaaugggauauuauugaaccuugaaaagaaagaaaauucugacacuugcugcaaaauggaugaacccugaggacauuaugcugagggaaauaagcuacucacaaaaguaaaauacuguaugauuccacuuauaugagaugccuagaguagucacauucauaaacagaaaguagaaugagauugcccaggggguugggggaggcagaaauagggacuuacaguuuaauggguacagaaugucaguuuggggaaaagaaaaaguccuggaaaugaaugguggugaugguuguacaacaauauaaauauauuuagggcaacugaacuguaugcuuaaaaaugauuaaaaugguaaauuuuguguuguauauauuuuaccacaauaaaaaaagauguuauuaauuuuaaaaguccaauuuguccuuaaaagccagauauaggauaggcacaaacauuacuuaugucugacaauuagauaauagcauugaacuacccucacuuauagggagccgaagccccgugggacgggaccaacucagcgcuccacuugaggcuauaugaucaaacagcaaacuguuuaucaugaaugcaagaugugaacaaacucacacugcgccugccaccaaaagguuugcugagggacaucacuccuuggcgcugggcuccuugaaguuaucuauugagaaaucuagcaccuauuguucaaaggaugcagucucacaagccugcugugaaccaaauggcccauugacaauuacucgacaaucaccgccccccuuucucgcuaucucuuuuaccuaauacauauggagcgcuguguaaagcucagggcccuugugcaccagaggcaaggugcccccugaccccuucuuccaaauauacucuuuugucucuugucuuuuauucccacguucgccccacuuuguucagucccccuaguuucgugcggguuacauaguggcauccgaacacaggacuucaaggaugugaacaaagaaggucugcuggaacagaggaacuaaaauugacaaggcaaacagugaccccgggaugagucugccggcagcggauguaaggucagugcccuaaagagguaccgagagcagugcuuuaaagaaguaaugggaaugggaaguuuucugaaucaggguaacauggagcagaauuugucuguugaagaaaaacauuauguacaguugcuuaaaauuuuguugaaacgaaaugguccucagguuaguucucagacauugacuaagcugcugcaggagguuauuacgcauaacccaugguuuccacaggcaggcacucuugauguggaaaauugggauagagcaggagaaggauuaaaacaggcucaucaaaaaggucuuaaaguugauucuucaguuuucuccacguggaguuuaguucguacuguacuucugccauuaucuccuuauuauucugcaggacagcaggcugaaucuaaaaaucugaaagaaucugucgucccacccacagcuccaauugaaaauaaaaacaggagagggaggauaaaaaguggccuauaccgccucuuccaguugcagaaacaucuguacggccucguuugguagcagaaauagaaaccccaauacaaagaauuuuacgcugugcugccauagcuggagagcccuuaggaccuugugcuuuuccuaguuccguaaggccugauccaaauaauccacagcagguuauucaugaacacacuccacuagaguuuaaguuguuaaaggaauuaaaaguaagugugauaaauaauagcguacagagcccauucaccuuaagauugcuagaaucuguguuuggugcuaugcgucuuuuacccuuugaugagaaacacuuggcgugaacuugcuugucugcuagcgcauaucugauauggaauuuaaauuggcaagaaaugucugcagaccaggcuagacagaaccaugcugcuggaaauggagacauuacagaggauaugcuguuagguaauagcccuuauucagaccuggaauguuaaauggcacucccagaugcugcuuaucagcaguguguacaggccgcuaaaugugccugggccacaauuccugaagagggagucccaguacaaucuuuuuuacauacauguaagugucacaggaacccuaugugcaaguacuugcaagauuacaagaggcagugaagcgucagauuccucauaccguggccgcagaaaugcuaaccuuaacucuagcuuuugagaaugcaaaugcggauuggaaaugugcacuggcacuggugagguguacaaaaaacuugggaaauuuucucagagcuugucaggauguaggaacugagcuucauugcucugcaguguuagcacaagcaauggcuaauuuggcaguugacaaaucuaaaaggagccaaaggucaagcccuaaaaugggaaaauguuauaauuguggaaaaacuggacauuuuaaaaaggaaugccgccauauguuaggauagaaaggaccuuacaaugcugugccccacccaacggaaaaaacgcaggacuuuguccuugcuguaacaaaggaaaucaaugggccaaucagugcugcucaaaauucaucagaauggcacucuccugccggguaacgagacaagggccuggacuugggccccacacacaguaagaguauuccuaguccagaccucaaccccguuucagggauggguucccggagguacauugauucccucacccuacuccagguggacaaacuuauuuuauugauggcccuuccaaagguugugccacuaucuguggaccaaaacauacucaaacaauaaugaccucugggguuucagcucaacacucagagcuaauuacagucauucagguuuuagagcucacagcuucagauccuaucaacauugucugugauucagcuuaugcuguaaauguagccggucgcauagaaacugcuacaauuaaaaguauacuagacccagaacugcugaauuuauuuuuaagacuucaacaaguuauucgcucucgugcagcuucucuucacauuucucuuauuugcucucacacacaacuuucugggccacuaucucuagguaaugagaagcagacaaauugauugguucuguguuucagcaagcucaagugucucacacgcugcugcaccaaaauacuucugcccuuacucgccuguuccauuuaugucacagccaagcuagggcuauaauacaagccaguccuacuugccagcaugucucccuggagccacaccuguagaaugcuguaaccuaugagguuuggcuccaaaugaaauuuggcaaauggauguuacacacauagcaaccuuugcuaagcucagcuauguucaugugacuauagacacuuauucucauaugcugcaugcuacaugccaaacaggugagacagcuggucauguacagugacauugucugucaucaguugcucauaugggauaccugaacaauuaaaacugaccauggaucugcuuauacuaguaugcuuuucaaaauuucuuacagcuuugggcuauaacccacaaaauaggaauuccuuauaauccuagaggacaaggcauuauagagugggcacaucaaacauuacaaugcauguugaaaagacaaaaaggggguauaggaagccaacugccaccucaaucaaaacuauauuuagcuuuauuuacuuuaaauuuuuugacuccugguacaaaugauaagacuccagcagaaagacacuggcaaguguuagaggaaaagaggaaaauuuauccgaaaauguuacggauaucugcagaagaaggacaauggaaagguccaguggauuuacugacguagggacaaggguaugcuuguguuuuuacaggagauggagaaaccaugugggugcccucaaggugcguguggccauggaaugggagacuggaggaacccaggguggccaaccaugggcccggucccuccgguacgagccaugagccagcugagccugagugcaaagacggagagaaggcugacaagggucacgaugacaucaacccucauaaccuggggacaacucaagaaaaccaugcaggaagcugagaaacuacuggagcaucagggacaggcaaaaaccccugauuccauauucuuggccauguuagccauaauguccugugcaguauguuuucccugugcagaggcaaaaacauacugggcauauguucccaaucccccagcaguacgaccuaaacuuuggagugaaacuccuccugagauuugucaugaucagggagaguaggcuccaggaccccuaacucccccugacauagaacaguuagauucucagaauaaugucauuaauuauaccuuccacuggaaggacuuccuuuguguaucacuacacagacaucgcucagccauagcugucuuacaauucaagcucaaacaugguugagucacuauggaaaaauuauguacuuauuaggucuugguucuauuaauguaacuggugugcucaccaaccauuccuggcccagucgcccuaauugugcugauuauacagaauagauuccauucaauagcuccuauccccuucugugggcccagugucuugguccacuggcuagaaaacaaucuaugguaacuggagacauuguggauuggagaccuaaaggucaauuagauggaaaagaugaaaaucagaaaucauagcacaaacuucgcuggcauugguagcaagcuuuuaaugcuucuucuuuauacaacaccgagauccaaucccagucugccgcccagauugcuuggcauggagcaggcuuuagcccaccuuuuccucuggcauuauccagggaggaaaggaccaauucaagagacgauauagaaggcagcacucccauuuaugaauggcaacaucuggguuggaauauuauccaauaauagcaaugguaagcgacacagucgcuuuuuuuggcagcuaggaaggaccagcuccagguaaacaauacccaauugaccugcaaaucuugccaguuauaucacugcauuaaucauagcacauugcaaacacauaauaucccuacuuucagguuuuugguuuuuaggucgcaucccugggcuacggauuccuguuaaucugucugagccuugggcugccacaccugcuuugcauuuugugaaacuucuaacucagcuuacucaucguguccuagagccuuaagcaugauaauuuuugcuauuguuuccuuggucacacuaauaacuucuguugugauguccucuguagcuuugcaugauucuauucaaagagcucaguaccugaagaaguggaugcacacagccgaccaagcguggccacuucagaauaaaauuaacacugaguuacaaauugaagugguaauguuaaaauccacgguccuaugguuaggggaacaaguacaaagcuugcaguugcagcagcaaaugcauugucauuuuaaucacacucauauuugugucaccaacguagaauauaaccaaaguaucugugggaccuugugaaagccgauuugccgguagcuuucacauccaacaucaccuuuguuuuauuuuuauguauuuauuuauuuauuuauuuacuuauuuuugagauggagucucacucuguggcccaggcuggagugcaguggcacgaucuuggcucacugcaaccucugccucucagguucaagcaauucuccagccucagcauccugaguagcugggauuauagucaccugccaccaugccuggcuaauuuuuguauuuguaguagagacaggguuucaccauacuggucaggcuggucuugaacuccugaccugaggugauccacccaccucagccucccaaagugcugggauuacaggcaugagccacaaugcccggccauuaccuuuaauauuggugaauugcaaaacaaaauucuugauuuaaauagguaaacucaagaauuucagccuucuuuugaagacuggacugaauuccagcaaggccuggagagccucaacccuuggaccuaucugaagcaccaccuuaacaucuuauauguaguucuuggaauaauguuguuuugucucugucuucuguucauagucuguaaaaucggauggaccgccaauuggaaaaugagagcugcccagccuggccuuacauucuuucaauuaauacauaaacagaaagggggauauguagggagccaaaggccugugggaugugaccaacucagcauuccacuggcggcuauaugaucaaacagcaaacuuuaucaugaaggcaggaugugagcaaacucacacugcgccugccaccaaaagguuugcugaaggacaucacucccugccaccaggcuccuugaaguuaccuacugagaaaucuagcaccuauuguucaaaggaugcagucucgcaagccugcugagaaccaaauggcccacugacaauuacccgacaaucacccgcccccuuucucgcuaucucuuuugccuaauaaauacagagggcuuuguaaagcucaggguccuuguccacuagaggcaaggugcccccgaccccuucuuccaaauauacucuuuugucuuuuauucccacauuugccccccuuuguucagucccccuaggucugugcggguuacacucacugccacccaaggagauuuuccuaauuucuuuccuuuuuuuuuuuuuuuuuucagugagugucucuuuuauagaugaagaagacauauguugggagaaacaaagcuuuacaauguaauauacaguagagcugucauuuuaagcuacacaugaaagcaaaaguuacuaaucuuuacccugcauaagcaaauauauauucaaagaagaaaaaaguguaaagcugauaucuaccgagcuuuuuguguucaacauagacuuuuuuuuuuuuacucuaaguuuggggauacaugugcagaaugugcagguuuguuacacagguauacgugugccauggugguuugcugcaccuaucagcucaucaucuagguuuuaagccaagcaugcauuagcuauuuguccuaaugcccuccuuccccuugccccugcacccuccaacaggcuccagugugugguuuuuccccuuccuguguccaugugugcucauuguucaacucccaguuaugagugagaacaagcaguguuuuguuuucuguuccuguguuaguuuguugaggaugauggcuuccagcuucauccaugucccugcaaaggacaugaucucauuccuuucuauggcugcaugguauuucaugguguauauguaccacauuuucuuuauccagucuaccauugaugggcauuggguugguuccaugucuuugcuguuguaaauagugcugcaauaaauauacaugugcacgugucuuuacaguagaaugauuuaucuuccuuuggguauauacccaguaaugggauugcugucaaaugguauuucuaguucuagauccuugaggcaucacuacauugucuuccacaaugguugaaccaauuuacauucccaccaacaauguaaaggcauucccauuucuccacagccucaccagcaucuauugguucuugacuuuuuaauaaucaccauucugacuggcaugagauguaucucauugugguuuugauuugcauuucucuaauuaucagugauguugagcuuuuuuuuucuucauguuuguuggccacauaaaugucuucuuuugagaaaugucuguucauauccuuugcccacuuuuugaggggguuguucauuuuuuuuucuuguaaauuuguuuaaguuccuuauagauucuggauauuagaccucugucagauggauagauugcaaaacuuuucucccauucuguaggcugccuguucacucugaugauaguuuauuuugcuaugcaaaaggucuuuagucuaauuagaucccauuugucaauuuugguuuuuguugcaauugcuuuuggcauuuucaucauaaaaucuuugcccaugccuauguccugaaugguauugccuagauuuucuucuaggguuuuuauuguuugggauuuuaaagucuuuaauccaucuugaguaaauuuuuauauaagauguaaggaaggggucaaguuucaguuuucugcauaugacuagccaguuuuccuagcaccauuuauuaaacagaaccuuuuccccauugcauguuuuugucagguuggucaaauaucagaugguuguagaugugugguguuauuucucaggucucuguuuguuuuauuccauuggucuauaugucuguuuugguaccaguaccaugacguuuugguuacugucaucuuguagcauaguuugaaucagguagcaugaugccuccagcuuuguucuuuuucuuaggauugucuuagcaauaugcgcucuuuuuugguuccauaugaaauuuaaaguagucuuuucuaauucugugaagaaugucaaugcuaacuugaugggaaaagcauugaaucuauaaauuacuuugggcaguauggccauuuucgcaauauugauuuuuccuauccaugaggauggaauguuuuuccauuuguuucaguucucucuuauuuccuugagcaguguuuuguaguucuccuugaagagguccuucgcaucccuuauuggcuguauuccuagguauuuuauucucuuuuuagcagcuaugaaugggaguuaauccaugauuuggcucucugcuuguauauuguuggugcauagaaaugcuugugauuuuugcacguugauuuuguuuccugugauuuugcugaaguugcuuaucagcuuaaggaguuuuggggcugagacgaugggguuuucuaaacauagaaucaugucaacugcaaacagagauaauuugaccucuacccuuccuaugugaauacucucuauuucuuuaucuugccugauuguccuggccagaacuuccaauacuauguugaauaggagaggugagaggguacccuugucuuuucaaagggaaugcuuccagauuuugcccauucaguaugauauuggcuguggguuugacauaaauagcucuuauuauuuugagauauguucuaucaauaccuaguuuauugagaguuuuuaacauaaagggauguugaauuuugugaaaggccuuuucugcaacuacugagauaaucauguggguuuugucauugguucuguuuaugugauagauuacauuuauugauuuguguauguugaaucacccuugcaucccagggauaaagccgacuugaucaugguggauaagauuuuugaugugcugcuggauucgguuugccaguauuuuauugaggauuuucgcaucaauguucaucagggauacuggccugaaguuuucuuuuuuuuguugugucucugccagguuuugguaucaggaugaugcuggccucauaaaugaguuaaggaggagucccuccuuuucaauuguuuggaauaguuucagaagaaaugguaacagcuccucuuuguaccucugguagaauuuggcugugaaucugugugguccuuggcuuuuuuugguugguagguuauuaauuaccaagcaaauggaaagcaaaaaaagcagggguugcaacacuagucucugacaaaauagaccuuaaaccaacaaagaucaaaaaagacaaagaagggcauuacauaaugguaaagggaucaauucaaugaaagagcuaacuauccuaaauauguaugcacccaacacagaagcacccagauucauaaaacaaguucuuagagaccuacaaagagacuuagacuccacaauaguagugggagacuuuaacaccccacugucaauauuagacagauugaugagacagaaaauuaacaaggauauuucggacuugaacucagcucuggaucaaguagaucuaauagacaucuacagaacucucaaccccaaaucaacaaaucuucucagugccacauggcacuuauucuaaaaucauccacacaauuggaaguaaaacacuccucagaaaaugcaaaagaacugaaaucauaacaaacaaucucccagaccacagugcaaucaaauuagaacucaggauuaagaaacucacucaaaaccauacaacugcauggaaauugaacaaccugcuccugaaugacuccuggguaauaaugaaauuaaggcagaaaucaagaaguucuuugaaaccaaugagaacaaagagacaacacaccagaaugucugggacacagcuaaagcagcguuaagauggaaauuuauagcacuaaaugcccacaucagaaaacuagaaggaucucaaaucaacacccuaacaucacaauuagaauaacuggagaagcaaaagcaaacaaauccaaaagcuagcagaaggcaagaaacaacuaagaucagagcagaacugagggaaauagagaugugaaaaacccuucaaagaaucaaugaauccaggagcuauuuuuuuugaaaaaauuaacaaaauagaccacuagcuagacuaauaaagaagagagaagaaucgaauagacacaauaaaaaaugauaaaggagaaaucacuacugaucccacagaaauacaaacuaccaucagagaauacuauaaacaccucuaugcaaauaaacuagaaaaucuagaagaaacggauaaauuccuggacacaucacccucccaagacgaaaccaguaagaaguugaaucccugaacagaccaauaacaaauuccugauuucuuuucuagcagccuaacuuaauuugacccaaaaaucugaaauagaacugagaauauuuaagcauauuuuuuaaagucccugagcacuugcuuuuuuccuuguuguucauaaaacuuaacauugcauuuuuuuuuuuugagauggagucuugcuguguugcccaggcuggagugcaguggugcaaucucggcucacugcaaccugugacucccugguucaagugauucuccugccucagccucuaaguagcuggaauuacaggugugagccaccgugcccggccccuaauauggcauuuuuaaagaaugagauguggucgggcauggugacucacaccuguaaucccaacacuuugggaggccgagguggguggaucacuucaggucaggaguucaagaccauccuggccaacauggugaaaccuuguaucuacuacaaauacaaaaauuagccaagcgugguggcacaugccuguaauccuagcuacuugggaggcugaggcaggagaaucgcuugaacucaggagguggaaguuguagugaaccaagaucacacuacugcgcuccagccugggcgacagugagugagacaacgucccaaaaaaaaaaaaggaugggaugugccucaguuguagguccggaaugccaaguuuacaaucagcacuuugauugccaagcucuuuauuaaaaagucuuaccuucugccacuguuugaagucuaaaagaacugaauuaaauauauuucccuuauuaggggauaaaaugucuuuuucacugaaaagaagaaaaaaaaaaagagaaacaucucagaacaagacauaaacaagaucaucaguucacacacuaaagacuaaacaacuaacauauuucuccucaauaauuuugaagcaugccuuccagguccagccccucuccccacagguauuuaucauuaaauuuguaaacauaaauucagauucuauucagaccugagcaaucaaguuacagggccaugggccacaagaguauuuuuuuuaaaggguggucucuugagucuugagaauuaaaaaccagaucauuaucagaagaucuguugaaugcagcugucaaagcacuauauaaauagaaagaaagccuuuacagugauuaagacucaacauuuaagccagaaaucccaacuucugguagaaaacaauuuccuuuaauggcucugaagucucacaaggugaaagcuauugauaaauaagcuucugaagcuaaagagacaagaacuauggccacccgugcacaccucccagcuaagaaucaacaaacaauagaaauggguacacggcaggagcagccagcuuggagacauaccagcuucagcuuccagaacuuccaaaucuacuaauggggaaaccuuuaaggggguaugaaaaacugaaaccauuauucucaauuugaaauggaaaugcuaccuaacagacaaagcaucuuaaaauuuaaaaaaaaaaaaaaaccuuagaaaucaucuaguccaggccucaacagacaaagcaucuuaaaguuaaaaaacaacaacaacacaacaacaacaaacaaacaaacaaacaaaaaccuuagaaaucaucuaguccaggcugggcaugguggcucaugccuguaaucccagcacuuugggaggccuagguggguggaucuccuaaggccaggaguucgagaucagccuggcuaacaugguaaaacucugucuguacuaaaaauacaaaaauuagccgggugugguggcgcaugccuguaaucccagcuacuugggaggcugaggugggagaaucgcuugaacccaggagauggaggcagcagugagccaagauugcgccacugcacuccagcuugggugacagaauaagacccagucucaaaaaaaaauaaaauuaaauuuaaaaaaagaaauuuaguccagacugcauccaaagcauagauucccacuaaccuuggcugugauuuagccaucugaccucaacuuaacuacuuuauuagcagcuucuuucauugucagauuucucuaaucauugcaaaguaugauauccgaucaaaaccaucucccucuaacugucacccauugguuuuacgucucugcauaugauuugcagauggauccaaauacucaaguuugccaaaguaaugaaauaaguugacuuuauuucaaaaagagagaaaagaaaaagaacuggacucaaauggggacagcagcaguugagcagggggaucgggauggacuagagagauacuuagcacuagaaaccacaggacuauucaagguuguuagcaggauugugccuucauagggacugcuccccaaaaucaauguuagagugauuacaagguaaaagacagaaggaggaacacagagaauuugacugaguuaucagacauaaguauaaucagaaaaacaagauucuuggugacucacuugaagaacuccugccauuugauaagcccauccuuaacaauuuucagugucucgcuuguagacucuuccauuuguucuaccucuuguuuaaguuuauucacuaaguuucuccauuuuugugucaacuucugcaacagugcaaggucuucaguguccuauauaaaaugcauagaaucaaauaauauauucauuuauguauauaacaaauagucauuaacauauaccaggccauuauuaauauuguaauacuagagaaauucauagaaaauugauuaaaaauugaaaaguuacacuacuacaccauucauuuggugaugaauuuuccauggcauuucuuauaaaguauuaagagacaagauuuuuuuuuccuuugcaacaugaacccaauguuuccauaggacuuucacaggggcaguguggugugcuagacagaacaggaaccaagaagccaaaccaaaccaaaugugaauuauagcuauuacuggcuguguaaccuugggcaaugauaucuaaucuauuugggauuaauuuuuauuauccauaaagacccuaauaucuaucucacagaauugucuuaagaguuaaaugaaaugacuaguguaaaugcuuugacucaguagaaacaugcuaaaugcccuccuuuucuaucuagugugcucacugaauuuucccauaaaauugauaaugcaacuauuucaaaaaacacagcuauuuacuuuuuuuacuuuaaccaugaaucaauaggaucauaauuguaugaguaaccuuguaguguuauuaaacuuaaauaaauugcuuuaauuagaagacaaauauagagaaauaagggccuuuauucaccuucccauagauuuuucauucuguacaauaagcacuaauauaaaaugauauuuuuaaaaucgauaaauuuaacaaaggcaucuuacagucucaacccucaccacuuggcaucuuuuuuucccauaacugaagauaauugaccuuuaccuuguuugauagcaguaugaugaaaugcuuaguguauuuauuccagccuuuuucauuaagguaaagucuucuagccaauaugacucuauuucuuucaaucaccuauaaaaauaauguacuauaaucaggaaccuaaaacauuagcaaaccacuauaauuuauuacagugauuucauauaucgauuuuucauggaaucauuaacucaacuaaaauuucucguuuaaaucauuaacacgaauuacaaauucacauuuuccacugaacuggaaccaaacugaaguauaguguauagcaaaacuucuccaaaaauuugaucuaaagaccccuuuauacaaaaaauguuaucucaaggccccuuuauacucucaaaugcuuuuauuuauauggaaugcaucuauugauauuuacuguauuggaaauuaaacuagauauuuuuuuuucugagacagugucuugcucugucacccagguuggagugcaguggcgcaaucucggcucacugcaagcuccaacucccggguucacaccauucuccugccucagccuccugaguagcugggacuacaggcacccaccacgaugccuggcuaauguuuuuuauuuuuaguagagaugagguuucaccuguuagccaggauugucucgaucuccugaccucgugaucugccugccucggccucccaaagugcugggauuacaggcgugagccaccacgcccggcagaaaguaaacuagauuuaacacguguauuuguuaaucacuuaaacauuaacaaacccauuacauauuaacauaaauagcauauuuauuuuuaaaaauuguguuaaauuaguaaaaagagugcuauuguuuuacauuuuuacaaaucuaauguuugccuuagaagaacagagcuggauucucauuugcuucuguauucaaucuguuagaauauaucacgucauguagcugcuagaaaaauccacugcauacucuuaauaaaagaaugagaaugaaaaaggcaaacaacauuuuaguauuauaaugaaacuaauuuugauuucuugaagcucuuaaaagggucucauagaggccuccugccccccacaaggggucccugggccauacuuugagaaccacuaauauaagaaaucaacugcuagucauuuaaugaaauacuguucuagacacuguggacauagacauggacaaaagagauaaaguucuuauuuucaaggaauugacauucuaacugucacuucaguuagaagggacucuagggaugaucuaacacaaagcucaucaaugcaaggaauucuacagaaaccucuaccaggggccagcucucuacuauugaaauacuucuagugugagggaucucacuuuucuucuuuuuucuccacugaacaugucuagcucaaaucuguuucuuacaucauguauuuacugucaugauuguuuccucugaaaaugucaaugugcccuuaaaaauucugcaucagaauggaacacuguauucuagaugaggucugaccauuucagagaaaaaugagacaaugaucuccuucuauucucuuuacuucuaaucuuguaaaaguccagcauuguuuugagaaucauuucaugcaguugccuuagcaaauccacaguuacuucaaugucacaaaucuuuuuuuuuuuuuuuuuacauggauugcucuuacauugggucuccuccuuuagguggcugcccugaguuuuguuugucuuuugucucugaagaugguauauaauggaaacugggaguucaggcucugggaucagacuugcuagguucaccauuuauuagcuaugugaacuuaggcaaauuaccucucugaguccucauaugaaaaauguggguaaugauaguacuguuucaagggauuacuguaagaacuaugcuaauuauucccuuagcaaaauaucugacagauaguaauaacugaauaaauaauugcugauucuuuuuuaaaaauaauaucaugguaauuauuaauguuaaucauauuaguaagauuaaucuauacauuuaucccuacuaacauuucauuugucuggaaaggcucaucauucucaaucguugagauauuugaaucucaugaaguuuuaugggcaggaacuuugucucaauuauuuuuauuuuaccaaccaguacauggcauaaugucugacacauaacacaugcucaaaguuuauuuuuaaaaauuaguagauccucaaaaauuaccauucagucaaaaaauuaauauauauuuguuaaaacaaagucaaacaauauagaaguauaaaguaaauuucaaaauucccaccagcucacccaacccuaacauucaacuaaccaaagguaaugucuuauuaguuugcuguucucuuggugaagauuuugugugugugcauauauaaacuaaacuauauauaguuuuuuuuuguuuguuuuuguucuuguuuuuguuuugagacugauccucacucuauggcccaggcuggagugcaguggcaugauuucggcuuacugcaaccucugccucccagguucaaguguuucuccugccucagccucccgaguagcugggauuacaggcaugggccaccaugcugccuaauuuuuguaauuuuuuuaguagagacgggguuuuaccacguuggccaggcuggucucaaacuccugacaucaggccauccaccagccucagccucccaaagugcugggauuacaggcuugagccacuauacuuggccacauaguuauuuauauacuugugauaguuuuuauuaaauguucuccuauccuuuuauauuauucuaaaacuugcuauuucuuuuacuuaucauagccaucuuugcacauacauauauaucuacaacauucuuuuaaauggcuccuuaguguucuacuguuugaauaacuauaauuucccuucugguggauauuuagauuauuucaauauuuuuguaaucacaagcaauguugaaaugaacauccauauucuuauucacuuguauuaguauuucuuaggaauggaaugacuuuuugccugugugauugguuaaucaaacagguacaaauuuaaaauacuguuagccucuauaaaaauuucuaaaaugguuauaucaauauauaugcccaucaauaguacaugcaaauguucauguuuaucaucugucuauguuugcccauaugcuaagcuaaaaauguuaucuaauuauucuguauguuccaucuuauugaugauuggugagguugaacauauuuucauauauuuauuggcuauuugaauuucuuacucugaauuaucuguuuauagucugugccuacuguuuugcuggauuauuuuaccuuuaaaauuuauuuauucuaccacuuuaguaauauuaacuauacaaacauuuucucccaguuuguuauuugcuuuuauuucuagugauugucacugaauggaaguuuuaaauuuuaagauuucccgucauacuuagaaagagcuuuggccaggcgcaguggcucaguccuauaaucccagcacuuugggaggucgaggcaggcagaugacaaggucgggaguuugagaccagccugaccaacaugguaaaaccccgucucuaccaaaaauacaaaaauuaucugggugugguggcaugugccuguagucccagcuacuugagaggcuguggcaggagaaucgcuugaacccgggaggcagagguugcagugagccgagauugugccacugcauuccagccugggugacagagugagacucugucucaaaaaaaaaaaaaaaaaaagagcuuccacauuucucucuuuacacacacacacacacacauaugugagacagggucuaacucugucacccacacuggagugcaguggugugaucucagcucacugcagccucaaucucccucccugcuucugcccagcacaaagcacauggaaaauuuuccccaaacucaugguuuuuacacuggaaaaagugagaucaagauggacaacaagcuuccucaucauguugauuccuuggcaggagaccccaucauguugauuccuuggcaggagaccccaucauguugauuccuuggcaggagaccaucacaagugccugaagagauaaauaugccugaggacaggcagagacaaaggguagaagaaggacuaccauccccaggccuggaaacuuugcucugcaacucagccaaaggagacuccaugugagagaggguuaucaacagcaccaugcugugcaagguucauuccacagauucccugggcacuagccccuagccauccuucucacacugcagagauauugccuuuggaaacuccccuacauaggaaggguagcacuucaauccuuuacuagaguugaggugaaccuggguuuaaagcaccauguagugcugaaaaggaggcagcaaccuuaagauuugcuaagcaaaaauagccaaucaaacauaaaacaagccagacagagaagauuagaauaaauaacuaaaccuucaaugcaaaguaauagacauacauucauaagaaacaacagcaaacagggaaccaugaucuccccaaauggacaaagcaaggaacaagugagugacucuaacacgugagcucucugaugaagaauucaaaacuacaguuuuaagaaaacucagugaucuccaagauaacccagaaaagcaauucagaaauuuaucagagaaauguaacaaagagauugaaauaauaaaaaaauaaaauuacuggaauugagaaauacauuugcugaacugaaaaauucaucagagguucucaacagcagaaugcaucaagaagaggaaagaaucagugaacccaaauacaggcuacuuguacacaaucagaggagaaaaaaggauagaaagaaacaagaaucagccaggcaugguggcucacgccugcaauccuagcacuuugggaggccggggcagguggaucaccugagaucaggaguuugagaccagucuggcuaacauggcaaaacuccauuucuacuaaaaauacaaaaaaauuagccaggccugguggcacgugccuguaaucccagcuacucaggagacugaggcaggagaaucgcuugaacccgggaggcagagguugcagugagcagagaucaugccacugcacuccagccugggugacagagccagacucugucucaaaaaaaaaaaaaaaaaaagauaauagaaaacuuucaaaaacuuagauaugaauguccaguuauaggaaggucugagagcaccaaacagaugugacccaaacaagaccacccaagguauacaacaaucaaacucucaaaggccaagaacaaaaagaugaccguaaaagcagcaagaguaaagaagcaaauaacauguuaaggagcuccaacuuaccuagcaacagacuucucaguggaaaccauacagggcaggaaggagagaaaugacauuuucaaagugcuguaagaaaacaaacaaacaaacgaacaaaacccugcuauccaagaguacuauauccagcaaaguuguucuuuaaauaugaaggagagauagucuuucccaaacacaagcugagagaauuuaccaccaccagaccucucuuacaagaaaugcuaauggggaguucuucaaucuaaaagaaaaaaacaccaacauguaaaaaaaaacuuugaagcuauaaaacccacugguaaaaugaucuacacagacaaauauagaauaugcuaauacuguaacuguaguguguaauccacucauaacucuaguaugaagccuaaaagacaaaucuaucaaaaacaauaauagcuacagcaacuuguuaagagaugguuaauauauacaaauauguaaaugcaaauaacuaaaagucaaaauguugaggagaauagaguuaaagcguauuuuuuucauuuuuuauuugcuucuuuucuuuuuuuguaaucuaagauaaauugucaucucuuuuuuuaaaaaaaccuguuauacaauguuuuuuguaagcuucaugguaaccaccaugcaaaaaccuauaacagauucacuuaaaaaaaggcaacaaauuaaaacauaauaucagagauaaccacuuaaucacaaaggaaaacagugagaaaggaaaagaggaguuauaaaacaagauaaaaagcaacaaaauggaaggaguaaauccuuacuuaucaauaauaacacugaauguaaaugaacucaauuauccaauuaaaagguacagaauggcugaaaggauaaagcaacaagacccaacaauaucugucuacacaaaauccacucaacuauaauaacacauacauacugaaaguuuauggguagaaaaauauauuccaugcaauuggaaaccaaaagagagcaggaguagcuauauuuauaucagauaaaauggguuacaaaucaaagacuguaaaaaaaaaagguuacuauauaauuauaaaggauucaauucagcaaaaagauauaacaauuauaaagaagguguaacaauuauacgcccaacacuggagcuccaaacuauacaaagcaaacauuaacagauauaaagggagagauggccaggcacaguggcucacaccuguaaucccagcacuuugggagacuaaggugggcggaucacuugaggucaggaguucgagaccagccuggccaacauggugaaacccugucucuacuaaaaauacaaaaauuagccaggcaugguggcagguaccuguaaucccagcuacuugggagauggaggcaggagaauuacuugaacccacgaggcggagguugcagugagccgagacugcaccacugcacuccagccugggcaacagagugagacuucaucucaaagaaaaaaaaagggggagagacaaaauguaauauaauaauagugggggauuuuaacacucuuuucaguaauggacagacaagaaaucaacaacaacaaaaaacggaguuaaacuacacacuggaccuaauaggccuaacugacauuuacagaacauuucacccaucuguuaaggaauacacauucauuuugucagcagaugaaacauucucuagaauauaccauaucuuaggccacaaaacaagucugaagaaauucaaaaaaguagaaaucauauagaguauuuuuucugaccacaaugauggaauaaaacuugaaaucaauaacaggaagaaacuuggauacuucauaaacacacagaaauuaaauaacauuuuauggaaugaccaauggucaauguaggaaucaagaacaaaaugaaaaaucaucuugaaauaaaugaaaauguaaaaacagcauacaaaaaucuaugggauacaguaaaagcaguaugaacagauaaguuuauaauuuauuguuauaaauuauauauuugauauaucuauaucaaaaugauagaaagacgggaaauaaccuaacaaugcaccucaaggaacuagaaaagcaagaacaaaccaaaccuaaaauuaguagaaggaaagaaauaauacagauaacagcagaaauaaauaaaauugagacaauaaauacaaggaaucaaugaaaggaaaagcugcuguuuuuuuuuuuuuuuuucuuuugagauggaguuucguucuuguugcccaggcuggagugcaauggcacaaucuuggcucaccgcaaccucugccucccggauucaagagauucuccugccucagccucccaaguagccgggauuacaggcgccugccaccaugccuggcuaauuuuuuuguauuuuuaguagagacagaguuuuaccauguuggccaggcuggucucaaacuccugaccucaggugauccacccacucugaccucccaaagugcuacgauaacaggugugagccacugcgcccagcugaaaaguugguuuuuugaaaagauaagcaaaaucaauaaagcuuuagcuagacuaaauaagaaaaaagauaaagguccaggcaugguggcucacaccuguaaucccaacuuuugcaggccgaggcagguggaucacuuuaggccaggaguuuaagaccagccuggccaacaugguaaaaucccaucucuacuaaaaauacaaaaauuagccaggcaugguggugcacaccuguauucccagcuacucaggaggcugaggcacaagaaucacuugaacccaggaggcagagguugcagugagcugagaucacgccaccccacuacacuacagccugggugaaagagcaagacucugucucaaaaaaaaaaaaaaaaaaaaaaaaaaaaaggaaaagaaaaagaaaaggaaggaaggaagaaaggaaggaaggaaaccauagagaaccacaaaagaccccaaauaaccaaagcaaucuugugcaaagagaacaaagcaggaggcaucacacuaccugacuucgaaauuuacuacgaagccauaguaaacaaaccagcaugguaauggcauaaaagcagacauauagaccaaugcaauaaaauauagaaccuggauauaaauucaugcauauauagccaaccaucuuugacaaagaaggaagaaaggaaggaaggaaggaaggaaggaaggaaggaaggaaggaaggaaggaaggaaggaagggauacccaaauagaauaagaaacgaaaaagaagauguaacaacugagaccacaggaauacaaagaagcauuagagacuuacaaacaacuaugcaugaacaaauuggaaaaccuagggcuggacaugguagcucacgccuguaaucccaguaccuugggaggguggggcaggcagaucacuugaggucaggaguucaagaccagccuggccaacauggugaaaccgucucuacuaaaaauacaaaaauucaucaggugugguggcgggcaccuguaaucccagcaacucaggaggcugagacacgagaauugcuugaaccugggaaauggagguugcagugagccaagacugugccacugcacuccagccagggggaaaauggaaaaaaaaaaaaaaggaaaaccucaauaaaccaauaacaaguaaugagaucaaagccauaacacaaagucucccaucaaagaaaaucccaggaccuaauggcuucauaguugaauucuaccaaguauuugaagaagaacuaauaucaauucaacauaaacucuucaaaaaauuugaaaaggaaggaauacuuccaaacucauaaggcauuacccuaauaucaaaaccagacaagaacacaacaaaaaaaagaaaacuacaggccaauaucauggaugaacacagauguaaaaauccucacaaaauauaagcaaaccaaauucaacaacauguuaaaaaagaucauucaccaugaucaagugggauucaucucagggauaugaggaugguucaacaugugcacaucaauaaaugugauacaucacauuaacagaaccaagaacaagaagcauagcaucauuucaauagaagcugaaaaagcacuugauaacauucaacaucccuuuaugauaaaaacccucaucaaauuuaguauagaagaaacauaccucaaaauaaaagaaagccauauauggcaaacccacaguuaacauuguacugaauggggaaaaauuaaaggccuuuccucuaagaucuagaacaagacaaggaugcccauuuucaccacuuuuauuccuggaaguccuggacagagcaauuaggcaagagaaagaaauaaaaggcaucuaaauugaaaauaaagaaaucaaauuagccucauucacaaaagacauaaucuuauacuuuaaaaaaccuaaagacuccaccaaaaaccuguuagaacugaaaaacaaauucaauauauuucaaguauacaaaaucaacauacaaaaaucaguaggauuuauauauaccaauugcaaacaaucugaagaugaaaucaagaaagcagcucuauuuaaaauagcaauaaaugcucccucucccucucccucucccucucugucucccucccccucccccucccccucucccucucccucuccccaccaucucccucucccucucuuuccacggucucccucugaugccgagcugaagcuggacuguacugcugccaucucggcucacugcaaccucccugccugauucuccugccucagccugccgagugccugcgauugcaggcgcacgccgccacgccugacugguuuucguauuuuuuugguggagacgggguuucgcuguguuggccgggcuggucuccagcuccuaaccgcgagugauccgccagccuuggccucccgaggugccgggauugcagacagagucucguucacucagugcucaauggugcccaggcuggagugcaguggcgugaucuuggcucgcuacaaccaccucccagccgccugccuuggccucccaaagagccgagauugcagccucugcccggcugccaccccgucugggaagugaggagccucucugccuggccgcccaucgucugggaugugaggagccccucugccuggcugcccagucuggaaagugaggagcgucucugcccggccgccaucccaucuaggaagugaggggggccucuuccccgccgccaucccaucuaggaagugaggagcgucucuguccggccgcccaucgucugagauguggggagcgccucugccccgccgccucgucugggaugugaggagcgccucugcccggcggcgaccccgucugggaggugaggagcgucucugcccugccgccccgucugagaagugaggagacccucugccuggcaacagccccgucugagaagugaggagucccuccgcccggcagccgccccgucugagaagugaggagccccuccguccagcagccaccccaucugggaagugaggagcgucuccgcccggcagccaccccguccgggagggaggugggggucagccccccgcccggccagccgccccguccgggagggaggugguggugucggccccccacccggccagccgccccguccgggagggaggugcgggggucagccccccgcccggccagccgccccguccgggaggugaggggugccucugcccggccgccccuacugggaaguggggagccccucugcccggccaccaccccgucugggagguguacccaacagcucauugagaaugggccaugaugacaauggcgguuuuguggaauggaaagggggaaaagguggggaaaagauugagaaaucggaugguugccgugucuguguagaaagaaguagacaugggagacuuuucauuuuguuccguacuaagaaaaauucuucugccuugggauccuguugaucugugaccuuacccccagcccuaugcucucugaaacaugugcuguguccacucaggguuaaauggauuaaggguggugcaagaugugcuuuguuaaacagaugcuugaaggcagcaugcucguuaagagucaucaccacucccuaaucuuaaguacccagggacacaaacacugcggaaggccgcaggguccucugccuaggaaaaccagagaccuuuguucacuuguuuaucugcugaccuucccuccacuauuguccuaugacccugccaaaucccccucugcgagaaacacccaagaaugaucaauaaaaaaauaaauaaauaaauaaaauaaaaauaaauaaauaaaaauaaaauagcaauaaauaauauaaaauaccuaaauuuggaaaagaaguaaaagaucuauacaaggaacacuauaaaacucugauuaaaaaaaagacauaaaaaauggaaauauauuccaugcucauggacuggaagaacuaauauuguuaaauggcaauacuacccaaagaaauuugcagauucaaugccagcccucuuaaaauaccaauggcauucuucacagaauuuuuuuuuuaaauccuaaaaucuauauggaaccacaaaaggccccaaauaaccaaagcaauccugugcaaaaagaacaaagcaggaggcaucacacuaccugacuucaaaauuuaguacaaagccauaguaaacaaaucggcaugguaauggcauaaaagcagacacacagaccaaugcaacaauaaaacuagacccccuauuucucaccauauacaaaaaucaaaucaaaauggauuaaagacuuaauucuaagaccugaaacuaaaacaacuccuugaagaaaacguuggggaaacacucuaggacauugguuugggcaaagauuuuccguguaagaccucaaaagcacaggcaaccaaagcaaaaagaaagaaaaagcaauuacaucaagcuacaaaccuucugcaugguaaaggaaacaaucaacaaagugaagagaaaaccuacagagauagagaaaauauuugcaaacuaucuaucugauaagggaguuacaaccagaauuuauaaggagcucaaacaacucaauagcaaaaaaaaaaaaagaggagauagucugauuuuaaaaugggcaaaagaucugaauagauauuucuccaaagaagacauacaaauggcaaacagguaugugaaaaaaugcucaacaucaguaaucaucaaagaaaugcaaaucaaaacuacaaugagauaucaucucaccccaguuaaaauggauuguaucaaaaaacaggcaauacagaugcuugcaaagauguggagaaaggagaacuguucuauaaaagggccguauaugcaaggaaguuuccaaaugccgaaggagcugagaaaccaaaaaccaaggcagacaaauccaauuuguggguaaaggguguuuuauuggggaaacuaacagaagcauugucuaggguagccacaagacagguagaucucugcacuguuacuccccaggcucaaggcuuauauaccauaaagaaaggguaugcuuguuuugugcaacacaaaagcaacccuccagaacaggcaagaaugcuguaagcaucauagccuuauaauuuaugugauaacaucaagguugcuuuguucuuacacugagaaaaguaaauagaaaucaggaggcauucacuugacuggggcuaaucagaagucaauauggcacauuagcauucaacauggagucacuuuugucuccacuuguacgcuguuggugggaauguaaauuaguauagccacuguggagaacauuauggagguuccucaaaaaacuaaaaccagaacuaccauauaauccagcaauuaauuccacugcuggguacauguccuaaagaaagaaaaucaguauaucaaaagauaccagcacuauucacaauagccaauauaugcaaucaaccuaagugcccaccaacgaaugaauaaugaaaacacaguauauaaacccaauggaauauuauucagccacugaaaaauaauaaaauccuaucauuugcagcaacauggaugaaacuggaggucauuuuguuaagugaaauaagccaagucacagaaagacaaagauugcaaguauccacaugugggagcuaaaagaguggaucacaugaagauagagaguagauucaugguuaccagaggccaggaaggguaggagagagagaagauaaagagagguugauuaauggguacaaguauaugauuuaacagaagaaauaaguccuaguguuagauagauagguagacugacuauaguuuacaacaaucuauugcacauucuaaaauagcuagaaaagaguaaaucaaauguaucuaccacaaagaaaagacaaauauuuuagaugaugucuauccuaaguacacauauuugaucuuuacaaacuacaugaaugcauuaaauuauaagauguacccugcuacucgggaggcugaggcaggagaauggcacgaacccgggagguggagguugcagcgagcagagaucgcgccacugcacuccagccugggcaacagagugagacuccaucucagaaaaaaaaaaagauguacccuggagagaaaagaaaguucauuaaugauuaccuaaguugaauggguuggagguaaugagaagcgacugcuaaaauguauggaguuucuuuugaggguaaugaagaaguuuucagauugguuguggugaugguuucacaguucugcgaccaugcuaaaaaacauauaauuguacacuuuaauugggugaauuauaugucacaaaagcuacuauuuuuuugaaaauucucauguaauuucuucuaauauguuuauaauuacauuguuuuuaacauuuaauuauucccuucugggauuuacuuuuuaguuaucuuuuuaaugaggucgggaucuaaauuuguuuuguuuuguuuuguuuuuugagaugcagucucgcucuguugcccaggcuggagugcaguggugcgaucucggcucacugcaaccuccaccucccggguucaagcaauucucgugccucagccuccucaguagcugggacuacagacacccgccaauaugcccagcgaauuuuuguauuuuuaguagagaugggguuucaccauguuggccaggcuggucuugagcuccuaaccucaggugauccacuugccuuggccucccaaagugcugggauuacaggcauuggccaucacgcccagccgaaaucuaaauuuuuuaacaauugaauaaucgauugugccaacccaauuugaauaucccauauauaggugagucuauuucugaccuuuuucuauucuauucuguuguauuuaucuauucuaaccaaguaacacauuuucucaguuacuuugacuuuauaauacauuuugaugucuaaaaguacaaguuauuuuuauuaaucuucuuuuaaaauguuuuauuauucucauauucagauucuuccagauggguuuuauaaacaacuugccaaauuccuaaaaauaaaauuguuacugagauuuuuaguggaauuauaucaaauuuaaagauuaauuuggccgggcgcgguggcucacacuuguaaucccagcacuuuggcaggcugaggugggcggaucacgaguucaggagaucgagaccauccuggcuaacacggugaaacccccucucuacuaaaaauacaaaaaauuagccaggcgagguggcgggcgccuguagucccagcuacacaggaggcugaggcaggagaauggcgugaaccccagggggcggagccugcagugagccgagaucaugccacugcacuccagcaugggugaaagagcgagacuccaucucaaaaaaauaaauaaauaaauaaauaaauaaagauuaauuuggagagaacugacaucuauacaauauugauuauuguucucaaccagugauaugcuauacagcucuccuuuuaguuugcuuuuaaguucuuuaccaugguuuuaguguuuucaagauacaggucuuaucccuucuuauuaaauuuauucccucuuugcauuucuaauguuuauuauuguauauagguaauacguuggguuuuuuuuuguauuuaucuuguauucaucaaccuuuauuaaaggcuaaauaauucaaauaauguuuaaauuuauuuuuuucugguuagaaaacugcauuauuugcccaauguuuguuaaaaaauuguauauuuaucuuauauucagcaacauuauuaaaggcuaauuaauucaaauaauauuuaaauuuaucuuugcuagguagauaauugcuuuaucaggaaauaauagugacuuugaccauaaugagauaccaucucacaccagucagaacggcuauuauuaaaaaguaaaaaaaaaacagauguugacgaggaugcagagaaaagggaacacuuauauacuauggugggaauguaaauuaguucaaccccuguggaaaacaguauggagauuucucaaagaacuaaaaauggaacuaccauuugacccagcaaucccacuagugguuauauacccaaaggaaaagaaaucauuuaaucaaaaagacaccugcacucauauguuuauuccagcacuauuuacaauagcaaagucauggaaucaaccgaaguguccaucaaugauuaauuggguaaagaaaaugugguauauaccauggaauauuaugcagccauaaaagagaaugaaauuauaugcuuugaagcaacauggaugaagcugaaggcaauuaucuuaagugaaaaaacucagaaacagaaaaucaaauacugcauguucucacuuguaagugggaacuaaacaauggguauacauggacacaaggacgaaaauaauagacacuggugacuccaaaaguggggagggugggaaaggaccaacaguugagaauucaccuauuggauacaauguucacuauuugggugaugggcucacuggaagcccaaaccuuaugauuuacacaauauauccauguagcuauccugcacacguaccccugaaucuaaaauaaaauuuaaaauuaauuaauaaaauaaauauaaacaguuaauguggauauguuuauuaccuugauugucaugaggguaucacgaguguauguaaauguucaaugucaaauugaauauauuaaacauguguggauuuguuuuuuuuguauaucaauuguacuucaauaaagguguuaaaaacaauguaauauguuaauaaaguaaaaggaaaucaagauguaguaaucucaauugacacagaaaauauauuugacuaaauacagcaccuauuuaugauuaaacucuaaacaaaugaaaaauuuaagggaacuuccacaacccaauaaaggguauauaugaaagccuacaguaaauauuguacuuaauggugaaagcagaaugucuuccccauaagacugagaacaggaauacucacuuuuaccacuucuauucaacaauauacugggaauuuuugcuaaagaaaucagugggaaaaaaaauuuuaaagagauuuugcugcuuccuauaaguaguuauaucucuugauuuuauuugcauguuauuacugaauuaggaucuccagugauagcagaaauccuuucuccucucuugaauggaaaugccucuagcauguccccaguaaugaucuagauuucuaauaauuaccucuaguaaguaaaugaacuuuccuaaauaacaagccuugauuccacuaucuaguauauuagcuuucucucuagcuuuaggacacuugacagggaugccuucuacauuuucuuccaaauaacugacaaacuacuacauguggcaggguuaauacagagcucuaaugcagauguauuaaugcauuaaugcaguauaucuccauggagaacgcugugaccugccaccaguagaccagugaaccaauuuaacugaacucauuuuuuaaucuuuugaggaucaaaauucacuguaccuagaagucccaguugucagaauaggcaaccaacaaguaaauauuuuagaaauauagaauauugugugacuuugcuauuucccuaaaguauuacuauaaugguccacaguguaccauauuucaauucauuugucaucuuguguaccaagguaaacagaaucagagagugggucagccacaguggcucaugcauguaaucccagcacuuugagagguugaggcaggaggaugauuuaagccuaggaguucaagacuauccagggcaacauagagaaaucccaucucuacaaaaaauuaaaaauuagccaggagugguggugcacaccuguaaucccagcuacucaagaggcugaggugggagaauugcuugagcccaggaggucaaggcuacaguaagcugugauugcaccacucaccacuauacuccagccugggcaacagagugagacccuguuuuuuuaaaaaaaaaagagaaucagagugugauauccagugauccaaauauggucaccuuguaugaagagauaagaaccaccuuuccuacuuuauuauuaguauaaauuaaaguugaaaauuuuaacauguucccaaacaacagaaaaagaacacuuguucauauuucauagauucugcccuuaaaaaaaaaaagacccuuaauuguguaauagcuaugugcccaacaaaugcaagaauaaaaagaagaaauucaacuuuuccuuuucaaagcccacaaaaguuacauuauacaucaauaaauauacauccucauuuuuuugagucuuugucuagauuauugaaaacugcaaaacaggccggguguggcagcucaugccuguaaucccagcuacucaagaggcugaggugggagaauugcuugaacccaagagucagagguugcagugagccgagaucacaucacugaauuccagccuaagcaacagagugaguaagacucuuucaaaacaaaacaaaacaaaaaaaacaaauuuuaaaacuguagaaugaaucuuuagccaaaaaagaagugugaguugugaauccagaugaacuaaccuucagggccaauucauauguggcugagcuccagauaucucuuucugccacuaacuuuuucauaucauucuccauccuuucucuuuguaauguauauaagucaugauauucuucuacuauucuauaaaaacaauuaagaaacagcuucauuuaauuuauacuaacaauauagacacauauauuuuuuaaaaaagaaauuuguuuuaaaauagguaauguguuccuuuaaaacucaucauaagguaauuaugguauaauugcugaauauauugauaacacauauacagugaaauagaagaaaaauacucacauuuaauuuauaaaucuuauaaaagucuuaaugaaaguaaaaaucucauauacuguuccuugcucuaaacauuuuucaucuuauucuuuauuuuuucacuagaauucugacaugauauuccaaugguauaauaacaccauaucuaaugaaaaauucagcauacaaguaacaauaaccuaacaguuuuauugucaaaguuugcucacagaccuaagauucuuuaugaaagguacaaaguccaauaauugugagccacuaaaauuuuuaauuauacauaauuaguacaagauuaaagaaaauugucccuuaacccuuuaaaaccuuaaauaaagcagcuuuuucuuaacuauuguuucuuuaugucuaccagaacauaccuuuuuccuucuaauuuacacugaagcuucauuuaaaauuaacagacuuccuggcugggcgcaguggcucacgccaguaaucccaacacauugggaggccgaggcagguagaucaccugaggucaggaauuugagaccagccuggccaacauggugaaaccucgucucuacaaauacaaaaauuagccaggugugguggcgugugccuguaguuccagcuauuugggaggcugaggcaggagaauugcuugaaccuggggggcagagguugcagugagccgagaucgcgccacugcacuccagacugggcgacagaaaaauuaaaagaccuccugaaguaaauacaaacauagaaguuauaacguaacaaguagcauuucacaaaucuuuugaaacacuuccucccaaggacuuugcaauaagaauuaguccacugaaguagaauucuucuagucuuagaggcuuucauuuguucaaaauaauaaaaaaaaacuuauacaggugaauacacauguacaaauucacugagcuauacucuuaagauuugugcacuuuauugccuaaaaauuagaccucaauuaucaaaagagaauuaaugacccuaauuuaacaguaaaagcaaaaaauccagaaacaaucucaauguccaacaacaaaagaguagacagauaaaaauauaauguaguucuaugauuuaaaaaaaaaacacuggagauaauuaaacaucaucauauuauuuuuguuuuguuucguuuuuuguuguuuugaaacagaguuucgcucuugucccccaggcuggagugcaauggcacaaucucggaucacugcaaccuccacgccuggcuaauuuuuguauuuuuaguagagacaggguuucaccauguuggccaggauggucucaaacuccugaccucaagugauccgcccgccucagccucccaggggugcugggauuacaggcaugagccaccguaccuggcuaaacaucauauucuuaauacuuugguacaugggaaauuucuucauguuauaauacacaaugaaaaaaccaaaaugcuaaaauuauaaaauguuugaucucauuucuauuaaaaaaauacauaaaguucuagcuaauuuggcaagugaaagaaauaaagggcauccaaauuagaaagauagaagucaaauuguuccuguuugcagacagcaagaucuuacauauuuuuuuaaaaaaccccuaaaaguggcaccaaaaaacuccuagaauugauauacaaauucaguaaaguugcaggauacaaaaucaacauacaaaaaucaguaguguuucuauacaccaacaaugaaccaguagaaaucaagaaagccaucccauucauaauagauaccaaaaaagaacaucuaggaauaaauguaaucaaggaagugaaaaauauguacaagaaaaacuacaaaacacugaugaaagaaauugaagaugacacaaauaaacugaaagccauaccauacuagugaaucgaagaauucauaucauuaaaaugaauauauugcccaagcaaucuauaaauucaaugcaaccccuaucaaaauaccaaugucauuuuuggcaaaaaaaaaaaaaaaaaaaaagaaagaaaaaaagaaaacacacuuuaagagucaaggcaggaggauuacuugaaccuaggaguuugagaccagccuuggcaacauaguaagaccacauuuaggggaaaaaaaaaauuuuacccaggcaccaggcacucuaguguguaccuguagucuagcuacucaguuggcugauguguaaggauugcuugagcauugaggucaaggcugcagugagccaugaucaugcaacugcacuccagccuggaggauacagugaaccccaucucuauaaagaauuuuucauaaaauuauccagguuugguggcucaugccuguaaccucagcacuuugggaggccgaggugggaucacuuaaggucaggaguucaagaccagucuggccaacauggcgaaaacccauccuacuaaaaguacaaaaauucaccaggugugauggcaugugcaugccuguagucccagcuacuugggaggcugaggcagaagaauagcuugaacccagaaggcagugguugaagugagccgaaaucacaccaguacacuccagccuggcaacagagugagauuuugucucaaaaaaaaaaaagaauuuuucauaaaauuggaaaaaaaugacgauuaaaucagaugcacagauagcaaaguaagaacauaggaaacaugaaaaaauaauuaucuaguaaccaaucucaacagaaaggaaauuuauaaaaugucugaaaaagauuucaaaauaaugauauuaaagaaacccagugagauacaagacacacagauaaagaacacaaauaaaucaggaaaacaauccaugaucuggaugagaaacucaacagagacagguaucauaaaaaggaaugaaacaaaaacccuggaacugaagaauucaauaaauguaauaaaaaauacauuugauagcuucaacaauagacuauaucaaguagaagaaggaauuucuucugaccuugaagacaggucuuuugaaaaaaccuagucagacuuuaaaaaggagagagagaaaugaauugaaaacaaugaagaaagcuuauguggauauaugggacaccauaaagugaccaaauuuuuuuuauucuggggaguuucggaaagagaagagauggacaaagacacagaaaaccuauuuaauaaacuaauagcuugaaaauucccaaaucuugcaagagauaaagacauccagauacaagaagcucaaagauccccaacccaaauuugacugugggacagucaacccacaaagauauuuucuaaggcauauuacagucaaacugucagaagucagagacaaagggagaauucuaaaaacagcaagagaaaaacaucaaguuacacauaagggaauccacauuagacuaauggguuucucagcagaaaccuuaagccaggaaagaauugaaugauauauucaaaaugcugaaaggaaaaaaagaggccaggcacaguguuucacgccuguaauuccaacacuuugggaggccagugcaggcagaucacgaggucaggagaucgagaccauccuggccaacauggugaaaccucgucucuacuaaaauacaaaaauuagccggucaugguggcacgcgccuguagucucagcuacucgggaggcugaggcaggggaauugcuugaaccagggaaacggagguuguagugagcugagaucacaccacuacacuccauucuggugacagagcaagacuccaucucaaaacaaaaaaaaaaagaaagaaaaaaaacccugcuagccaagaauucuguaccuagcaaagucauccuucaaaaguaaaggacaaaagaagucuuucucagauaagcaaaaacugaggaaauucaucaccacuagaccagccugaagguaguccuauauuuagaaacaaaaugacaauaucuaccaucaugcaaacacaucaguguaaaaaaucucacugguagagcagaaacaaaaaagagaaaggauucaaauguuaccacuacagaaaaccaccaaacagcaaugauaaacaauaaaauaagaggaaaggagaaaaagcuauacaaaauaaucagaauauaauuaacaaaaugacaggaguaaguccucaccuaucaauaauaaccuugaauauaaaagaauuaaauucccccauguaaaagauauagauuggcugaauggauauaaaaaugcaaccuaaacauaugcugccuccaaaaaacucacuucacuugcgaaaacauauauagccuaaaagugaagagauggaaaaagacacucuaugcagacagaaaccaaagcaagcaggaguacuuauacuuacaucagauaaaucagaauuuaagucaaaaucuauaaaaagagacaaagaaguucauuauaugaagauaaagggaucaauucaggaaaaggauauaacaacucuaaauauauaugcacccaacccuggagcacccagauguauaaagcaaacauuagaucuaaagagacagauggaagcuaauacaauaaugguuggggccuucaaaacccuacacucagcauucaaaagaucaucuagacagaaaguuaacaaagaaacauuggauuuaagcaauacuuuagaacaaauggacauuacaggaauuuacaaaacauuuuauccaacaucugcagaauacacauucuucucaucagcacauggaacauucuccacaagugaccauauauuaggccacaaaauaagucucaauacauauuuaaaaauuggaaacauaucaaguaucuucuuggaccacaaugaaguaaaacuagaaauuaauaacaagagaaacuuuggaaacuguacaaauauguggaaguuaaacaacaugcuccugaaugaucacugggucaguaaauacauuaagaagaaaauuuuuaaaugucuugaaacaaaugaagcacaaggccuaugggauaaugcaaaaguagugcuaagagggaaguucauauuaauaaacaccuauaucaaaagagcagaaagauuucaaauaaacaaccuaaugauuguuuauuauuccaggaacuagaaaagagagaaaaaacaaaacccaaaauuaguagaaagaaacaaauaauaaaugucagagcagaaauaaaugagagaaacuaaaaaacuacaaaauaucaacaaaauaaaaaguuaacuuuuugaaaaaauaaacaaaaucaauaaacuucuagcuagacuacccaagaaaaaaagagagacgacucaagcaaauaaaaucagaaacaaacaaacaaacaaaaagagauauaacugauaccacugaaauauaaucaugaacaacaauccacuaacaaauuggaauaccuagaagaaacuagauauacuccugaacacauaaaaccuacaaaauugaaacagaaaaccugaacagaccaauaaugaguaacaagauugaaucaguaauuaaaagucucccaaagaguguaaauuaguucaaccauuauggaagacgauguggcguuuccucaaggaucuggaaccagaaauaccuuugacccaguaaucccauuacuggguagauaccaaaaggauuauaaaucauucugcuaugaaaacacaugcacacguauguuuacugcagcauuauuuacaauagcaaagauuuggaaccaacccaaauguccaucaaugauagacuggauuaagaaaauguggcacauauacaccauggaauacuaugcagccauaaaaaggaugaguucauguccuuugcagggacauggaugaagcuggaaaccaucauucucagcaaacuaacacaagaacagaaaaccgaacaccgcauguucucauucauaagugggaguucaacaaugaaaacacauggacacaggaaggggaacaucacacaucaggccuguuggggguuggggggcaaggggagggagagcauuaggacaaauaccuaaugcaugugggacuuaaaaccuagaugauggguugaugggugcagcaaaccaccauggcacauauauaccuauguaacaaaccugcacauucugcacauguaucucagaacuuaaaguauaauuaaaaaaaaaaaagucucccaacaaagcaaagcccaagaccaaauggcuuuacugcugaauuguacacaacuuagaaagaauaaacaccaauucuucucaaaugauuccaaaaaauugaagaggagggaauucuucuuaacugauucugcaaagccaacauuauuuugauaucaaaaccagacaaagacacaacaacaaaaaagaaaacuacagaccaauaucauggaugaacuuagaugcaaaaauuccaacaaaauacuagcaaagcaaauccaacaacauaucaaaaagauaauacaccaugauuaagugggauuuauccuggggaugcaaggaguuuguucaauaaacauauuugaacauuuuuuggagauuugugacaacuugauaaagcucagccaggugugguggcucacaccuguaauuccagcacuuugggagggcgaggcagagggaucaccugaggucaggaguucgagaccagccuggccaacacagugaaaccucaucucuacuaaaaauacaaaaauuaacugggugugguggcggaugccuguacucccagcuacucaggaggcugaggcaggagaacugcuugaacccaggaggcagagguugcagugagccaagauugugccacugcacuccagcuugggcaacagagugagacuccaucucaaaaaaaaaaaaaaagacaaagaaaaagcucacagaugaacacagccuagaaauaucaaaaaaugaagaaaaguuagcaaugucaugaauagauaaaauacacguagauacuggucuauuuuaucauuuacuaccauaaaauguauuauaaaaagcuaaaauuuaucaaaacuuacacaaacacuuacagaccauacauggcacauucauagucaagagaaauguuaacaaauguacagguacaguauuaaaucauaguugaauaaaauuaacuacaguacauacgguauuacuguaauacuuuuguagccaccuucugcugcuauugcagugagcucaaauauccacuuaaaacacgauguaggccgggggcaguggcucaugccuguaaucucagcacuuugggaugcugaggcagcaggaucacaugaggucaggaguaguuccagaccagccuggccaacauggcaauacccugucucuacuaaaaauacaaaaauuagccgggugugguggcacaugccugaaaucccagcuauucaggaggcugaggcaggagaaucacuugaauucaggaggcggaggcugcagugagccaagauugcaccacugcacuccagccugggcgacagagcgagacucugucucaaaaaauaaaguaccauauaauguaaucaucacugcaugaguaguuuguaucuccagucaauuguguauugcaguaaaaagugaucucucccaguuuucacguaauuuccaucacguuuaguacaguaacauaaaccuugaauaacaccaugguaccuauacgaagugucaguaguaaugcugaaaguacaaccaagaagcagagaagagucaugaugucacaagaaaaauuaaaugcuugauauguacuguagauucaggucugcaguuguaguuacccaccauuucugacagacaaauucgucuuguaaacagaugauguaaauguacaauaucaaugaauacaguacaguacuauaaauguauuuucucuuccuuaugauuuucuuaguauuuucuuuucucuagcuuacuuuguuguaaaaauacauuauauaauauauauauaacaugcaaaauauguguuaauugacuguuuaucaguaagguuuccagccaaccauagaauauuagugauuaaguucuggggacaucaaaaguuauauguagguuuuugacuauguggguuucagugucucuaaccccuacauuguucaacagucgacuguauacugaaagacacuguuucaaguaagauuaacugauccauugugacaaaugcugcuaguaaggcaagugaaaugagaauugaucauuggauuuagcaauaugaagaucauaggugacuuugucaagugccauuuaguggcaugguaaggaugagacacaagugauaauggcaagagaagaaacaauaaagacaaugaguaugacaacuuucuguagagauuuccuguaaggagagcagagaaaagggaccauagcaggaagggaagguguaguucuaagagaccugggacauuuuuguuuguguuuuuuguuuuuaagaugggaguaauuauagcauauuugcauacugaugggauuaaucagcuagagagggaaaaauuaaugaugcaaaaaagagaaggaacguuugcugcaaguuucucaaguaaguaacaggggauaugaaaguauacaaacaagagauuggccuuagaaaggagcagacuauaguuaacaaaagggaaaacggaauauauaagcacagaugcagguggguggauagaugugggggugacagcuuaaguucucuucuguuugcuucuacuucuuagaaagcaagaucaucagcuuauaaagaggguggaaagguaggauugaagguauaaggauagaagacuaaguauagaagucaccucgaaaaacaagaaaguuauacuacagaaaaaaguaguauauagaguaggcaaaaauugaauaaaguaucucauguuacauauuaguccauuuucaugcugcugauagacauacccaagacagggugauuuuuuuuuuuuuuuuuugagacggagucucgcucuguugccaggcuggagugcaugaugucggcucacugcaaccuccgccucccagguucaagcaauucuccugccucagccucuugaauagcugggacugcaggcgcaugccaccacgcacaguuaauuuuuguauuuuuaguagagaugggguuucaccacguuggccaggauggucucuaucucuuaaccucgugauccgccugcuucagccucccaaagugcugggauuacaggcuugagccaccuugcccggccccgagacugaauaauuuauaaaggaaaagagguuuaauguacucacaguuccacguggcuggggaggccucacaaucaugguggaaggugaaaggccccucuuacauagcggcaggcaaagagagaaugaaagccaagcaaaagggguuuccccuuauaaaacaaucaggucucgugagacuuacuaccacgagaacaguacagggaaaccacccccacgauucaauuauuuccccccaagucccucccacaacacgugggaauuaugguagcuaaaauuuaagacaauauuuggguggggacacagccaaaccauauuaugcuaguaaagaauaaaauagaauaaaaguaaaaauacauuucugaauuuagaucuuagguacauuugguuuuucuugacauuuaaaaaauucaaucacucuucaaucaauuuuuuagaaagcacaggaauaggcuguauuaaaagagauauaaaacaagauguaauguguguucuuagauuggauacugguuuggcuaacccaacuaugaaauguauuuuggaaaaacuugguaaaauuuuaauaucuagcuaauuuaugaaguaaaaauuuacugaaauaggcagacguucuuuuuuuuuuuuuuuuuuuugagauggaguuuuguucuuguugcccaggcugaagcacaauggcacaaccucagcucaccgcaaucucugccucccagguucaagcgauucuccugccucagccucccaaguagcugggauuacaggcauguggcaccacaccuggcuaauuuuguauuuuuaguaaagaaaggguuucuccauguuggucaggcuggucucgaacucccgaccucagcugauccacccgcuuugaccucccaaagugcugggauuacaggugugagccaccgcaccuggccguacacauucuuuuuaucauuuguuuguuucuguguccuuuuuuuuuucuuuuuuuuuuuuuuuuuuuuuuugagacagagucucgcucuguugcccaggcuggagugcaguggcaugaucucggcucacugcaaacucugccuccuggguucacgccauucuccugccucacccucccaaguagcugggacuacaggcgccugccaccaugcccggcuaauuuuuuuuguauuuucaguagaaacgggguuucacuguguuagccaggaugguguugaucuccugaccucgugaucugcccaccuuggccucccagagugcugggauuacagguguuagccaccacaccuggccaucuucucuuuuuuuuuuuuuauuucuucccuaauuuuuaaauuuuauuuuuccauaaguuauugggguacaggugguaucugauuacaugaguaaguucuuuaguggugauuugugagauuuuggagcacccaucacucgagcaguauacacagcaccauauuugugguauuuuaucccucaucccccucccacucuuucccccaaguccccaaaguguauuauucuuaugccuuugcauccuccuagcuuaacucccacguaucagugagaacauacaauguuugguuuuccacuccugaguuacuucacuuagaauaauggucuccaaucucauccaggucacugcaaaugccauuaauucauuccuuuuuauggcugagugguauuccaucauauauauauauacaccacaguuuuuuuauccacucguugauugaugggcauuuggguugguucuacgauuuugcaauugugaauugugccacuaugaacaugcccaugcaaguaucuuuuucauauaaugacuucuuuuccucuggguagauacccaguagugagauugcuggaucaaaugguaguucuacuuuuaguucuuuaaggaaucuccacacuguuuuccacaguggguguauuaguuuacauucccaccagcaguguagaaguguucccuaaucacugcauccauggcaacaucugauuuugauuuuuugauuauagccauccuugcaggaguaaggugguacugcauugugguuuugauuugcauuucccuuaucauuagugauguugagcauuuuuucauauguuuguugcccauuuguauaucuucuuuugagaauugucuauucauguccuuugcccacuuuuugacgugauuguuuguuuuuucuuaccgauuuguuugaguucauuguagauucuggauauuaguccuuugucagauguauagauugugaagauuuucucccauucugugggcugucuguuuacucugcugacuguuccuuuugcugugcaaacacucuuuaguuuaauuaggucccagauauauaucuuuguuuuuauugcuuuugcuuuuggguucuuggucaugaaauccuugccuaagccaaugucuagaaggguuuuccaauguuaugucuagaauuuuuauaguuucaggucuuagauuuaaguccuuaguucaucuugaguugauuuuuguauaaggugagagaugaggaucugguaucauucuccuacaugcgguuagccaauuaucccagcaccauuuauugaaaaggguguccuuuccccacuuuauguuuuuguuugcuuuguugaagaucaauuggcuguaaguauuuggguuuauuucgggauucucuauucuguuccauuagucuacgugccuauuuuuauaccaguaccacacuguuuuggugacuauagccugaaauaggucgacauucuuaacugaaaaaauguugauuguagaauagugcauacaauacaauuuugguuuuaacuauacauauacaugugaguacauguacacagaaacaagacccauagcaccagccugccugcuuccucccaauacugcagcuucccccaggcccacagcaaugccccacaucacuuugcuggcccaugugugugcaggcauguuuugcuuuccuugccucaccagcaugcaugugugcauacacccugcccugccacugauauggcaguaguacauucugcccuuccacacccuccccccaaccccugccacaaggcuuugauccauuacagugacagccuuggugggcagacacccagccagucccacccccacaagcacccugcccuuaguggcaacacuccuccaagaguaaaacuaagcucagagaacaguggacucuccccugcccugagugaccaccccugccugcagcucacagagaaugcacauagaccugcaucugccagagccuugcccccaugcuaagaccaccaccagcacaacugugcacacaguugccagcaggggccccccaacccucuuccagcugugcugccuccacucuguggugacacccacauggaagcaggcaccccagcaccuguugcagccaaugagaaugcacccccacaacauugccacuacugcugcugcugacacaugaaaacaagggcagaucccacugccacagcacuaugaaaggcuuuggcugacaccacccaacagaguguagugaccagugguccaggagcaccucagcuccccccagugcaguggauuccuaaccucaaggagcagagaacaaagcuggucccaauacaagucccccagaguuggaguacacgguccaggaguuggaagcugagcguuggcccccuagaaucuuccagaaauaaagccaguugguugaauccauuuuauaccacaaucaaacucucgaugucaucauauaggauaaaaggggaaaaaaacacccaaacaucagcaacuucaaagaugaaacaaacaucagcccacaaauaugagaaaaaaacaacacaaggacucugacaacucaaaaagccagagugccuucuuuccuccaaaugaucgcaccaccucuccagcaaggguucugaacugggcugagauggcagaaaugacacaaacagaauucaugcuauggauaggaaugaagaucauuaagaugcaggaguaugcugaaacccaauucaaggaugcuaugaaucacaauaaaaugauaaaggagcugacagacaaaauagccaguauaaaaaagacuguaacugggcugauagagcugaaaaaauguucuacaauaacuucauaaugcaauuacaaguauuaauagcagaauaaaccaaguugaagaaagaaucucagaacuugaagacugguuuucugaaauaagagagucagacaagaauagagaaaaaagaauaaaaaggaaugaacaaaaccuuggagaaaugugggauuauguaaagauaccaaaucuaugacucauugaugucccugaaagagauagggugaguguaagcaacuuggaaaacauauuuuaggguaucauccaugaggauuuccccaacguagguagagagaccaacauucaaauucagaaaaugcagaaaacccuaguacaauacuucacaagaagaucauccucaaggcacauaaucaucagauucucaaaagucaaaauaaaagaaaaaagguuaaaggcaucuagaaagaaaagucaggucaccuacaaaaggaagcccaucagacuaacaguggaccucucagcagaaacccuacaagccguaagagauuggaagccaauauucaacauucuuuaaaaaaagaaauuccaacccagaauuuuauauauguccaaacuaagcuucauaagugaaggggaaauaagauccuuuauagacaagcaagugcugagaaaauucauuaccaccagaucugccuuaaaagagcuccugaaggaagcacuaaauauggaaaggaaagaccauuaccagcugcuauuaaaaaacacauaaguacacagaccagugacacuaugaagcaaccacacaaacaagucugcauuauaaccagcuaacaugaugacaggaucaaaucuauauauaucuuuacugguuuaccuuaaauguaaaugggcuaaauguccugauuaaaaggcacagaguugcaggcuggauaaagaaacaagacccauugguaugcuaucuucaagagacucaucucacaugcaaugacacccauaugcucaaaauaaagggauggagaaaaaucuaccaagcaaauggaaaaauccauucugagugauugauacauaaauuauacauuaauacauaaauuauaauuuagucauaugguuaauauuauagugcagaaauauuuguucuauaugcaucauaacgagaagaucucaaaagaauaguauuuaguugguaaaagcaaguuuuuuuuuuuuugagauggagucuugcucugucgcccaggcuagagugcuggagugcaguggcgcagucucggcucacugcaaccuccgccuccuggguucaagcaauucuccugccucagccucccaaguagcugggacuacagguacgugccaccaugucagcuaauuuuuuguauuuuuaguagagacaggguuucaccguguuggccaggauggucucgaucuccugaccucaucauccacccaccucggccucccaaagugcugagauuacaggcgugagccacugugcccagccgcaaauuuuuuuauauguaacuauguauuauaguaaaauauaaaaacauggauaggaaaguuacauaccaacuauugauuagugauuaacucuggggagggaagaagcagaauggagauauauagagauacagacauagauauagauguauuuuuuuaaaucuccaaauauuuuucuuuuuuuuuuuuuuucuuuuuaugggacagaaucucacucugucacccaggcuggagugcaguggcacaaacucagcucacugcaaccucugccuccuggguucaagcaauucucaugccucagccuuccacguagcuaggauuacaggcaagcaccuccaccuccagcuaauuuuuguauuuuuaguagagaugggguuuugccauguuggccaggcuagucucaaacucucaaccucaggugauccaccugccucagccucccaaagugcugggauuacaggcgugaaccaccaugccuggccuaaaucuccaaauauuucuauaaaauuuuguuuccuaaaaauggggugugaaacaaguaugacauaauggcugacauuugguaauucaugaaagguaaaugaguacucacuauaaugcuuucuuuuucugaaugucugaaauauuucaugacauaaaauuucauuaaaagcaaccauuauaagaauauuucauauugucauagcacugacuauaugccaagcaccauucuaagugcuuuacuuauauuacuuccuuuaauacucguaauaaccuaugagguagguaauauuauuaucccaauuuuacauaugggcaaacuuaggcccagaaaaguuaagugacuucccaaaggucacacagcaaacaguaugguuccagaaucuauguuaucuaugcucacuguuucuuuacccuuucuuuuagaaaaccagaaaguaauagccugcaauccucacucaaugaaaaugauuaaugcagaaagcaacggucuaucuccaagagaaaaaaucauguuuuaccuucuuugcacccagaaugagaaaucaacuaaauucagauaaaguaagcuaucuauaugugauuuuagaauucaagaaguuauaguaucauauauauuauuucagaagcuauauaagcuucuuccuuuuccccuauguaagcuaaacaaacuuuaagcaacucacuuggcauucuuuuccgcauuuaaaagagcuugugccaaauccuugugggcuuuuucuguuuccuuuguuaauuucacaucaugugcccgaacuagacacaguucccugaaauaaagcaaagaaauuuuuaauucauauuuggagauuuccaaaaaguuucuaccaagaaaaucagauuuauauucaggaaucuucucaguuaucauguguaccucccuucccaguuuuuccaccuuauaaaccaaaucaagaaauugaguguacauucuagauggaaucuugccagguuuggaaaugaaaucaggcuggcaggaaucagacagaaauaagauguaggggagauccuuuagaauggagggaggcagaugcugacaugcaaggccgccaugcuggucuacccugcuuucugauaugacuauccuaucuucuuuauucucaccacuaaccaucuugcuucaagguuaaaaguuagaugaucacuaacuuugauggcuauaugauacuuauucucuuugagauguuaacauccauaauguuaacauccauaauuauggcacuguucuauaaaccugauuaagguaaacaucuguauuuuauuuuauuuuauuuuucugagacagggucucgcuccgucacccaggcuagagugcaguggcaugaucuuggcucacugcaaccuccaccucccggguucaagugauucuccugccucaaccuccccaguaguugggauuauaggcaugugccaccacgccugucuaauuauuuguauuuuuaguagagaugggguuucaccauguuggccaggcuggucucaaacuccugaccucaagugauccucccgccucagccucccaaagugcugggauuacaggugugagccaccaugcccagcaacaucuauauuuuagaagaaagaguaagucuuuuccaugucaaauauauacagagucuucauuuuuaugugaacuugcauaacccauuuaucuauaucuauaucuacaaugacaucuaguucuuuuuguucucuugcuaaacaugaaaaggaaacagaagaaccuuggccuuuaaccauuccacuuucccuaaauauuuuuuacucccuuuagagacaugacauugacuuuuguuuuguguuuaagauaaucacaguuuuuaccuggucaguucuucaauaacaugcuugaaauuauacaauucuucuaaaaugcgcugguccaucacucgcugaguuaccaagucuuuguagaaaucaaucaucugccgagcaaucuggucaagcauuugcacauaccucucucugcaugacaaacaaccaaaaagcuccuagaucugauaaaugaauuuaguaaauucucagguuacaaaaucaauguacacaaaucaguagcacugcuauacaccaagaaaaccaagcugagaaucaaaucaagaaaucaaucccuuuuacaacagcugcaaaaaaaaagaaaaagaaaaagaaaagaaaauacuuaggaauauacuuaaccaaggagacgaaagaucucuacaagaaaaacuacaaaacacuauugaaaaaacauugcaugugacacaaacaaauggaaacacaucccauguucauggauggguagaaucaauauugugaaaaugaccauacugccaaacucaaucuacagauuccaugcaauucccaccaaaaauaccaucaucauucuucacagaacuggaaaaaaaaaauccuaaaauucauauggaaccaaaaaagaccccacauagccaaagaaauacuaaacaaaaagaauaaaucuggaaacaucacauuaccugacuucaaacuauacuacaaggcuauaguuaccaaaacagcaugguacggguauaaaaauaggcacauagaccaacggaacagacuagagaauccagaaauaaacucagauacuuacagccaacugaucugcaacaaagcauacaaaaacauaauguggggaaaggacacccuuuucaacaaauggugcugggauaauuggcaagccauauguagaagaaugaaacuggauccucaucucacaccucauacaaaagucaacucaagauggaucaaagacuuaaagaccugaaaccauaaaaauucuagaagauaacaucagaaaaacucuucuagacauuggcuuaggcaaagaauucaugaccaagaacccaaaagcaaaugcaacaaaaacaaaaauaaauagaugggaccuaauuaaacuaaagaacuucugcacaacaaaagaaauaaucagcagguuaaacagacaacccacagagagggagaaaauauucauaaacuaugcaccuggcaaaggacuaguacccaaaaucuacgaugaacuccaacaaaucagcaagaaaaaaacagauaauuucaccaaaaagugggcaaaggacaugaauagacaauccucaaaagaagauauacaaacaggcaacaaacaugaaaaaauacucaacaucacuaauuaucaagaaaaugcaauuuaaaacuacaaugaaauaucacccuacuacugcaagaauggccauaauuuaaaaaaucaaaaauaaaugucagcuuggauguggugaaaagagaacacuuuuacacugcuggugggaauguaaacuaguacaaccacuauggaaaacaguauggagauucuucaaagaacuaaaaguagaacuaccauucaaucuaacaaucccacuacuggguaucuacccacaggaaaauaagucauuauaugaaaaagacacaugcacaugcauguuuacaguagcacaauuugcaacugcaaaaauauggaaccaaccuaaauguccaucaagcaaugaguggauaaagaaaaugugguauauacacacuauggaauacuacuuagcuauaagaugaaaugaaauaauggcauuugcagcaacuugguuggaguuugagaccauuauucuaaaugaaguaacucaggaauggaaaaccaaauauuguauguucucacuuauaaauaggagcuaagcuaugaggaugcgaaggcauaagaaugauauaauggacucuggggucugaggaggaagauuaggaugggggugaggaauaaagacuacauauuugguacaguguacacugcucagcgggugauggguuauauuaguccauucucacagcgcuauaaggauauacccaagacaggguaauuuauaaaggaaagagauuuaauugacucucaguuccacagagcuggggaggccucaggaaacuuacaaucauggcagaagggaaagcaaacauguccuucuucacauggcagcaggaaggagaagaaugaaagcccagaaaaggaagaagcccuuuauaaaacuaucagaucucuggccaggcacagugacucaugccuguaaucccagcacuuugggaggcugagacaggugaaucaccugaggucaggagcuugagacuagccuggccaacacagugaaacccucucucuacuaaaaauacaaaaaauuagcugggcaugguaaugcauacuuguaauccuagcuacuugggaggcugaggcaggagaaucaccugaacccaggagcuggagguggcagugagcugagauugcgccacugcacuacagccugggcaacagagugagacuccaucucaaaaauaaauaaauaaauaaguaaauaaauaaauaaauaaauaaaaucaucagaucucaugagaacuaauucacuaucacaagaacagaaugagggaaacggcccucaugacucaaccaucucuaccuggucccuuccacaacauguggggauuauggcaacaacaauucaagaugagauuuggauggggacacagccaaaccauaccacgaguacaccaaaaaucucagaaaucaccacucaagaacuuaucuguguaaccaaaaaccaccuguucuccaaaaacuauugaaauaaaauaagagaaacaagguaucaugcagaaggaaaggaaaaaaagauagaaaauaugcaagagagaaaguaauguuaggcaauaaaauaguaaacagacauuccaaaagauaugugagaugaacaauauaggaaaaaaaaaaaaaaaagaagaagucuggccucaguggcucacgccuguaaucccaacacuuugggggcccgagguggguggaucaccugaugucgggaguuugagaccagccugaccaacauggauaaacccuaucucuacuaaaaauacaaaauuagccaggugucauggugcaugccuauaaucccagcuacucaguaggcugagacaggagaaucacuugaaccugggaggcagagguugcagugagccaagauugcaccauugcgcuccagccugggcaacaagaucgaaacuccaucucaaaaaaauaaauaaauaaaaaauaaaaagcacagaagcagaaugcuguggcuucauuaaaaaagaaaaaaaaaggaaucuaggcuguguuuuccugccaugccauacaagugagugaacaauuguagaaaauuguagagcccuaauuauuuggaauaucauauguuagacguaaaacaaaaauaaaaacuuguuuuauuccuucuucuagauauaaauucuuugagacuagaaacgaugucuuacauauuuguauuuuuacaacaucuaacagcaugacuuaacguauagugagauucuuauaaauaguuaaauucaugaauaaagccauuuuuucaaauugacaacauguaaaacgacaacuauuuaaacacaaacaaaaaucuuuaauacaaagaagucauuucuuuugcuucugaauaaaaccaaacaaaauauuuggaagugaucacagaugauaaauuauaaauaccauaacagaauaguauucauuuauauuaacagugaucuaggccaggcgugauggcucacaccuguaaccucagcacucugggagaccgaggcagguagaucacuugaggccaggaguucaagaccagccuagccaacauggaaaaaccuuguaucuacuaaaaauacaaaaauuaguguggcauaguggcacaugccuauaaucccagcuacuuggguggcugagacacaagaaucacuugagccugggaggcagagguugcagugagcagagaucucaccacugcacuccagccugggugacagagcaagacugucuuaaaaaaaaaaaaaaaacugaucuagguguuacacccuaagccugagguccuagauuuguaauaugucugaguugacuggucguuuaaucuuucauucauugacagaaagaauuauccagcccuugcuuuaaggcugaaaguggcagggaguuuaucaccucaagaugcagcucauauauuggaaauaucaauuuaaaaaacaucaucuuuaggauuucccccuccugacaauauaggaacuaaauacucugaaggaccuucccauuacaauccaacuagauccauaagagaacacacuuuucaaagcauuacugaguuugcaggaagaaacagaagacucuagggaugaaaaacaauaagaacaaacaaaaaauaguaaguuagaaauggagugggaguuguaagcaguaagcaaacccaaggucaggaugguccccaggaaaauaccaacacugagaaccagagacuaagccuugggcugacuucaaagugggagacgugggcaaguguaggacuacugcaugaaucccagauuccagaagggagcacauacaaaucuucuuuuuccagaaagcauccuggauucaugcccugaggaucccauggccaaggucagugaaauauuagcuccacaagcaaaggcugcaaaauacuaauguaaauaaaccaccaugaaugagacucagaagaaauaaccaauagcagauuuuauaagacuacgcaugaaauguuugagaaauaaaaguuagaaucuaaaaaugggcugggcaugguggcucacaccuguagucccagcacuuuguggggcugaagugggcagaccaccugaaauuaggaguucgagaccagccuggccaacauggugaaaccccgucucuacuaaaaaugcaaaauuagccaggcaugguggcgcaugccuguaaucccagcuacucaggaggcugaggcgggagaaucacuugaaugcggagguggagguugcagugagcugagaucgugccauugcacuguagccugggugacgagugaaacuccaucucaaaaaaaaaaaaaaaaagaaucuaaaaaugaauaagcaauaaaauuauuauauuugaugagacaaacguggaaacaaaccaacaaaacucuuaagggaggccaggcacaguggcucacaccuguuaucccagcacucugggaggcugaggugggcggaucgcuugaggccaggaguucaagacuagccuggccaauauggcgaacccugucucuacuaaaaauacaaaaaaaaaaaaaaauagccaggcaugguggugugugccuguagucccagcuacuugggaggcuaaggcacaagaaucacuugaacccgagagucagagguugcaguaagccaagaucgugccacugcacugcagccugggccacagcgagauccugucucaaaaaaaaaaaucucuuaggggaaaaauauaauuguugaguuaauaauagauggguuauagcauaauagacacaccuagagaagacaguaauguccuagaacaaauuacucaaaauguaggacagagacaagagggaaacuaugaaaaagagauuaagagacaaagaagacagaaugagaauaucuaacauauaucuaaucaaagcuccagaaacagaagacagaaugcaguacagacaugagucaaagaucaucacugauaauuucccaacacuucugaaagacauuaaucuauauagugaauuaugguauagauauagguacaggaaauauaaaaagaaauccagaggaacuaaauuuacuuuccuaccugaagugacaacaacaaaacaaggacaaagaauaggaaaccauuuuuaagacacuggauaucaggcaaugaaagagagugaucccugagagaccagaaauaaauaaagcaaacccuacaauugugccagccuaaugccuugggagaguuuuccaggccauagcacacugagagggaauccaggaagaccccaguugacucucugaguuaaggagacagaguuaacagucuagagagaugaaagcagcuagaguucagaggacagaguagcagagagaaaagaguuauacaagauaugcagaagaucucccucaaguguucagcuaaguacugaucagggcauaaaugugagaaaacuacccaagaccaaggaaagaacuacccaaaaggaucagagguaagaaugccagaacucgcauagaaguaguaccaguaccaaccaaccagacuguaaaaacucaugauucaugggacauuggauaugguacacagaaaaguuuugucuugguauucagaaauaauuagcccuaaauugggcacugcucuugucccaccuaaagaccuaacaggaucaaauuuuuuuaaauaacuuaauugugucccaaaacaaagcuaacgaauauuuguaugaaaacaaaaauauacagcauccaaauaaggcauaauucaugacugccauccaaucaaaauuacugcuagguuuaaauguuucuccccucauaacuaguguugaaauuuaauuguuauuauaacaguauuaagagguggaccuuucaggagguguuuaagucgugagggcucugcccugauaaauggacuaaugccauuauugcaggaauggggucauuaucgcacaaguggacccacucccucuuucucucucucucacccucucacuuucugucauguuaugauuaccacaagaagguucucaccagaugauggcaccuuuguacacugcacuucccagcuucccaaacugugagccaauaaaucucugcucauuauaaauuaccccccgucugugauauucuguuauagcagcacaaggcagacuaagacaauuacuaaacauguaaagaagcaggaaaacacaccuaugaggagaaaaaucaaugaaucaaaacugacccagaaccaaaauagacgguagaauuaacagacaaaaccacuaaaaguuaucuaacuacauucuguauguucaaaaaguuaaguagagacauggaagauauuuaaaagacccaaacugaccuucuagagaugaaagcaaaaaugucugagaugaaaauauauacuagauaggauuaaaguaagauccugucucuacaaaaaaaaauacaaaaaaauuagcugggugugguggcacacacuuguagccccagcuacugaggaggcugagguaggcggaucacuugagcucaggaguucaaggcugcaaugagccaagaucaugccacugcacuccagccuggguaacagagcaagacucuaugucaaaaauaauaagaauaguaauaauaauuagauaggauuaaaagcagauuagauauuaugggaaaaaaagauuaaugaacuugaagguauagcaauagaaacuauccaaaaugaagacaaauagaaaagagcaaaaauguguauaacauuagugaucugugggacaacuucaguacuaguggccuaauacauguguaaacaaauucccucaaaagagguggagggacagaaaaacacuuaaagaaauagccaaaaauguuccauauuugaugaaaacuauaaagccacagaccaaaaugcuuaauaagcaccaagcacaagaaacgugaaaaaaaacuacaccaagucauagcauagugaaacugcucaaaagcaaugguaaagaaaaaaucuuaaggcugggcucgguggcucacgccuguaaucccagcacuuuggaaggccaaggcaggcagaucacgaggucaggaguucgagaccagccugaccaacauggugaaaccccgucucuacuaauauacaaaauuagccgggcgugguggcaggcgccuguaaucccagcuacucgggaggcugaggcaggagaauugcuugaaccuuggaggcagaaguugcagugagccgagaucgcgccauugcacuccagccugggcgacagagcgagacugucucaaaaaaaaaaaaaaaaaaaaaggaaaaaauccuaaaaucagcuccaggaaaaacacacauuacguuugggggaauaaagacaaggauggcagcagauuucucacuggaaacaaugcaaaugagaguagggcaacaacaucuuuaaaguacuaaauuuaaaaacugucuauauccaacaaaaauaucuuucaaaaauucucuuauugccccaaggccagguaccaaacaaccagggacaaccccuauuauggaaugcccagugaaauuauccaaacaauccaaucuuaagccuacuuaaccugccucacuuauuccuucccaaggaaaccacaauagaggugccuccccacagguucccucccucucauuaccucaugacugacuuggugucuccccgcaauggcccuguauggcaugcugcuucuccccagggagcugugaguauaacaaaacuauaaaacucuuucuggguucuuucucuugaucugcaucaggucucacuguaucucacccaagauaauauggcuaaaauaaaaugaaagcuauagacccuuuccauauauuaacaaaaaagaaaaaaaaaugcaguuagauuacuuacgaucaguagaauagagaagugcacuuuuguggcauucucaaaaguagauauaaagacaaaucuaauauaaaaaucaaaaggaaacuggaccauuccaauaacagcacuaaccugacuuuagacagaaguucuccucugucugcacaguccacacugacuugucgaauaaguucaugaaauaucauguuguaaauggucuguuccuucuucaauauauguaguaguuugugcaucugucagaagguaaguaacauaaucaguacuuauuacagucuuaguaaaaaacauuuuaggagguuaauaccuugaauguaaauaaguuuuagaaacacguugauuaauuuauuucacuuacauuuucauuuauauauauacaaaagugauauuugauuuuuaaaugcuggucugcccaagugcaguggcucacaccuguaaucccaacacuuugggaggccaaggugggcagauugcuugaggcaaggagcuugagaccagccugggcaauauggugagacccugucuguacaaaaaauauaaaaauuagccagccaugguggcacacgccuguagucccagcuacucgggaggcugaggugggaggauccccugagcccagggagguugcagcugcagugagccauaaucacaguguacuccagccugggugacagagugagacuuugucucaaaaaaaaaaaaaaaauuggugccucuuuaucugaugcacugaaaaggucacaauaucacuucuauguuauagcugccaaaaauaaaaaaccccaaucuaaaaucaugacuauacaucugacaaaccaaaauugaagaacauucuacagaguaacuggcuuguguucuucaaaacaacaaggucaagaaaaacaaagaaaggcugagaaacuguuucagauuaaaauugucuaaagaaacaugacaacuaaaagaacuaugugauuucuuagauucuggacuaggaagaaaaaauagcuauuuuuaaaagccauuacagagacaauugauaaaauauaaaauuuaaaugucugugucagauaauacuaucauaucaacauuaaauuuccugauaacuauauuauggauauauaagagaauguccuuguuuguaggaaauauauccugaauaucuggguauuaaagaggcaugaugucuccaacucacucuaaaugguucagaacaaagugaugcauauguagacagagaaggagagagaaugagaaagcaaauagggcacaauguaaauaaccagauggagaauccggguaaagguuacauagcagugucuuguauugaacuuuuucuguaaguuuccaauuccaaacaaauaaaauacauaaaacaaaaaagaaauagcccugauaaagaaaaaggucucuaucuauguaagacuaaaagaguucuuucuuaaguagaaaauaaaaauuacaagugguggccuggugcggugguucaugccuguaaucccagcacuuugggagggugaggugggcagaucacuugaggucaggaguuugagaacagccuggccaacauggugaaaccccaucucuacuaaaaauauaccuggcaguguuuuuuaguguuacauaaaauaauaagggucuuacaaucaaugauaccuuauauuuggugaaauaauaauacuaacaauuaauuauacagugucuaccacaugccaagaacuguucuaagcacuuuacauuuauuaugucauuucaucuccacaaaaacccuaugagguaggugauauuauuaucuccaaaguucagaugaggaaacugagguacaaauacauuaaaugacuuguccaaggccauuaguaaauauauggcagggucagaauucuaaccuaggcaaucugccuccugagugcaugcucuuagccaccagguugcauucggcuuugcaauuaccuucguugguccuguauauuccugauuuuccacaccagcccucucuagcauaguauccaucacaucauucagcugggccacuucuacucuuuuauuagguuuccuaaaaaauuaagguggcagacuuaugcaauuaacauugcaacagggaauucucaaauggcaaaaagaauauaauauguguaaagagaauauauaugcucucugggauauuaauggcauuuuaagcauuagaccugugucuauuaaucuauugggagaucaauaauauaguagaaaaaaggaagaaaaaugcaaauaguaugauucucuuuuucauaaaagaaaauaaugcuuccccccaaaaaaaauucuauauaccuaucauauagcaguguaagaacauagaaaaagaaaaaauguagggagauaaacaucaaacuuuuaacauugguuaccucacaaugugagagaagaaaagggacaaagaaaaggaaaaaaaagacuauagcaaaauggagaaauacuaaugguuaaacauagaauauaaaaguacuuuaucauauuuaaauauuaugcuauauauguaaauauguaaaauuuaauaugcaauuagacaaaugaaauauauaaacauugaauauacaauuguaaaaacgaaaacacugauuagaugaugaacuuguaggcaauuauugccuuggguugcugcuauaauuuuaauaauuuuguuuaauaaaguaccaagaaauguguauguauauagguauucuuucugagaaagacuuuagaaaauaaacuguacuuacauggaugggaagagcaauagccuguuuucacuaucugugaggagaguaguguauuugcuacaauaaauaagauagguaaauguuauuuuaagaaaauuuucuggccuguuuaucaauuagcacaacuaacccccagaaucuugguuucuaaguaccauucuccacuaaaaggaaugaguacugcuuggagaagugacucaccacccauuccagggcuggaguuggaaaauacaagaugaaccuggaagucuuaucaagccagaaaauaaguguucaaauaaucaucgggacauggccaaagaacacaagagaaagcucaaaggagcagccuuuggccauuggccaaaucuggaaaaauuugagcaucaaaauaaugggccgggcaugguggcucacaccuguaauccuaacacuuugggaggcugaggcgggcagaucacuugaggucaggaguucgaaaccagccuggccaacaugaugaagccccgucucuacuaaaaauacaaaagaauuagccgggcaugguggcaggcgccuguaaucccagcuacucaggaggcugaggcaggagaauugcuugaaccugggaggcggggguugcagugagcagagaucgugccacugcacuccacccaugacagagcgagacucugucucaaaaaaauaaaaaauaaaaauaaagggcugggcgugguggcucaugccuauaaucccagcacuuucagaggccaaggcaggaguucaagaccagccuggccaacauggugaaaccccgucgcuacuaaaaauacaaaaaaaaaaaaaaaaaaaaaauuaggugugguggcgcgugccuguaaucccagcuacucaggaggcugaggcagaagaaucgcuuaaacccaggagguggagguugcagugagccaagaucacgccacugcacuccagcuugggcaacaacagcaaaacuccaucuccaaaaaauaaaauaaaauaaugauaguaaagaauuaaaauccaucaaauaaaauagaaauccauuauuccauaugguaaaaugccaaauaacaaauuggcagaagaaauaaugaucauacagaagaaaugaugaaauuuuaaaaaauucaucaaggccaggugcaguggcucacaccuguaaucccagcacuuugggaggccgaggugggugggucaccugagguccggaguucgagaccagccuggccaacauggcgaaaccccaucucuacuaaaauuacaaaaauuagcugggcaugguggcaggcaccuguagucacagcuacucgggaggcugaggcaugagaauugcuugaacccaaggggcggagguugcagugagccgagaucgcaccacuucccuccagcccaggugacaaagcaagacuuugucucaaaaaaaaaaaaaaaaaaucagccaugugcuguggcucaugccuguaaucccagcacuuugagaggccaaagcgggcagaucaccugaggucaggaguucgagaccagcuuggcuaacauggugaaacccuguuucuaccaaaaauacaaaaaauuagccaggcaccguggugccugccuguaaucccagcuacucaggaggcugaggcaggagaaucgcuugaaccugggaggcggagguugcagugagccgagaucaugccauugcacuccagcuugggcaauaagagcgaaacuccgucucaaagaaaaaaaaaaaaaaaaaaaagucaccaaaagaucuauaacuaauggguuguuaggaaauacacacuaaaguauuuggugguagaaguauuugauuauuuacucuuaaauaguuugaaaauaugugcauguguaugcaugcuuguguauguuuaagagcaaaugagacaaaguguaaacaaccagugacucaagguagaggguauauaggcauuccuuuucccauuuuugcaacauuuuuaugucugaaauuacauuaaaauaaaagguuacccaaaaaaugaauuucauuugguucucuugggcaaaauauuguucugaaacauaccaucacaaugaaaugcaauauauuauaacauacauauuggaaagacaauaucaaaagagugacagccucuggauauuuuauuauaaaaccuuaguccaaaguucucauuuucuaaacuauaaaacauucaaguguuguuucagaaaauaaaagcaagauccuauuuucaaucccauaaacaggaaucaaagaugacaagauaaugagucugcaauguggagccaagcccuggagcauggauuaugagaugcuggcucagagggcuacuuuccuuugucuccauaaucauugcucaaaaucauuccuaaagggcauagucacacauucaaacaaaguuccauuuuuuaaaaaauucaaaauuaaauggcaggaaaaaauaugaauaauuuaaucacuaacaucccaaacucuuuuaaguacuuuuaguuuuuauuuuuuuuaauuuguaucuuuuucuuucauuuauguauuuuuuuuuugagacggagucucacucugucgcccaggcuggagugcaguggcgcgaucucagcucacugcaagcucugccuccuggguucaugccauucuccugccucagccucccaagcagcugggacuacaggcacccaccaccacgcccggcuauuuuuuuguauuuuuaguagagacggaguuucaccguguuagccaggauggucuugaucucccgaccucgugaucugcucgccucagccucccaaagugcugggauuacaggcgugagccaccgcgcccugccaauuuguaucuuucuuaauuguauuaggauggcuggcucaaauguuuccucauuucaguuuauauauugcucaggaauaugaguguacuauucucagguucuucuauguaugggaaggaggaaacaguucaacuugucagguauucuuucuuuuuuuuuuuuuuuuuuuuugagauggaguuucacucuuguugcccaggcuggaguguaauggugcaaucuuggcucacugcaaccuccgccucccagguucaagugauucuccugccucagccuccccaguagcugggauuacaggcacccgccaccacacccagcuaauauuuuuguauuuucuguagagacggacuuucaccauguugaccaggcuggucuugaacuccugaccucagaugauccacccgccuuggccucgcaaagugcugggauuacaggcaugggccaccgagcuggggcagguauuuuuuacauaucauaguacucacucaucauaacacuccaaaccugaaacuccuguacuugacacaauaugaaauucuucaggaaucaaaguaucuguuagugucuuuggcuuaaaagaaaagaaaagcaaaauaaaagaaugaauauauuaauagagaaaaaauucacuugcacaaauccuaauuccuaaccuaaagagauacuauuuuuuaaguugaaaaauuuugauuggagaaauaacaauauuagcaaugugggucauagcaaaugacaaaaacuaaccagagcacacaucucuaaaauaaccauaaauuaaagaauaaccuuggugcuaguauuaguuacauguaucccauauauucagaaguuuauugauuccuuuccuuuaaauucagcagggaauuuaaaauucaacuuagcaagauaccaaagauaagaauccuacaacuuuauauguggauuucuaagggaaaaacaauauaaucucccacgcuguguuuuuuagauuaaaacagauuaacugugguucgcaaaauggcuuaaaauaagacauuuugaucuuuuccugcuaaauacccuuuucccauuuuaagaaguaauuugaaaaugcuaugaagauuggugagcaaugcagguuguuauaguaugacguuguuuuauauuuuauauuuauauuaaaaaucauuuuaaaaugauuuuuaaaaguagacagagggagagaagauuauuugucaaauacuuuauuuaccuuauggggcacaaugacaccaucaugugacuguaaugaacgggccaaaugugggggacaaacugccuucucccuagucuguccuuuggcauauguuacaucguacagaaaagaaauaucccuaaaaaguaagaaaaauauauuuacaaaacaaauuuucuaucuggauaccacauaacagcaggugagauccacacauauccuucuaauggguaagaugguccucugugucagcaaaacugaucuccuuacauaacacuuuacuaagacugaggcauuaaacaugaguucccccacauucuuucucuucuccaccugaaauuucucauucauaucacaaacucuuuccuuuccuucaguaugagguuaaaauauauucucuuuccuauggcuauucccuccacuuaggugcuugauuccaucuuugcccauauccucaggagucucauuccaucaguccuaacuucuguguaucuccaacucuacauccccuuugaccuauaauaaacuuuuuccccuucuaaaaauauuuccuugaacauguauugcugucauguugugauuguuauuaucauuauuauuauuuugacacagagucucacucugucgcccaggcuggagugcaauggcgcaaaaucucagcucacuacaaccuccaccucccggauucaagcaauucuccugcccagccucccaaguagcugggauuacaagcacgugccaucaugucuggcuaauuuuuuguauuuuuaguagagaugggguuuugccacguuggccacgcuggucucaaacuccuggccucaggugaccugccucggccuuccaaagugcugggauuacaggcaugagccaccaugcccggccgcugucauguuauuaugaucuaucaauggaucaaucgauugaucuaucaucgaucacuuguguuaaacaucaaacuuccuaaaauuguccugcaauuugauuuccacccauaccucucuucugaaacuauuuucuagaaagcugauggugauuaccacugccaaguuaaacaaucucuuagcaguuaucuucuaccaugcuucccuggaauguuuuccaggguugaucacauuugcaacuuuucugugagucuuuaaauuauuucaaaauaagaaguuuaauaaaacaaaauacagaaaaguggagaaaaaaauccucugauaaccaagaugugggcaaguggucuaagcuaggccaaauauacucuuccaggagacggaaucuugagucauugacucuuuuaagacuuccaggacagaaaacaauaggcauuaauucaucacuacaaugguacccugaaaugauuguccauuacauccuucuauaaacuccaaauguauuuacugguuuacauaguaaagacuaauucagcaucuacugcauaccuggcacugcgagcuaagaacacuaauagugaaaaaagcaaauaaaaaguuccuacccucauggaacugauucuaguggugaagaaugacaauacagaaauauuacaauuucaaggccaguugcaguggcucaugccuguaacaccagcacuuugggaggcugaagggggcagaucacuugaggucaggaguuuguggccaaccugaccaauauggcgaaaccccaucucuacuagaaauacaaaaauuagccgggcgugguggugugugccuauagucccagcugcuugggaggcugaggcaggagaaucacuugaaccugggaagcaaagguugcagugagcugagaucgugccacugcacuccagccugggugacagagugagacuccaucucaaaaaaaaagaaaaaacuacauuauuaaauuugggugcccuggguuauaggauuguacauuaacgugcccaaaauucauuaauuugcucagcaaauauuuauuaaccauauuguaagugacagaaaauaugcuagaugaaaggaauauagaacuauuucuuaaaauagacacagucccuaccauuggggagccuucaauauagaggggaagauucgcaaaccaaagaaaaguauaauauaaagacauuguaacagagaauagaauguuacuggaauaacuaauaacaacaccacccaaauacaguuuagaccaagucagggaaaacuucgggaagcaguaacaauuagugagaacaagaaacugauuuggauuuagguaagcaaccgaaaaguguagagaacagcauaugcauagguccugagacacaacagcacauggugacuucggcaaacugaaaauguaguauaguugacccuugaacaacacagccuugaacuguaugggucugcuuauacaugaauuuuuucaaccaaacgcugacugaaaauacaguauucaccggauaugaaacccucauauacagagggccaacuuuccauauauauacaugaguuucugacucauguacggcugacugcagaaauugaguggacacagauucugguaucugcaggugucugggaaccaaucccccacauaucccucaguaugagggaugacugaauauacaguugaaguaugaagaauaaaauuguugaaauuagagaacuaaacacagagagccuugcaaaucaugcuuaacauguugggcuuuagucuaagagaagcuagaaagguuuuauggaugaaaugaaauuuuaaauuauuuuagaaugacuauaacaguugcaauauugugaaauggugggagagggugugcuuugagggcaaugccauuuggcagcugauguggcaugugagguugguggaaacaggccaguucuagugucccaggaagauccugaaauauacaacauggaccauaacuauuuuuaaacguauauauugguaguaaaagacaucaagcuauugauguccugcgcugugauauucugguucucuuggauauguacaggggaaaaauguuagagcuguauuucccaauccuccggauucuuucucuguuccacccucuuagagguuuuacauagucacaaagaucugaaugagcugcugucaggaugauggaacagcaguucuuaucacaccaauaaaugcuggagaaguuggccauuacaauuguuuuguuagcuaaaaaugaugaaugcuucauguacauauauguguguguagauacacacaugugcauauauuauauacauauauguacauauauguauguacauauauguguacaguauauaccuguauauacauauauaaugcauauguauacauuauacauuauauguuauacauuauauauauuuuauauaauuagacauauauuauacacacaauauuuuaugcacauauacacaaacauauaauuaaagaauauguuggggccgggcaugguggcucgcgccuauaauccuaguauuuuagggggccaagaugggcggaucaccugaggucaaguguucaaaaccagccuagccaauauagugaaacaccaucgcuauuaaaaauaaaguuaaaaaacuagccagaugugguggcaggcaccugucaucccagcuacucgggaggcugaggcaggagaaucgcuugaacuugggaggcagagguugcagugagccaagaucacaccacuacacuccagccuggaugacagagcaagauuccaucuuaaaaaaaauuuuuuuuuuauuaauaaagaauauuuugauuuaguaaucaucacucaaauucucucaagaaccuacuuuagcagccuuuuguauuuuuuuaauuuuuaaaaauaauuuauuuuauuuauuuauuuuuuaaauuauacuuuaaguucuaggguacaugugcacaaugugcagguuuguuacauacauauacaugugccauguuggugugcugcaccccccauuaacucaucauuuacauuagguauuccuccuaauguuaucccuccccccuccccccaucccacgacaggccccggugugugauguuccccacccuguguccagguguucucauuguucaauucccaccuaugagugagaacaugcaguauuugguuuucuguccuugugauaguuugcucagaaugacgguuuccagcuucauccaugucccuacaaacgacaugaacucauccuuuuuuacggcuacaaaguauuccaugguuuauaugugccacauuuucuuaauccagucuaucacugauggacauuuggguugguuccaagucuuugcuauugugaauagugccgcaauaaacauaugugugcaugugucuuuauaguagcaugauguauaauccuuuggguauauacucaguaaugggauugcugggucaagugguauuucuaguucuagauccuugaggaaucaccacacugucuuccacaaugguugaacuaguuuauccucccaccaacaguguaaaagcguuccuauuucuccacauccucuccagcaccuguuguuuccugacuuuugaaugaucgccauucuaacuggugugagaugguaucucauugugguuuugauuugcauuucucugauggccaacgaugaugagcauuuuuucaugugucuguuggcugcaugaauaucuucuuuugagaagugucuguuuguauccuuugcccacuuuuugaagggguuguuuuuuucuuguaaauuuguuugaguucuuuguagauucuggauauuagcacuuugucagauggguagauugcaaaaauuuucucccauucuguagguugccuguucacucugaugguaauuuuuuuuugcugugcagaagcucuuuaguuuaauuagauaccauuugucaauuuugguuuuuguuaccauugcuuuugguguuuuagacaugaaguccuugcccaugccuaugcccugaaugguauugccuugguuuucuucuaggguuuuuaugguuuuaggucuaacauuuaagucuuuaauccaucuugaauuaauuuuuguauaagguguaaggaagggauccaguuucagcuuucuacauauggcuagccaguuuucccagcaccauuuauuaaauagggaauccuuucuccauugcuuguuuuugucagguuugucaaagaucagaugguuguaaaugugugguguuauuucggaggccucuguucuguuccguuggucuauauaucuguuuugauaccaguaccaugcuguuuugguuacuguagccuuguaguauaguuugaagucagguagcgugaugccuccagcuuuguucuuuuugcuuaggcuugucuuggcucugugggcucuuuuuugguuccguaugaaauuuaaaauagauuuuuccaauucugugaagaaagugaguggcaacuugguggggauagcauugaaucuacaaauuaccuugggcaguauggccauuuucacgauauugauucuuccuauccaugagcauggaauauucuuccauuuguuuguguucucuuuuauuucguugagcagugguuuguaguucuccuugaagagguccuucacauuccuuguaaguuggauuccuagguauuuuauucucuuugaaacaauugugaaugggaguucacucaugauuuggaggagccuuuuguauuucuauacauuauuaaaguacuggguauuguuaugguuugaaugugucccuuagaaauucauguguuggaaauguaauugccauuuuaauaguaucauuaugaaguggaaccuuuaagaggugauuguguuauugauuuuuagaagaagccuguuuuauuuacuuguugaaauauaauuuuuuauuaaaaauaauuagagggccaggcgugguagcucacgccuauaaucccagcacuuugagaggccgaggcggguggaucaccugaggucaggaguuugagaccagccugaccaacauggagaaacccggucucuaauaaaaauacaaaauuagcugggcaugguggugcaugccuguagucccagcuacgucagaggcugaggcaggagaaucacuugaacccgggaggcagagguuguggugagccgagacugcgccauugcacuccagccugggcaacaggagcaaaacuccaucucucaaaaauaauaauaauaauaauuagagauauguuuuguuucuucauaaaauucuaugguaaaacacccgcuuccacucuucuggaaaaucuauuuuuauuuaaaaaaacaaaaaacaaaacaaaacaacuuugauucuuaaucauaacauaauaacuggauuuuauuuauuugucuuuaagaaauucuccaacucguucuucagcccccagauuauuaacugaguucauaauucaagcucuucuucaaaucaucauugguugaguuaugucuaucuauaaacaugucuuuuaucugaagaugucaaugucacccuguucugggaguuauucgcacagguacuuccucauaccagcuccuuuagcccuuccaacaauuuuguaaauacccaauguucugcauuugauucuuuccugcuuaaaauaucuagacugauuuauuuucugcacugaacucugcugaaagaguugucgaaaaauauuacucgagaauauuugcuuugcuguuuuauauuuuacugcuggguucugggugauugagguugcuggacaaguuaucucguuaugcauacuauuaguugugcauuugugcauuaguuuucuauuggugccauaacaaauuaccacaaauuuagcaucuuaaacaacauaaauuuauuaucuuacugcucuguaggucagaaguccaacagggucucaaaaggcuaaaaucaaggcauuggcaggacuguguuucuuucuggaugcucuagaggaagauccaauucuaugcucauuuggguuguuaacagaauucaguucuuuaaaguuguaagacugcaaucccuguucccuugacaguuggcgacugagcugucauuagaauuccuaacuucuaguagccaaauucauuucuuggcugcuuuuccccuuccuccuucuucaaagccagcaaugucaggcugaacucucacaagucaaagcuguccucuuccuuucucaucucucugacccacuugacugccuuccuuuuccacuuuuaaagauucaggugauuaggcugggcccacccugacaaucuaagauaaucuauccauuucaauguccuuacuuucaucauaucuguaaagucccuuuucccaggugagguauguauucacagguucugagacuacagugaaaauguuuucgugggguugagggggcauuauccugucaaccugacuucacacuuaaaaaacuccaacucagagucauuugacauuaaaacuuuauuuuuuguuuuguuuuguuuugagagggagucucgcugggucgcccaggcuggagugcaauggcacaaucucagcucacugcaaccuccaccuccuggauucaagcaauucuccugcguuagccucccaaguagcugggauuacaggugugcgccaccacgccuggcuaauuuuuguauuuuuuguagugacaggguuucaccauguugcccagacuagucucgaacuccugaccucaaaugaucugcccaccucggccucccaaagugcugggauuacaggaaugagccacugcaccuggccaacauuaaaacuguaaugucagcuuagugccacauucagauauagcuaauuaauuuucaaaguacuucaaacaacucauaauacuaauuauugcuaccaauaauuauaaccaugauccggaggcauagaauaaaauauaaagccucaguacauaaaaaucaauaggacaaguuucuaccacuuuuccuugcacugaagcauagcugaguaauagcaccuauacuuaaauagcacauuauaguuuuacaagugcucuugcaucuauuaucuuauuugugcuuuacaauaucccugggaggcacacaaaacuggcccagccuauuauucccuuuuuacauaugagaaaauggggcuucagaaagacuaaauaaccuacucaaguauguuaaguguaaacauuuguuucaguagaagggacauuuaagugagggcgcaugcauggaguaaauugauaaguggacaauacauagaaaacuagcaggucucaaucuucacagggaaaauguugacccacuugaccgccuuagaaugacuuagaauguuuguaggaaugagacaaaaacaaauaguauuugcugacuugaucugaaacaguguaaagauuaagggcucccuuuggagagauccagaaauuaagcuuuuguuuuucaagguuuuccacaucaugaagcuauguuaccuaguucuuucuucuaaagauguccacaaagaagacauacacacagauaaaaggagcacuaaaggcauucugccuguuggaucuugucccuuuuacuaggguacaacagggaauaggagaguauagggacaaguauacaaaggcaugcaaaaagcaaauuuaaaccaaaaauauguaaagccagcaccuauuuccauccuacugauaauaaucacacacaaaaagauggucuuuggcccuucuggauuguauucugauucaaagauacuguaaauuuuaucaucuaugauucagugauuuuucuaauucugccccucccaagguaaucauucaaaaugagaaaacaacucuauuuaucagcaucuauccuacuaucuuccuucuuuaccuuccagcuccugugagggagacgggauggucaaucagguauuugaauuuauuccuucgaacagggugaugccagacauggucuacaaggcguggaagagugcccugggaaaaagcaaauacacaugaauauccagcagagggcgaucuaaucaaauaaaauguauuaauaguuuugaguaaguacuguauuuacauuaagggcacuuggguacucuaaggaaaaaagagagcagaauucuuauuaaaugacauaaagacuaaaacuagaauaauucuauagugagugaaaaacauuaaggguagcaauuaucauuuuaguaaauccacauaaaaacaggucaauggaaauacucaagccuuggaaacaauuuauacaaaagacuggaguuuucaaucuaagaaauuauuuuaaauuuuuuuuuuuugagacagagucuugcucugugguccaggcuggagggcaauggcgcaaucucggcucacugcaaccucugccucccggguucaagugauucuccugccucagccucccgaguagcugggacuauaggcgcaugccacuaugcccagcuaauuuuuguauuuuuaguagagacaggguuucaugauguuggccaggaugguugaucuccugaccucgugaucugccugccucagccucccaaagugcugggauuacagccuaaaaaaauuuuuuaaggccaggcauguuggcucacacuugaaauuccagcacuuugggaggcuaaggcggguggauugcuugagcccaggaauuugagaccagcauaggcaacauggcgaaacuccgucucuaugaaaaauacaaaaauuagccaggugugguggcacagaccuguagucccagcuacucaggaagcugaggugggaggaucaccugagccaggguagucgaggcugcagugagcaaugaucaggccacuacucuccagccugggccacaguaguaagacccugucucaaucaaucuuaaaauuuuuaaggcuaucuggaauauauaauaugugcauaauaaauacuuaaagaauaaucagaugcccaaaaaauaauguuccccauuacucuacauauguacauacaaaccuuugggguuuuaauuuucuuaggagguaguaaguuuucaggacaaggaccagcauuggccgcauaggucagagaaagaagaacuucuuugggaaugaacucauucugaagggaaguaggaaggaguuuugaacgauccaccauauuuuuuuucuccuuuagcucaggaaguccuaaguaaguaguggaaaagaaaaacucuuacuauauauuuuuuuaaguuagauggagcuucucagacugccucaucaaucccaucuguuucuaacagagagaaacauugcuucuauuugacaaagauaguaacaaauaauauugaaaacagugaacaucaucuagucaaggaaaauaacauucaucuugccuacccuacucacauuacaucagacacaguuucaaaaacucagguaccaagaugaaccugcaugauucucaauucaaaguugaaaacuaaacucauuucacuugcucagguaacugggagagccuuaagaagacaggaaugaaugucuauuuucccuuucauaugaaaaucacaaaucucuccccccaagcugucaaauuauuuaguaauuuuuuucuuacaugaauucaaaggugagaauaauugcauuaaaucgaggcauuuauagaguggaaaggcucuggguugggcuuaaaaguaaagauggaacugggauuguugcaaaugagaguggaacaaucugagcugacaaaucuguggaaugggaacuguaaaaagaguguucuacccugcuugacuagggcaggggaguaauaaaggcagguaguugggauaauguaggaaaagcccuccuaugaagucagucagguaggguugaguuguuauucuucuuaaucuaugccuguaacaugguaugguuuauguuuauuucuauaaggagguaucaugcuuugauuacuaucaaaaguuguuaggguuuacauuaccaaaucuccugagagcuugagaucaaaagaaacagaagaaaaaaaaaaaaguuggguggggcuugggguuuuaguacaaggugcaggugagaugggaaaagcuuuaacagaaccggguaaggauaacacuagcugacucuaguacagauccgcauaugaacgaaaaucuuaaggaauugcucucauuuagaaaaauuacuaaaagcuaauacaaauuggcacauuguacuaaauugaguuucucuuaucucugcuauuacuuuuuguuucuuuauuuacuuauuugagaccaagucuaccucuguugcccaggcuagagugcaguggcaagaucuuggcucacugcaaccucugccucccggguucaagugauucuccugccucagccugccgaguagcugggauuacaggcgagugccaccacaccaggcuaaauuuuguauuuuuaguagagaccggguuucaccacguuggucaggcuggucucaaacuccugaccucgugauuugagacggagucucguucugucgccaggcuggagugcaguggcgcaaucucggcucacugcaaccuccaccucccggguucaagcgauucuccugccucagccuccugaguagcugggacuacaggcacgagccaccacgcccccccuaauuuuuguauuuuuaguagacagaguuucuccauguuggccagaauggucucaaucucuugaccucgugauccgccagccucagccucccaaaugggauuacaggugugagccacugugcccggccuauuuauuuauuuauuuugagauggggucuugcucuugucucccagacuggaaugcaauggcucgauccuggcucacugcaaccucaccuccuggguucaagcgauucucuugccucagccuccagaguaagcugggacuacaggcgcgagccaccaugcccggcuaauuuuuguauuucuaguagagacgggauuucaucauauuuggccaggcuggucucgaacuccugaccucaagugauccgcccaccucggccucccaaagugcugggauuacaggcgugagccaccgcgcccugccucacuauuacuuuuuccaaaguuccuuaaagccaaagaccaggaaccaaaaaauacguaacuauugauauuuaaaauagguugaauuuaaaaucauauauaaaucaacauuugaaaaaaaguauaaacuguauuuagauggaguagugaaacaguacucugacucaaaauacuguaaaaggaaugacuucuugcuuuauuuaagcaaguguguuagaaaaauguagccaaucaagguauucugaauaucagauuuaaaaaaccggugaauggaaggugauuucugucuuacggccaugacuguuuaugacuucagaaucaacgaaguuuaccucuugucccuuccuuggcuacagacacuuuuaacuuuuugcucucagauguugauguagaguuuagcgggguggagggcguuuucgggagagacauaauaaacaaugccuccuaucucuuuaguaauuugaaauaguccuccggaaagcuaauuuagacacaaaucagcgccgcacugggacuugcaggcugccacauaguccugcaggcagaggaaaaaagauuuaaaaaaaaaaaaaaagaugacaacuauugaguacuuagguucagaucgcaguuuagaauucaucuagcaugguucuccuucuucggggcgaccucuauguucugggguuauguguagcgacuaagaagccuuaguggaccgucaggucggggucaaggagcagggcaggaaggacccgcucggcggaccccgcagaccgccggcaccccuggugggggacacucgcugcaggcggcucggcuggggaccauaccuuccccacaggcagcgcucucgcgcgccaguuccacaaacucgcgaguugggcaggccucgcacugcuucuugguuuaaaaugacgggaaagggacacccgcgauccuacccacacauugcguacccgcccagcauccgcucacuuccuccuuugcuggaacgccuguuugucgucauagaaacccagggccccgagguuuagcgcccuccauaggggcugccuucagcggugccggcggaggagggagacagcuaagacaaucccuacacccucuuggaguuucuuauguucuaagucacagcauagguucaguagcaaaggagaagaaaaacguuuaaucccgccguugucacggaauccgaaagugucucacgccggggcuuccugccgcgggccaggccagu

SEQ ID NO: 191152 - RNA, 10498 nt, Homo sapiens
ggcagugucaauaaaguuucagcgguuuguaguuuguagcggacaacauggcggccuucaugcugggcucgcugcugcggacguucaagcaggucaggccucuacuuuuauccacaccgcuaccccucaccgcugaaucucauaacccacgggucccccacggcucugccaccuguagugcucggugaggaccaguccagggguucuccuuccgcccucuuccgcgcuugggcuugguucaggggagguccgagcugcagaugucaauuugguuuucguaagcauaugacuaacugguauuggaagaugugagauugacuccgauuuguaagggaguaagcagauaggagacgaguuccgaggauugagcucucagagacuuguaacguuaagagaugagaaccgugcaagggagacugaaaggaguugucagcuagggagauggaaaacuaggagagugggauggccgggaagcaaaggaugacagaauuucaaagugugaggagugggcaacucugcucaaaguugauaaaucaauuaaaaagaagugcugagaauugaagaguuuagcagugugaagguuguugggaccuuaaucacagcuguucugaugguguuauggggacgaaagcguucaagagaauaggaggaaauaaaguggaguauagauaagccuuuaaaggagcuuugcuguaaaggagagcaaaaaaaaugggucaauaacgggggcggggagggggguuguuuucuuuuaacauggcagggaaaacagcauguuuguguaugaaagggaaagauccuguaguaaaaauugaugauguagaagagggaagaauugcuagagcuguaccuuuauguaggcaagaggcaauggaggcugguucgagugcagugguguuuacaacuaauugaucacaaccaguuacagauuuauuuguuccuucuccacucccacuuuuucacuugacuagcccuaaaaaaaccaaaaacauuuaaaaaaaaaaaaaaaaaagagagagaggcuauggggucuugugcaugaaguuuggucuuaggaaccuggacaguuaaucuguagcaguguuguucauagaaauauaaugugaaccacauguguaauuuaaaauuuuucuaguagccacauuuaaaaaauaagaaauagaugaaauuaaguuuaauauaauauuuuauuuaaccagguauauccaaaauacugugguuuuaacauagaaucaauauaacaaugacuuaugaaauaguuacauucuuuuuuuucauacuagauuuucaaacacuuaaagcauaucucaguuugggugcuaaauuucccaucauuaaaaugggaaauauaguucuaccaaaauaauaaaguuguuuaauguuuacaaugcuuugguuuugaauuuuaauuaaaauaaagaauuacauuccccaguugcacuaguuauauuacaaauguuuaauaccccuaugugguuagugguuacucuguuggacagaguggaucucugauaacaggagggaauguagaacauaugauacagaugcuaguaagugagccacuauguuggugagcauuuauagaaaugcucuuuugauuucuucuaauuuuauaauuaaggagaaagugaagucaucagcugagugugaggaugugggagcaagugucagagauuuaaggggagaaagacccuguaagagaguuggaaauggacagaaggaauggucaggagaauuggaguaaguacagagaagugagagaggggccagagaguugaugguguauucaagagaacguuguauuuauagaacaauggaauucaggcuaggugagagaggaagacaguaaaucaaaagcugagugaaaaaagugaaaaaugguaggaucaauggauugaaagucccagaaggauuguuauugggguguuagaaggagcaagcuagaaagaagugauaaugaguugagauauacaaagugagauaauagcuugcacuuauuaauaauaaaauacccacaacaugggcauggaauugaauaguuaaacaagaguggaggacaaaagucauugaaggagagguguuaagaaaucagagugaucaggguguaauuucauguauauugaaauaaccaggaauuaagauaggaacaauauuggagagagugacaauaagccaggauccaaaaucguggaaaaaugaaagggaguggcaggggcuuugguagaugacugcaacaaugagagggaguggaagguaguaagcccaauggcaugagucaaagccaggagcuuucaggaaggaaggagaacucgaagcugcaaugaagagcaaggaagacacuuaccuaucccaccucuaggcccaguuauggaagaaaaaggagcuacaggaaaagcugugaggagggauuuaaaauucggccagagcaaaaggugaaggagaugucaagagaaauugagaauuuaaaagauuuugaugauagaccauggauugagagggcccaguggaaagguuuuaggagcugaagaggggugagagaugggggcaggauaagauguguacagagcagaauagaguguggccuuaaucuauaaagcaccauuauaagcugguaaggaaauacaccacaguagaaaugcagacaaagcacauaaaaauguucacagaagaaauaauauaauaggccaauaaauauuuuauuuuaaaaguguauuacuuugggauuucaagaccagccugaccaacauggagaaaccacaucucuacuaaaaauaacaaaauuagccggguguuguggcacaugccuguaaucccagcuacucgggaggcugaggcaggagaaucgcuugaaccugggaggcaaagguugcggugagccacgaucgcgucauugcacuccagccugggcaacaagagcaaaacuccgucucaaaaaaagggggaaaaaauggauauuacuuuucuaguaagaaaaaaagguaugcaaaauagagugaaagacuauuuuuaaaaacuaauagaagucuucuaggagaauuugauuaggaauacuuugaaaaagaauucaaagaagaaaugcuuaaucuuguuuucuaaaucuccuguacccucaauuucacagguaaaagcaaaccucacauugccccucaaugugaacgguuucuuugauuucuccuugaucuuaugaauauaucuuguucuuuuccauguuuuguuuggacagacuaccuuuucuccccuccccuguccccacuuuagucaaaauucugucagcauuucaauguugaauugcugucaagauuucaaagccccucuuucugugacaagcauguccauccaugguuaccaaggcauucacuggacucagucauaugccacaucaauauuuaaauucuauuccugcuuaucuuuuuuucaaaaggugauugcagaauuguuauauuuccccaaggaacuuuuguuuaguaaugugagcacugaagauguucaguuuaucuuuuguuaauagauugaaaaaaugguggcuuucuauuuauaguauucuuauuuucaauuuuauauucugcuauacauauauuucauuuauaaacaucaguuaucagaagccaucauuuuucuauaggggcagcuuaauuaacauguaauauuuccucugguuugagagagacuuaucguuucuugugaucuauacucccuuugccuguccugucagucagaacuguaaauuaucaccgugaaaaugugagacaacaaggaauauacugucuuauuacuggacaacuagugcugagaagucuuaggucagugauaguuuuaaaguacccuuugaccuagcaguuuugcucccaauaaucuauccucaucaggcacaguggcucaugccuauaaucucagcacuuugggaggccaagacggauggaucacuugaggucaggaguucaagaccagcguggccaacauggugaaaccccaucucuacuaaaaauacaaaaaacaaaacaaaaaaaacagccaggugugguggcgggcaccuguagucugagcuacucaggaggcugaggcaugagaauugcuugaacccgggagguauagguugcagugagccaagauugcgccacugcacuccacccugggugacagagcuagauuccaucucaaaaaaguaaaauaaauaaauaauaauauaucuucaagauauauaggaauacauaugaaaugauuuccaagacauuauucacugcagcauuguuuauaauaauaaauagugagaucuguccagcaauacguggcagguuaaauuaugaugcuucuauauagcagauuaugcaauaugaagaaaauggggaagcuuuuuacauucaguuauugaaagaucucuaagguauauuguaaacugaaaagagggaacgaaaaaugggaggggaguguauacagacaaaaaucucugaaggauauacaagaaacuagaaacaguggauaccuguggggcaagggagucauugggcaggugaggaaugagguggggggagacuuuucacugugugucuucuuauaccuuuuugauuuuugaaccaugugacuauuggccuaaguacaggucaaacagaauaauaaaaauuucugaaaaucugucuuucaccuuccaauacauauguuauugcauuauauuauuaugauuuugacuuaauauacauccauaaaaguuauuuauucugaauaaauuaggaagucuauuaucuuaaacuauuaaacugaucuaaaacaacucuuaaaagaauacuaaaugauaaauaguggcagaaagagaauugcaggguugaggaacacucagaauguuguccuggcuauccuucacuugucccuugucucugucuuucagaugguuccuucaucagcuucaggccaaguucgaagucacuauguagacuggagaauguggcgcgaugugaagagacgaaaaauggccuaugaauacgcagaugagaggcuacguauuaauucacucaggaagaauaccauuuugccaaaaauucuucagguuagcuaauuaagaugagucccuuuguaccacaagaucauuaacucaacaucagaucacuuuugauacuguuuguugugacuugguaucaauauaauuucuggagaauaagauccacaucaauauaaacaaauagucuugaaacugauuuuguugaguuucaaauuaaagacuauucacuccuaacuagccuuacaacuguuucauuaugccagccuuagaaaguacugguaaauugggugguuauuuucaccuaaggucucucccugacuucaucccaauuuuuuuuuuuuugagauggagucucgcucuguuccccaggcuggagugcaauggcucagucucggcucaccacaaccuccgccucccagguuaaagcaauucuccugccucagucuccugaguaacugggauuacaggcacaugccaccaugccuggcuaauuuuuguauuuuuaguagagacaggguuucaccauguuggcugggcuggucucgaacuccugaucuugugauccacccaucugggccucccaaagugcugggauuacaggugugagccacuguguccagccgcaucccaaucuuuuaacuggcaaggcauugggaggcauugcugauguugaagucugugugccugguacgcggccuaaacuguuccuuaccuagcaccauucugagccugucuuccugaacucccuugcccacccucugugugcugaagugccuuuccauuaaggcuuacuuccuugucacccugcuuggcuuucugaagcauaaaguccugcaccuaaguggugauguagcauaucugcguucaaaaggcucaucagggagauauaaauuaaacucaaggccucucaaguuauugagaacucagauuuuuaaaaaacuacauuuagagaaguuggcagaaugauauacauccuauuuauuacuaugguuucuuuuuagucuugucuggauuaagccagaugagcagaaaacugagagccuuggaccacuggguuauggcuuacacuaaaguggcauuaagcuacuuuccuacauuuagggaguaauaagaaguggcaggccaggcacaguggcucacgccuguaaucccagcacuuugggaggccgaggcaggcagaucaccugaggucaggaguucaagaccaaccuggccaaaccccaucucuacuaaaaauacaaaacuuagaugggugcaaguggcacacccuguaaucccagcuacucgggaggcugaggcaggagaauugcuugaacucgggaggcagagguuacagugaaccgagaucacgccaguacgcuccagccuaggugacagagcaagacugugucucaaaacaaaaaaaaaagggcagggggcccccaagaaacugagcucaagacauugaucauagaggcagggaagcaggaugaugguugcuuggagcuaggaggacuaggggguauggcgggcagggggaaaucaggagauacuggucaaaggguauacuuccuguuguaagaugaauaaauucuguggagcuaacgcacaacaccguaacuauagucaauaguacuguauuguguacuugaaauugguaagagaguagaucugaaguguucuuaccacacauacacaaacgguaauuuugugaggugaaggaugcauucauuaacuucauugugguaaucauuucacaauguauauguuuagcaaaucaugacauuguaugccuuaaauauaugcaauuuuuauuugucaacuauacauuaauacagcuggggguguguuguuugaguaccuuuaugaagauacccagaagacaugucucugguaugacuagcagcaauaacugugcagagucugugaaucauguaaacugaucaugguucucugcugccugccaaguagcuuacaagucaaauuuaugucccaguucuaauuucacagcaugcacuuuuguguccugaggcuuuuaucuuuccuacucucauuucucuuugccccaguuuccucauuuguaaacugccuuaaaucuuucggggaacaagaaggaagggguauguaucaaucaaucaauccauaauuucuagccauucuuuaagguccaccuccaugaaacuuggcuucaaucuucuugcccagucauuucuccucuccaguuccuuguauagcauuuauuguuuacuacucaauggcucaaucaugguuuuuuuuuguuuuuuuuuuuuugagaugggguuuugcucuuguugcccaggcuggagugcaguggcacaaucugggcucaccacaucugccuccuggguucaagcgauucugcugccuuagccucccggccagaugggauuacaggcaugugccaccacacccagcuaauuuuguauuuuuaguagagaugggguuucccuauguuggucaggcuggucgcgaacucuugaccucagaugauccgccugccucggcgucccaaagugcugggauuauaggcgugagccacugugccuggcaaucauguuguuuuauguaauucuguuaguucauaaugguaacacaugcauaagcuuuuguuaauuuuuggcuuuuauauacuuucauuuaauuuguguuauuuuaauguguuauuuugcuugcaccgcagucuagcacaggguccaucuacuuguuagcacacuuaucagauuaaagugaauauuaugaacacucacacucuugaacacauacauaagaagaaaucucuacugacaaaaccugagcccuagcuacugcuguaaucccuacuuuucuccccucaaccacuuugcccuuaccugauucauccucuaccuugcaaaugauuuuuuuuaaauauaaaccucaucugaucucuccccuuuacuucucuagcugucagaaucuuuaccauagacaucagggcuccaugugauacucuccuuccuccuucucuagucuuaucucaagccacauucccuccuauuugaucaucauuccagagguuucacuuucgugauucaaaaaacaugaggcggcaacagaaauacauucacauacuuuacaaaugaguuaaacaagaguauguagcugcacuauuuauauucgcccaaaucguaagaugaccaucaaauguaggauggauaaaugaauuaugguacucaugcaaugaacauuaccugccaguggccaggcgcuguggcucacaccuguaauccuagcacuuugggaggcagagaugggcggauugccagagcucaggaguuugagaccagccugggcaacguggugaaaccccguuucuacuaauaauacaaaaaauuagcugagugugguagugcacaccuguaaucucagcuacucgggaggcugaggcaggagaaucacuugaacccaggaggcggagguugcagugagcugagauugugacauugcacaaucuaacacccacagccugggugacagagcgagacucugucucaaaaaaaaaaaaaaaagaaaagaaaauuaccugcaagugagaaggagcaaaauacaugugcaacaauguaaugugaucuguguaauaaugugauuucccuuaggauguggcugaugaagaaauugcugcccucccccgggauagcuguccuguuagaaucagaaaucgguguguuaugacgucccguccgcguggugugaagcggcgcuggaggcuuagucguauagucuuccgucacuuagcugaccaugggcaacuuucugggauccagcgagcgacaugguaaaugagcuccagaaccuauugagcuugcagggaagccaagcuugcaguuccagcaagcaaagauuuuuuuuaauagaccaaacccuaaucucuacaggggcccaguacaguuguuuggccuaccugaugcuaucucuaaacuacuuuuaaaaugaagacauuuggguguuucaugucagugaauuaucuuuucucuuggacuuaacaaacauacuguucccauacauaguacaaagaguagcauaauaaauauuuucugugaauguuuuuuauacccuccuuuuaaguuuaaucuuuuaguaacauauagggguuuuuguauuaagagcauuauuucauaaaaugcuaucuuauacauaauccaacuaauugacauguagcucauguauggcaguuuguaauccuggacuagcuuugcugaccugcagagcuccccuuaacuauuauuguuagauaaacagauuggauagcaaggcugcuguucuggauuaucuaaugcuccacuucuucuugugauggcugaacaaaagaaccacuaaguguuuucuuguccauccuuaagggacuuuaaaacaaauuaugccucuuuaaguccuugaaagucuccaucuaaagaggaaaaguuuguuggaacaguauauauucccuauuuuuauguuuauuuaauccauaacagaaaugaguaaggguagcacaaaguucucauucaguaacucaacagugugaucaucagcccagugauaaaaauauacauacugaauggaaguaccuacuuaacaucaggaaaauauuccuggagaacuuaauaaaucaggaggugaggggugagauuuuuuucugcacacagagggaacaaaagcacaaagaagcaaaggcacucuguagcaucagagaaccacagucacuucaguagaucagaaauaugaagcacaagacaaggcccguauuguggaggaucucacaaaucaugugaaggaauuaagacugacauaccagguauuacagaguuuuaagcacaggaaugacaucaucaguuuguaauacagguaagugacagcuguguggcagauggccaugagaggaaaaagcuacaggcaagacaaccaguuaggaggaugucuuaguuguugaggaagaugaaggccugaacuaacauugugguauuaguagaggagagaggacagauuuuuaaaguuuuaggaaagaaaauugggcaagacuuacaagacugauuauaucuaagagguaaagaugguucucuggguuccugauaaaagugucuagauagaugguagagggcaauuccaagagggcaacuccaagauagaaaauuuggaaaaagaacaaauuuaggggaaacagaagauaagcgaguucagguuccagucaugcgguguuggagaugccugugucaucugaugaagacuaguacgcagcuggauagcagaguccgaaacucagguggaggugaaguuaugagggaauuaucacaaucuaguuuggauucauauuucuuaaauauguaugacaacuuaccaacuggaauguucuagcuaauaucucaacuuagaauccaucucacuaccaaugggcaaacacuuguguucuaaaguuacuugcaaguaguuuauacugccaacuugauauauauacaugcuauaguuugaacauuuuguguacuuccaaaauucacauuaaaaucuaauccacaa

SEQ ID NO: 191153 - RNA, 10498 nt, Homo sapiens
uuguggauuagauuuuaaugugaauuuuggaaguacacaaaauguucaaacuauagcauguauauauaucaaguuggcaguauaaacuacuugcaaguaacuuuagaacacaaguguuugcccauugguagugagauggauucuaaguugagauauuagcuagaacauuccaguugguaaguugucauacauauuuaagaaauaugaauccaaacuagauugugauaauucccucauaacuucaccuccaccugaguuucggacucugcuauccagcugcguacuagucuucaucagaugacacaggcaucuccaacaccgcaugacuggaaccugaacucgcuuaucuucuguuuccccuaaauuuguucuuuuuccaaauuuucuaucuuggaguugcccucuuggaauugcccucuaccaucuaucuagacacuuuuaucaggaacccagagaaccaucuuuaccucuuagauauaaucagucuuguaagucuugcccaauuuucuuuccuaaaacuuuaaaaaucuguccucucuccucuacuaauaccacaauguuaguucaggccuucaucuuccucaacaacuaagacauccuccuaacugguugucuugccuguagcuuuuuccucucauggccaucugccacacagcugucacuuaccuguauuacaaacugaugaugucauuccugugcuuaaaacucuguaauaccugguaugucagucuuaauuccuucacaugauuugugagauccuccacaauacgggccuugucuugugcuucauauuucugaucuacugaagugacugugguucucugaugcuacagagugccuuugcuucuuugugcuuuuguucccucugugugcagaaaaaaaucucaccccucaccuccugauuuauuaaguucuccaggaauauuuuccugauguuaaguagguacuuccauucaguauguauauuuuuaucacugggcugaugaucacacuguugaguuacugaaugagaacuuugugcuacccuuacucauuucuguuauggauuaaauaaacauaaaaauagggaauauauacuguuccaacaaacuuuuccucuuuagauggagacuuucaaggacuuaaagaggcauaauuuguuuuaaagucccuuaaggauggacaagaaaacacuuagugguucuuuuguucagccaucacaagaagaaguggagcauuagauaauccagaacagcagccuugcuauccaaucuguuuaucuaacaauaauaguuaaggggagcucugcaggucagcaaagcuaguccaggauuacaaacugccauacaugagcuacaugucaauuaguuggauuauguauaagauagcauuuuaugaaauaaugcucuuaauacaaaaaccccuauauguuacuaaaagauuaaacuuaaaaggaggguauaaaaaacauucacagaaaauauuuauuaugcuacucuuuguacuauguaugggaacaguauguuuguuaaguccaagagaaaagauaauucacugacaugaaacacccaaaugucuucauuuuaaaaguaguuuagagauagcaucagguaggccaaacaacuguacugggccccuguagagauuaggguuuggucuauuaaaaaaaaucuuugcuugcuggaacugcaagcuuggcuucccugcaagcucaauagguucuggagcucauuuaccaugucgcucgcuggaucccagaaaguugcccauggucagcuaagugacggaagacuauacgacuaagccuccagcgccgcuucacaccacgcggacgggacgucauaacacaccgauuucugauucuaacaggacagcuaucccgggggagggcagcaauuucuucaucagccacauccuaagggaaaucacauuauuacacagaucacauuacauuguugcacauguauuuugcuccuucucacuugcagguaauuuucuuuucuuuuuuuuuuuuuuuugagacagagucucgcucugucacccaggcuguggguguuagauugugcaaugucacaaucucagcucacugcaaccuccgccuccuggguucaagugauucuccugccucagccucccgaguagcugagauuacaggugugcacuaccacacucagcuaauuuuuuguauuauuaguagaaacgggguuucaccacguugcccaggcuggucucaaacuccugagcucuggcaauccgcccaucucugccucccaaagugcuaggauuacaggugugagccacagcgccuggccacuggcagguaauguucauugcaugaguaccauaauucauuuauccauccuacauuugauggucaucuuacgauuugggcgaauauaaauagugcagcuacauacucuuguuuaacucauuuguaaaguaugugaauguauuucuguugccgccucauguuuuuugaaucacgaaagugaaaccucuggaaugaugaucaaauaggagggaauguggcuugagauaagacuagagaaggaggaaggagaguaucacauggagcccugaugucuaugguaaagauucugacagcuagagaaguaaaggggagagaucagaugagguuuauauuuaaaaaaaaucauuugcaagguagaggaugaaucagguaagggcaaagugguugaggggagaaaaguagggauuacagcaguagcuagggcucagguuuugucaguagagauuucuucuuauguauguguucaagagugugaguguucauaauauucacuuuaaucugauaagugugcuaacaaguagauggacccugugcuagacugcggugcaagcaaaauaacacauuaaaauaacacaaauuaaaugaaaguauauaaaagccaaaaauuaacaaaagcuuaugcauguguuaccauuaugaacuaacagaauuacauaaaacaacaugauugccaggcacaguggcucacgccuauaaucccagcacuuugggacgccgaggcaggcggaucaucugaggucaagaguucgcgaccagccugaccaacauagggaaaccccaucucuacuaaaaauacaaaauuagcugggugugguggcacaugccuguaaucccaucuggccgggaggcuaaggcagcagaaucgcuugaacccaggaggcagauguggugagcccagauugugccacugcacuccagccugggcaacaagagcaaaaccccaucucaaaaaaaaaaaaacaaaaaaaaaccaugauugagccauugaguaguaaacaauaaaugcuauacaaggaacuggagaggagaaaugacugggcaagaagauugaagccaaguuucauggagguggaccuuaaagaauggcuagaaauuauggauugauugauugauacauaccccuuccuucuuguuccccgaaagauuuaaggcaguuuacaaaugaggaaacuggggcaaagagaaaugagaguaggaaagauaaaagccucaggacacaaaagugcaugcugugaaauuagaacugggacauaaauuugacuuguaagcuacuuggcaggcagcagagaaccaugaucaguuuacaugauucacagacucugcacaguuauugcugcuagucauaccagagacaugucuucuggguaucuucauaaagguacucaaacaacacacccccagcuguauuaauguauaguugacaaauaaaaauugcauauauuuaaggcauacaaugucaugauuugcuaaacauauacauugugaaaugauuaccacaaugaaguuaaugaaugcauccuucaccucacaaaauuaccguuuguguaugugugguaagaacacuucagaucuacucucuuaccaauuucaaguacacaauacaguacuauugacuauaguuacgguguugugcguuagcuccacagaauuuauucaucuuacaacaggaaguauacccuuugaccaguaucuccugauuucccccugcccgccauacccccuaguccuccuagcuccaagcaaccaucauccugcuucccugccucuaugaucaaugucuugagcucaguuucuugggggcccccugcccuuuuuuuuuuguuuugagacacagucuugcucugucaccuaggcuggagcguacuggcgugaucucgguucacuguaaccucugccucccgaguucaagcaauucuccugccucagccucccgaguagcugggauuacagggugugccacuugcacccaucuaaguuuuguauuuuuaguagagaugggguuuggccagguuggucuugaacuccugaccucaggugaucugccugccucggccucccaaagugcugggauuacaggcgugagccacugugccuggccugccacuucuuauuacucccuaaauguaggaaaguagcuuaaugccacuuuaguguaagccauaacccagugguccaaggcucucaguuuucugcucaucuggcuuaauccagacaagacuaaaaagaaaccauaguaauaaauaggauguauaucauucugccaacuucucuaaauguaguuuuuuaaaaaucugaguucucaauaacuugagaggccuugaguuuaauuuauaucucccugaugagccuuuugaacgcagauaugcuacaucaccacuuaggugcaggacuuuaugcuucagaaagccaagcagggugacaaggaaguaagccuuaauggaaaggcacuucagcacacagagggugggcaagggaguucaggaagacaggcucagaauggugcuagguaaggaacaguuuaggccgcguaccaggcacacagacuucaacaucagcaaugccucccaaugccuugccaguuaaaagauugggaugcggcuggacacaguggcucacaccuguaaucccagcacuuugggaggcccagauggguggaucacaagaucaggaguucgagaccagcccagccaacauggugaaacccugucucuacuaaaaauacaaaaauuagccaggcaugguggcaugugccuguaaucccaguuacucaggagacugaggcaggagaauugcuuuaaccugggaggcggagguuguggugagccgagacugagccauugcacuccagccuggggaacagagcgagacuccaucucaaaaaaaaaaaaauugggaugaagucagggagagaccuuaggugaaaauaaccacccaauuuaccaguacuuucuaaggcuggcauaaugaaacaguuguaaggcuaguuaggagugaauagucuuuaauuugaaacucaacaaaaucaguuucaagacuauuuguuuauauugauguggaucuuauucuccagaaauuauauugauaccaagucacaacaaacaguaucaaaagugaucugauguugaguuaaugaucuugugguacaaagggacucaucuuaauuagcuaaccugaagaauuuuuggcaaaaugguauucuuccugagugaauuaauacguagccucucaucugcguauucauaggccauuuuucgucucuucacaucgcgccacauucuccagucuacauagugacuucgaacuuggccugaagcugaugaaggaaccaucugaaagacagagacaagggacaagugaaggauagccaggacaacauucugaguguuccucaacccugcaauucucuuucugccacuauuuaucauuuaguauucuuuuaagaguuguuuuagaucaguuuaauaguuuaagauaauagacuuccuaauuuauucagaauaaauaacuuuuauggauguauauuaagucaaaaucauaauaauauaaugcaauaacauauguauuggaaggugaaagacagauuuucagaaauuuuuauuauucuguuugaccuguacuuaggccaauagucacaugguucaaaaaucaaaaagguauaagaagacacacagugaaaagucuccccccaccucauuccucaccugcccaaugacucccuugccccacagguauccacuguuucuaguuucuuguauauccuucagagauuuuugucuguauacacuccccucccauuuuucguucccucuuuucaguuuacaauauaccuuagagaucuuucaauaacugaauguaaaaagcuuccccauuuucuucauauugcauaaucugcuauauagaagcaucauaauuuaaccugccacguauugcuggacagaucucacuauuuauuauuauaaacaaugcugcagugaauaaugucuuggaaaucauuucauauguauuccuauauaucuugaagauauauuauuauuuauuuauuuuacuuuuuugagauggaaucuagcucugucacccaggguggagugcaguggcgcaaucuuggcucacugcaaccuauaccucccggguucaagcaauucucaugccucagccuccugaguagcucagacuacaggugcccgccaccacaccuggcuguuuuuuuuguuuuguuuuuuguauuuuuaguagagaugggguuucaccauguuggccacgcuggucuugaacuccugaccucaagugauccauccgucuuggccucccaaagugcugagauuauaggcaugagccacugugccugaugaggauagauuauugggagcaaaacugcuaggucaaaggguacuuuaaaacuaucacugaccuaagacuucucagcacuaguuguccaguaauaagacaguauauuccuuguugucucacauuuucacggugauaauuuacaguucugacugacaggacaggcaaagggaguauagaucacaagaaacgauaagucucucucaaaccagaggaaauauuacauguuaauuaagcugccccuauagaaaaaugauggcuucugauaacugauguuuauaaaugaaauauauguauagcagaauauaaaauugaaaauaagaauacuauaaauagaaagccaccauuuuuucaaucuauuaacaaaagauaaacugaacaucuucagugcucacauuacuaaacaaaaguuccuuggggaaauauaacaauucugcaaucaccuuuugaaaaaaagauaagcaggaauagaauuuaaauauugauguggcauaugacugaguccagugaaugccuugguaaccauggauggacaugcuugucacagaaagaggggcuuugaaaucuugacagcaauucaacauugaaaugcugacagaauuuugacuaaaguggggacaggggaggggagaaaagguagucuguccaaacaaaacauggaaaagaacaagauauauucauaagaucaaggagaaaucaaagaaaccguucacauugaggggcaaugugagguuugcuuuuaccugugaaauugaggguacaggagauuuagaaaacaagauuaagcauuucuucuuugaauucuuuuucaaaguauuccuaaucaaauucuccuagaagacuucuauuaguuuuuaaaaauagucuuucacucuauuuugcauaccuuuuuuucuuacuagaaaaguaauauccauuuuuucccccuuuuuuugagacggaguuuugcucuuguugcccaggcuggagugcaaugacgcgaucguggcucaccgcaaccuuugccucccagguucaagcgauucuccugccucagccucccgaguagcugggauuacaggcaugugccacaacacccggcuaauuuuguuauuuuuaguagagaugugguuucuccauguuggucaggcuggucuugaaaucccaaaguaauacacuuuuaaaauaaaauauuuauuggccuauuauauuauuucuucugugaacauuuuuaugugcuuugucugcauuucuacugugguguauuuccuuaccagcuuauaauggugcuuuauagauuaaggccacacucuauucugcucuguacacaucuuauccugcccccaucucucaccccucuucagcuccuaaaaccuuuccacugggcccucucaauccauggucuaucaucaaaaucuuuuaaauucucaauuucucuugacaucuccuucaccuuuugcucuggccgaauuuuaaaucccuccucacagcuuuuccuguagcuccuuuuucuuccauaacugggccuagaggugggauagguaagugucuuccuugcucuucauugcagcuucgaguucuccuuccuuccugaaagcuccuggcuuugacucaugccauugggcuuacuaccuuccacucccucucauuguugcagucaucuaccaaagccccugccacucccuuucauuuuuccacgauuuuggauccuggcuuauugucacucucuccaauauuguuccuaucuuaauuccugguuauuucaauauacaugaaauuacacccugaucacucugauuucuuaacaccucuccuucaaugacuuuuguccuccacucuuguuuaacuauucaauuccaugcccauguuguggguauuuuauuauuaauaagugcaagcuauuaucucacuuuguauaucucaacucauuaucacuucuuucuagcuugcuccuucuaacaccccaauaacaauccuucugggacuuucaauccauugauccuaccauuuuucacuuuuuucacucagcuuuugauuuacugucuuccucucucaccuagccugaauuccauuguucuauaaauacaacguucucuugaauacaccaucaacucucuggccccucucucacuucucuguacuuacuccaauucuccugaccauuccuucuguccauuuccaacucucuuacagggucuuucuccccuuaaaucucugacacuugcucccacauccucacacucagcugaugacuucacuuucuccuuaauuauaaaauuagaagaaaucaaaagagcauuucuauaaaugcucaccaacauaguggcucacuuacuagcaucuguaucauauguucuacauucccuccuguuaucagagauccacucuguccaacagaguaaccacuaaccacauagggguauuaaacauuuguaauauaacuagugcaacuggggaauguaauucuuuauuuuaauuaaaauucaaaaccaaagcauuguaaacauuaaacaacuuuauuauuuugguagaacuauauuucccauuuuaaugaugggaaauuuagcacccaaacugagauaugcuuuaaguguuugaaaaucuaguaugaaaaaaaagaauguaacuauuucauaagucauuguuauauugauucuauguuaaaaccacaguauuuuggauauaccugguuaaauaaaauauuauauuaaacuuaauuucaucuauuucuuauuuuuuaaauguggcuacuagaaaaauuuuaaauuacacaugugguucacauuauauuucuaugaacaacacugcuacagauuaacuguccagguuccuaagaccaaacuucaugcacaagaccccauagccucucucucuuuuuuuuuuuuuuuuuuaaauguuuuugguuuuuuuagggcuagucaagugaaaaagugggaguggagaaggaacaaauaaaucuguaacugguugugaucaauuaguuguaaacaccacugcacucgaaccagccuccauugccucuugccuacauaaagguacagcucuagcaauucuucccucuucuacaucaucaauuuuuacuacaggaucuuucccuuucauacacaaacaugcuguuuucccugccauguuaaaagaaaacaaccccccuccccgcccccguuauugacccauuuuuuuugcucuccuuuacagcaaagcuccuuuaaaggcuuaucuauacuccacuuuauuuccuccuauucucuugaacgcuuucguccccauaacaccaucagaacagcugugauuaaggucccaacaaccuucacacugcuaaacucuucaauucucagcacuucuuuuuaauugauuuaucaacuuugagcagaguugcccacuccucacacuuugaaauucugucauccuuugcuucccggccaucccacucuccuaguuuuccaucucccuagcugacaacuccuuucagucucccuugcacgguucucaucucuuaacguuacaagucucugagagcucaauccucggaacucgucuccuaucugcuuacucccuuacaaaucggagucaaucucacaucuuccaauaccaguuagucauaugcuuacgaaaaccaaauugacaucugcagcucggaccuccccugaaccaagcccaagcgcggaagagggcggaaggagaaccccuggacugguccucaccgagcacuacagguggcagagccgugggggacccguggguuaugagauucagcggugagggguagcgguguggauaaaaguagaggccugaccugcuugaacguccgcagcagcgagcccagcaugaaggccgccauguuguccgcuacaaacuacaaaccgcugaaacuuuauugacacugcc

SEQ ID NO: 191154 - RNA, 30541 nt, Homo sapiens
aaguaucuuuguuccauugaauguuugcggucacagagagaacuuagaguuauaugacacucaaaggaaaagcaaaagagcauuaagaagugucuguuuuuguuauugccauuucauaaauauuuuaguagguguucaauuucauuggauauucuuuuuuuuuaauugucuuuguaccuaugauugaaaacaguaguuggucuaugacuuuugaggagguaaguuuuuuuuuuaaucuauguaugucuguaacaucagugucugucucuuugaaaaaugcaguauccuccucccaaaaguuacuaaccaaacuuucccagcuguacaucuccuauccauaaggggugaaacuaugaggacaguuguuaucugcuuuuuguucaaacggugucaguugugugagauggggaguauauguuucagacagugugaugugaguuuuaagaguuauguaagcagugucuccuguaaucuuuucugaaaggcaagagggagccaguuugccuguuuuguuuacaggcuuugagcauuuagcacaucugcuugugcaaacuuacagcaugugaauuucucugggcugacugagguuauuggggcugacuuuaagucugucuuccaugggcaacccuugucaacauuucaaaaugaaccaagcaggguuacugccuuuuccaagaccaucaaaaccaaacucucuucuccauucuaguauacaggcaaacuuuuucuagaauuggucaguauugaaaacaguuuuggcuccuugagaagaacuguaaaagacagccacguuaauauaagcucuguuuagcccucaguagguaagugugggcaaguucuuuguagaaaaucuccaucucaguagcagggucucacuguagugcucaguagcacucacccuggguucauacuuuggaggaugauacugcauuuuuggccccguagcuugcuuucccacuugucugugagugcagagcaggagucugacacuucccacugugcugcuugcuuugcagacacuaaauugaagcuucuugcuaaagcaaaagccaguaggcgugcccucuaggcuauuuugcuuugcagggacucugagacacucaguuucucccaaaucuuuucccacccuugcccuugccccuuuagcugugugucuguaaggaaggguuucaguugcaacagucauuguaaugagaaguuacuagucagaauuucagcugaacucacaccucuuucuuauauaacagauaauccaucagacauuuaucucuaaucaacagugaaguagcuaccugguaugauuucuaaauacuugaacaaaguacuuuuccaugaacauccuaugacuuuacuuggagguuacuuuaacucaauucuaagcauguaauuguaaccugaaaaacugguaguggcaacauuuucacuugugccaaaugaauguaauguacauaauagucgagggagcuuuuuguacuuugggguuauacaaguacaauuucaauagcaauaggauacuuaacucaggaauaccuauugaaguagucuuaucuuaguuucuugaagauauuuaucaagaaaugagaaaaaucucuucccuggcuaagcagccugcauugugaaauaugucauguugaaauugugcugguauuguuacucuuuccuggcugggaggaaauuuauugaaaaagcuucucaaaucuuuuuuuuuaaucuaaguuuccuauauguuuuuuuuccaugaaaaggaguaauagauauaucagaaauaaaggcuaacucuccagccccugcuagaaauuguguugcuuaggcaaagauucaaagauuucauuguagaagcucuggcuuuuuagaaauuuguuuuuuagucuccacauuuauuaugcuucugugggaggguguaacuucuguagauugaggggaacagacagaaucugaugaguacaaguugccucuacaagagcauucacagucuucucaggaacaucuagggaaagaguuccucacaaggcaccacuucugagggguuacauuauaucuuggucaaaaaggaggauccaauaugguuuuguguagaauaugaccuucuaacagaaguggacuuaaauuuuuuuuucucauuuuggcaucuuaucccuuccaauggaauuaaaauucugaauuccuuuuuuucuuaauaaaacuauuuuuuaaauccuauuacaaauauauauucauuguagaaaacuugaaaacauuuuuaaaagaacaaggacaacaauaaagaaaauucacuaccuacaguuaauauugguuguuuauauuguuacaaugagauucuccaauuauuuauugggguuuuuuuccccccuacaaggaaggcagcguaagcauuuccuguuauuauauuuucuuucuuucuuuuuuuuuuuuuugacacagguucucacucugucacccaggcuagagugcaguggcaugaucauaguucacugcagccuugacuuccuggguucaagugauucuccaaccucagccuccccaguagcugggaucaugugugcacaccacaccacccagcuaauuuuuuuuuuuuuuuuuuuuugagauggagucucacuaacucugucaccuaggcugaagugcaguggugcaauucuggcucacugcaagcucugccuuucagguucaagcaauucuccugccucagccucccgaguagcugagauuacagguguguaucaccacacccaucuaauuuuuguguuuuguuuuaguggagaugagguuucaccauguuggccaggcuggucuugaacugaccucaagugguccacccaccucagccacccaaagugcugggauuacagacaugagccacugugcccagcuguacccagcuaauuuuuaaaaauuuuuuuguagagaugggguauugccauguugcugaggcuggucuugaauuccugggcucaagcaauccuccggucucaggcucccaaaguauugagauuacagucaugagccacugcacccagccuucuccaguauuuuaacacugaguagaauucuauugugaauuuauuuaaaguauuaaagugauuugggauuguuuuuaucuuuuuuagucgauauguuuuucaauaauguuuuaacauucuccaacuauucuuauuuuuuuccaaaaaaaaaaaaaaagacagaaaugggcccugguggcugguauaaucaaggugcgguuuuguccuuuaacuucucugacagccuucccuguuuauggauccucugccucugugaaagccucagacuuugcccuuaccauguguuucuuagcccuuguuuuaaaaaacaggaaaaagaaagaaauugucuucucuuucaauauaacaaacaccagguuguuauauagaagauacaauuaacuucacauuaccugguaugcuaugauaaacuaucuuccaaaacauauauuugucuucuaguuuuuugucacugcuuugucugaguuuuugccaccuuugcagaaaacacuguuagacguguaaaucugaaaaacaggaaggucucaugacauuagucuuuccugucagcucucuuuugaaucuccuauaacuguuaacaguagcaaagaaagcaauuuugauacuuuggaauggaagacaugaaauagcuauucugaaaauaguugugaacauaccaaguucauaguguuuaguuaaggaaaggccuugcuucauaagaauuagugacuugguuuuuuuuuuuucuuucuuuuuguuuguuuguuuguuucguuuuuuuguuuguuuuuuuaucauguaacuuuguuucagauuuuucaagguugggagcagaaauccucaguaauuuauuuuacccagaauguuuuaaucugaaauuuuuuaaaaaacaaaaaaacuagauaucuuaugacuguugcucucacacaaaaauagguguucagaaaaguaaauauauucuuacucaaagaauaaaaaugucagcuguuagcaaagucaugaacccaugugucaugauucuugauuuagagcucuuaaauauacucaauaugaacccugucuuagaaaaacaauuugaagaaaugucuggugguuuuccccuguuucauuccuacugugucuugugguuucucuugaggucaagggugagacuaccgugcauguuucaaauaaagaauuguuugugucuguguucuagaucuauguaaaaaccucacaggauugggggggauaugcucagaaaguuuguucuuuguggcacauuuuuuauaaugaaguuccaucuugagaguuuaagggaccaguuucaccggguagagaaccgcaucugcauugcuagcuaaacucacuguuguuucccagacagcaauccugccuuccugugccacuugcgccuucuccuuuuuacaccuuugaaaguucacuuuguugcuuguuuuuccucaccaguucuguucguuucuguauguccagacacuaaugcccaccucuggcuauuguucuucugcagagggagaaccgaagauuacaggaggccagcaugagguuggaacaagagaaugaugaccuugcccaugaacuaguaacaagcaaaauugcucuacggaaugacuuggaucagguaauccuuagaaaugagacugugaugacuuccucagggcaaagaccgauuugcccucaucaccgcccccacaaacuugcuuuguucuugacuuuguucuugaggaauggacaaguggcagggacagucuguuaauuggagaccauggaaaacauaagccuuugagaaagguuugggucauuucuaaauagcaugugugacauacuuucuuuauaccucuaaacucuguuaugucuuuguugauaccuuuccugaaccaauggcugucagcauaauuaucugagaacaucagucaccaagaauaugccuguacuaaugccacucuaacaguagaugccuuacuuuuuguuccaguaagaauuauucuccauaauaaaugugaacuuuuacaugaaguaccuacauuaagaguuggauuguuagauugauaggcaucugaguggcugagagccagacugccugauugugaaugcuggcaccaccacugugaaccauaugacccuggacaguucuuaagcugucuauagguauaaaaaggugucuaucucauagagaugauauaacaauuaaauaaguaaaacacuucgauaguauguguucauuaaauguuagauguagcugagagagcuggcacuaaagggaauucaaaaacaaaaacaaaaacuguguuguuugggacacaggauauggaagguagaaaaagcugcccagagaaugguuuuuuaaaaaguuguggcccuguuaaccacaaaccucauucagcccacccauuuggaagcugugagaagugguaugagaaauaugugacuaggagagucagaaccaaagaagguagccggaucuccauucaaucagggucaauucagccuuaccucaguggucauauuuuuguauucaugagacuguugagauaagucagugcuauaaugaaagucuugguucuauguuaacuuuccaaauggucuugauucacacuugauucugccauuuugaaucuuuuauccauuaauaauuuucuuaugauggcugacuaaaugaaacaauuuuuaaacaguuggauucaguggggaugcagugaaaugagcuaaggagaguuucaaaguuguuuggcaaauguaguugguaauauguguuaagacguuaaaagguuuaagcaauaauaaaauuaaauuuuacuauguacccacuaugugccaagcacuaaauaaagcaauuuauaaacaucaucucauuuaaucucccuaaugacuccaggaagcaguuauuauuuuaauccuccauuucaugaaugaggaaacuauauagaugaggaaacuagagauccucugacuuguaaagcuauccuaaaaaaaaaagaucuguuuaaaaaaaauguauauacaagguuguuuacugcaguguuacuuauaagaaugaaaaauagaaauauuauuuuaucuauguucacuaguaggggagaaugacaguuugacuguaaaaugucuuucuggaauaauuuuuguuaaugggaaaauaaugauaaaguauuuuuuuaaaaaauacuuuuuuuuuucuguaaacaguaaacauuuauaauguuugcaucuaaauuucaagggcuacuggcuggcauugggucauccuauagggaaggggaccauaguauaccuagauagggaagaagcccacaaggaaauacaucaaaauguuacugcuagguaucucugggugauaagauuaaauauaauuuuuauauucaucuuuauaguuuuuucccauuuagaauuuauagaaagacccuaaauuacuuaaccaccauagguuaacuaaaaaugagcauuggaacuuuuaaaaaucagaaaaauaaugaacauuauaauaugcauauuauauaugaauauaauacuaaauaauauauauaacuuuaauaaucagaaaaaaauuauuaucuuaaaaaucauuucuucaccaagagaacccuuuaugugagucagucuggagugacugccauuauagguauuccugaaguaauugauuauugaguaccaggguagcucaugaugugagugcuagaacagccccugaagaaaagguuccaucagaccuucauucuuccucugccuucucucuucccuccuugacucucuuucccucucuuuuaagaaaaguaaauaugaccuggacccucccuuugggagcuuuuuaucuagaugaaagaaucuagaugaaagaauaaaaacugcuguuucaugcauauuuccuccuaacuucugauuuugcaguuuccuccucauugggguuuauuugcuuaccaaaaagcugucccugcaguugaagugaccugccccaccagucuucuaggaagggcccuagccugagagugaaaaguacuggcuuugcaggccuucaccuaguuugcccaguacuuucccauucccaguucaugaaaaucagaucucuuaauuaaaauagcaaaacacuggcaaacuuuaaacaaauauaaaaguagauuguauuuaagacaauauguaagcaaacaaacacuaauuaggaaauuagguucuuugcaaaaauaaaucauuucuuacucugaccauuuuagugcuaauuucaggcuuccugggcaccaaaggcucuucagcuuuucccucuggcagagccuuccucucuugagaacucgcccucucucggauuccuuaaauaaagauuucucagugauuagaagugaaaaaaaggugcaacaucuccauuucaguuucuguuugcuaucugcuuucaggccuuuccuguccuucccuauuugcaaggaacaaaagagaagagacaugauuaguacuguccugcugaggaccaggggucuagguucccucucaccauagcaaguucuguuagaccagaagcuacauggacuaaguggaaaauuauuuuguuuuauuuuaaguugaacaacuggccugguuaguucuuucagaaaucauuuaucagagauccucauuucugauauuagggcugagucuuuucugagguuauugguugauucaugauuaaaucacacauugcaaugcuuguuucucucauacauauauagcagaagccuuagauugcaauuagaacuuucaguaucaaugagacauuauaagauauuguuaaguauuuagacuugauaaugacaguguuucaaucuuaucaaauuauggugaaggcugucuggugcaguggcucacgccuguaauccuagcacuuugggaggccgaggcagguggauugccugagcuuaggaguucgagaccagccuggggaacacggugaaaccgagucucuauuaaaaauacaaaaaauuagccagguguggcggcaugcgcccguaaucccagcuacuagggaggcugagacaggagaaucucuugaaccugggagguggagguugcagugagccaagaucgcaccauuguacuccagccugggugacagagcgagacucugucucaaaaaaaaaaaaaaaaaaaaaaaaauuauggugaaggcuuuauaauuugggcucaaagguagaauuugaaaggcuuuauaauuugggcucaaagguagaauuuguguuuagcauuucauucauuaacauuaaaauuaauuccuacuuaagugagguauagugguuggcuguacaaaaauucaaaagaccacuguuagagggauacucaaguuauuucagaucuggcccuacuuugaugaacagaacaauugcuccuacuuuucuguuuaacauaagaggagaaacugugaauuaagcuuccuggaaaacuggacucuucccuauaggacccacaacaauugcugcagauguuguauaugguaacaguagaaauaagugaaguugccuuaaucuugaccuaaugaagacuguucagcagaaaaugugcaaauaaaaauaauaggucuucuuagcauaaacauuuagguguuuuugaaaaaaauuccucggggaaguguuuuucccccuuuucuuuucuuuuucuuucauuucuuuuuuuuuuuuuuuucuuugagacagucuagcccuguaguccaggcuggagugcaauagugcgaucuuggcucacugcaaccucuaucuccugguuucgagcaauucuccugccucugucuccugaguagcuggaauuacaggugcccaaaaccaugccuggcugauuuuuguauuuuuaauagagacgggguuucaccauguuggccaggcugaucccgaacuccuggcuucaggugacccacccaccucagccucccaaagugcugggauuacaggcgugagccaccgcgccuggccagcauuuacuuuaaaacauuuucauaaaauguuaaaauuuuagauggcucuccaagagaccaaacugaaaaaaaaacauuuauuucaguaucaugaugaacauuaugaaaggaucagucuguucacaaaguggaaauugcuguggguccuguaagaggaaggcuuaguugcagucuucuuuauuagcagggcucaaacauucugggguagaacuugaaccagugggcugcaguuacagggagagaguugguucaguuuuuaagaacacugaaaugagcaguacaauuguuuuuuguuuuuuuuuuuuuuuuuuuuuuuuuuugagacggagucucgcucugucgcccaggcuggaaugcaguggcaagaucucggcucacugcaagcuccgccuccugguuucacgccauucuccugccucagccuccugaguagcugggacuacaggcaccugccaccaugcccggcuaauuuuuuuuguauuuuuaguagagacaggguuucaccguguuagccaggauggccucgaucuccugaccucgugaucagccugccucggccucccagggugcugggauuacagaugugagccaccgcacccggcuguacagcugcucucaaagugccacucugugccuaucugucagagacuuuggggagggucucccugcuuugugaguaaccucagucagucaucuggcuuggggcucuagaauggaagcuuugugcuuccaugguuuauuuauuuuucucuuuuuguuuucuuuuaaaaugccguacuuuaugccacauccuuucaugauguacaucaggugacuuacaacuuaugaaaacuugacuugcaguguucauauugcauucucaaggucuaccucucauuuuaguuguuaauuugcuguuagauuuuccccccuaaaaucuaaugcaucagagcaauuuuuagagucuuaaagacuuuuaagggacuuuuucgccuuaacuacccaacgguuucaaaugaucugcaaacaaagcucuaaccacugggcuaugagccaucaggagccagaagacagggcaagcagagcagcuggaaugcaguuucucuacagucaccagcagacugugcuggccuggccaucuggacaugcaggagauauggcagaaaacagacagaaggccgcuuggccaguccucagcagacugggcuggccuggcccaucuggacaugugggagauauggcagaagacggacagaaggccaccuggccaguuuucaccauuauuuggauaacauuuugcugcugucagccagggauagcuucuucacauaaucaccucuccucugugucuggguucucucugcugaacucauccuguggccuucugccaucuccacugcaugcagucugcaucugcaaugauuuagccacaccucuucauucaccaaguacuuagggagcaccuauucuguacuuggcauugggcuuggugcuugggauagagugaugagcaaaagagauauaguucuugucuccuggagcuuaaagccuagugggcaagacaaauaaaucccauguguaaguugucauuacaguccuauuaagggaaauaugagagauuuagauaggggagcuaacuuagaugagggugagugggccagggcugagggcaugcuucauugccaugugaacuugaagccgaggccuaaaaggugagagccugacguguuaaauagacaucaucauucuagaaauaugaucuuuucuuccuggguuccugguccauauuuccauuuucuucauggcucucucuaucauggguuuuuggucuugauuucuccuuacuagacucacugcccugugugaguggccaugugggcagguuuaccucagcuagucuuugaauuugccaccuaacuguuguccucagaccacccugucugcuccccucucugagucaacccccauucuccaccaguuggaaguuucugugugaggcucuaccccuucaucagauccaucuacacagagugagugcugcuguaacaucuaaaaaucuguaagaagcauuuagaaggaggauggacuuugauguuauucaaaucugaauucagaucaugacucuauuagaugugugaccccagacaguuuguuggaucuuuccaaaccucacugucauaaucuguaaaauuauuguugguguguggauuagaaauaaugugugccaacuagauggcacauaguuggcauucagugaaagcagccaucgcuugguugagcuaggagggaaaauaaugacuugcaauaauuuuggaacagcaacugaagauuggguuuggagaagauuuccacacacuuucuuuacccucuguaugacugugauguaugacugugaugcaccaugauuugcaggcagaagacaaggcagauguguugaauaaagagcuccuuuugaccaaacagaggcugguggagacugaagaggagaagaggaagcaagaggaagagacugcccagguaaaaggaauaauauguaggcuuuucuuuacaaagguauguugguagggaauuaacacuauaaaaaagaaggaaaauuaaauuucuucuaaaucaaaggugauguuaaagcaguaauguaaguaguugaguguacuuacucaacauuuuuguucaacauuucugacauuuuuuuuuugaaggguguuaaaagaggaggcaguauuucuacccuugaacagcuuuuaggaauuugccuuuacugagauauuuagcaagaguguugaguuuucucuaaguuuaguaacuuggaauuaugauccaagagcuuugacaaaucugcaaauuuuguguuguaucuccaagauaauugacuucucugaaguaguuuaugagcauuguuaaaccgaaagccuacagagaucucugcugggaguugccacacagccccugccgcaaucagucacacuucauuuuccugauucacaccuuaagcagcaucaguauuccuggcuaagcuuucaaaccuauuuccugggggaauauaaagaaacauuuugggaaccagccuugaaguuagcacccuacacucuucaugggagcuguaaggcuaauuagccagaaaaugccaccagugcaaagcaguauaggauaggggcagagaggccuaugggcccaaggaauuggagcuuuccgcuuccccaaggaagaacaugcugcuucaucaguguuuucuaccccugucagucccagccaggggccugacacagauuagauuaugagucagaguuucaucacaaacaauugaagucuucugccaagaguguguuugaauuuuacuaauguagcuaacuuauaaagugaggaagcaucucaaaucgugauuagcuuauuuuaaugaguuucauucugagacaucaguaauacuaaacuuaaagcacagcauaaagcauuucaaggaucuacauccaagcaaccagaaaaaaaguuccacuaaaguuacauguggaggaaugugucauuuagcaccuuccagacuuuauaaaaaguguuccaugguuucuuuuuccuuggaaucugauuuaaugagucuuuggcauuuacagcggcccaggauauauauuucuuaccuacucaaaaauuuucaggggcugauuacccaguuuuagauuauuuaggcuccuuaauggguuuuguuuuuucuuuacuuccugccaucuuugggccacuuaagcuacucuagaugaggcauaaggcucuuggcaaguaaauuuaacccagguucuaccugcuccgugguuccauagacauauauacuagccuguaagcaauugauaccuaaaaugggaaggaauaugacacuugaauacucaccuaguauguugcaagaacaaugcaagaugcuuugcacccuuccuccccuccaugugcaucuguguguguguaacuguuuuaaucauuaugguacccuuguaaaauagggauuauucucauuuucagaugaggaaacuauggcuuagauaaauuuagugacccuugcucaaagacucucagccagccaagucuguccuaacaucuauggggccuuaucguggaaggcgagaagguuauuguuuauguccuuaaauuaugucagauagagaauaaagaucaauauaaacaacugaguguagaucacuauaacuuaccaauugcuuuuagaauuuuagaaucuaacagauaugaagaaauucagaaaucuaaugagugcuauuauaaauugcaauaauuuaugaacuagcaauuacagaguauacgccauuaauaauuugggaugcuuuagugcagaacgcaucucuuuauucugauuauguacuuaaaguuuaagcagaguuguuuuuuguuuguuucauuacuuguuuguucaacaacuugcagaauuuaauucuuuccuuuguaucugguagcaccugagcuuuuccaucaccuuaauuuuccccuauaccuagaauucuagagcugcugggccacaaaaauaacugugguuauaacuauagcauucauaauuuaacauuucagugacuguaacagguaccugccauuaugugucacuuuagcuccuucuaaagucaguuucuuuagucccugaaucuccuguccuucucaaaacucuuaucuucccccgucuuuucuaacucuaguccccaaagccucuuguuucugccuccagagagguaacagcaguaaagguagacuauaaauaaggaggccuacaaugauuuuuuucaguaauuuauaacaucaagaguaacaaauuuagcaugcaguauugccuugauguuuuguuuuagacucuuauaaggauaaagauagcuucugaauggauacuuauuuagcaauauguuuagaaguagcaagcauaagcaauuuuauaaugguguuguucauaugucucauauuuuacagaaaagaaaguaagguuucugcaucucuggagaugauugacuuuuucagauuaucaagaugcagcuuccaugaagauaauuuauauaguuaacauuguuaccauuguuacugacuaugaaucagacagacuugaauauagauguuugugaaaauuuaagauuuuggcuaaauccugauauuucucauucuauucuuucuagcuaaaagaagucuucaggaaacagcuagagaaggcagaauaugaaauaaagaagacuacagcuaucauugcugaguauaaacagguaauguacuucuguggcacauagagcuaguuauaguuugcugcuauaaaaguaauuuuuuuuuuuuugcuugaggccaggaguuugagacuagccugagcaacauagcaggaccccauaucuacaaggaaaaaaaauuuuuuaguuagccaggcacaguggcaugugccgguagucccagcuacccgggaggcugaggcaggaggaucaguuguacccaggaguuugaggcugcagugaacuaugauugcaccacuguacuccagccugggcaacagagcaagacccugucucuaaaaaaauaaaaauaaaaaaguaauuauuuuguuguuguuuuucuuugggggaagaaauauuuuuguuuuuaaaguuuccagaauaguuuuccagauuuauuaaauuuggugacucacugucuccuuugaagcagacacugguuggacauacuuauaacuuauuacuuauagcuuauuacuuauaacugauaacuugggaggucuaacugaccaaaacaaucuauugguuguuuacaguguuggguagauuuagaggaauagaaaaaccuuuugaugacuacugagauccuguuucugccuuagucagaagcuaauuuccaguagaucacacuuggaacauuugccucuuugugaaguuuaguuauuguauuaaauggcaguagcuaggggaucagugugcccuuugcuaccaugguacagaaugugguaggcacucuuuuuccuacauggcuauguggccuuccccucugcaggccaaugcuagcaggaagcuuucuauugugaaccuuaaaaugcuuuuaacaaagggcucaucuucuugaggauguuucuggccccaucaccauaguggucucagaaagcccucuuuccugguaucuacugguaucuuccuguccuuccuguuggcuggacauggcaaggacuccucucauugcugagacccugaguuaucuguucaaauuccagguuucuagaauuaauuaaaguaccauaugccaucuuuugaucuaaagauuucccuggggucuucuacuucacauaggacucugaagucugauacuuacuuuuuaaaaaaauguguuuuuuugcuuauaaauuaaauuuguguucuuguggaaaauuagaauagugcagagaagcacaaagaaaacaaaucucccucagucuuucuagcuaaucauuguaauauauugaauaugcauuguugcuauacaaaugcuuuauaaauaaauuuaaaauauauauaaacaggaugaauuguauuguuuauccuuuuuuuuuguaacuagcuuuaguucacuaauacauuaugaacaucuuuccauaaggaauccgcauauucacggacgauugauaaauaaaacuuuagagcuauuuuacucuucuaugauaaucaacauauguuuauuuaaugccugcucucugugaggcuuaauacuuugacagacaaaaagaugaaugaauucaaguuuucuucucuagaagcuuaucauauaauguggagguaauaccuacguagaaauaagaggaaaggaaacuuauuacaugugggaaaugaaaccuuuugagcugugcuucaaaggcgauguaagacuuggaucuguagagauaaagaagauaaagaagaggauggaaaugguagaaaagagagaacaggaugugcaaaggcauggaaguagauuagugaagagaaaaauaauucauuugguaagagauuccgguacaaaagagaagcaaagggacguuaggguccagaucaaggaaagucuucagggcuaggcuugggaccuuggauuuuauuuuguuugugguaggaucuuuuugagcaggaaaguggcauaaucaaagacauauuauuggcacuaaucugucccaguaagaaauguggaaccaaggagacagaccgcgaauaccagaguccaacuguaagaagaaccaggucccugaacuaaauaacuaacgaaaauagagaaaagggagacacaaaagacaguuuuuuuuguuuuuuuuuuuugcuagaugagaaaaccuugaaggugaucugagaugccgaaugugggcaucuaggagaagaggugguagacauuaaccaauacaaggaacauuaaagacuaugugcuguggaauuucccauugcuacaaaugcauguuuuucauugccagauuaugccauggguggccaccaaaugcagcacucuucaaauaguaauccuggggacuauucuugaauauuaucuggcaagcccuugaaauaaugcaaaaggcaacagacccaucuguuugaagauaaggauauaagacacaaucuaaaugcauucuauaguuggaauuggcuauuacuggcucuaugcauaauguuuuggcuuauuuaaaaggguuuaagguuugcagaaucuaccauggugaucucuucuuuuuaacaucagucaauaccguccuacuaaugguuccucaggcuuggaucuggagaaauuggaaugaaacucaacaaacuaaacucagcaagcaagcccucaucaccagagcuauuuuugaguagacugggugggauuuuuuaaaugucuguuuugauaauagagguagaccauauauguuuuuauccaaaauuauacuuuaaaauuucacauccccuguuuuuccaucuuuuuuuuuuuuuuuuuuuuuuuuuuuuuuugugaggcaaggucuugcucugucacccaggcuggaaugcaguggucugaacacagcucacugcagccuugaccuccugggcucaagcgauccucccaccuuucauccacuuuucuaaaauaaaagauucuuauuucagacaauggauuugaacauccaauacuuauuuaucuagauuuuuuccuuugaaagcaccuauuucuaccauuucuaauacuuguuagcaccuuauuucagaaucaauaagaagaauauauuuuauuuaauguacacuuacuauuggccaagugcuaugcuaaccccuuugcauacuuuuuuuuccacuugauugcuauagcacagcacuuuucaaucaugaggaaacugagucuuagaaagauuaaugacuuugcccaagcucacaaagcuauaaagaaauggagcuggccugccuuaaacucacauuuaacuccagcagcuaaguuuuuaauuucuaugcuauguugccaaaccuacuuaauaagaguuuuagucuguauuauuuucuggucauuuuaacuuuguuuuauccacucugccaccuuuuuuuaauaccuuaaauucugggguacacaugcagaacaugcaguuuuguuacauagguauacacgugccguggugguuugcugaacccaucaacccgucaccuacauuagguauuucuccuaauguuaugccuccccuaguccccuaccccuccaccaggccgcggugugugauguuccccucccuaugaccauguguucucauuguucaauucccacuuaugagugagaacaucacucugccacuucuuaaggaaacuuuugugauugaaaacagguucuuucugugacaguagaaaggagauauuucugucuagaauucuuuucaucaagauuuucucagcauacuaacuuguacaaagugaauacucagcaaagauucuauagguuaauuccaaaagugaggccaggaauucacuugaaccagucacagaaggcuagugacagaaagaaaccaaaucuacucuccguauguuucuacuaauuaagguagagugugcuuuacauauggaacgcuccagcuuucugcugcucauuuccgaaaugacuggcauuugcagugcuauucauuuguaaaauuccuucuaggaucagaugugcuagcauaacacaugaauugauaaguaguuauguguacaugcugcaagaguuguucuguuuucuaguaaaagacucuuuucucauccuuagaucuguucgcaguugaguaccaggcuggagaaacagcaagcagccagcaaggaggagcuggaagugguaaagguaaggagugaaaucgugcugugauaaaauuuauuucaaagucacacaggcuuguaaguaccugaaagaaccccaaacaccaccauuuuguauuaaaggauuuauuaauaggaauuauggagacuaggauaccucucuucugaccaggugugauugucuucccuaccaggugaaagguuaugaugcucccauaaaucauauggacugucagaggcagcuaacaugaaaggaaguaggauuugacauugucacaagaagccccagagcuugagaugagagugguaugaaccugagaacccucagcagcccacaucugacugagccugcauugauguggcuucaguaugggacucaguaggaucaucccaucacucucuuuauaaguaaacaccaugggcaauauagaacuuagcuggaaaaacauguguuggguaacugauucuugcacuaaguuuuuagagguuuauuuuuaaagaaaaccuguggcauuuguuuacuugcugcccccuggugguaaaaugcauuauguugaugcucuauuugaaaaaaacagauugcuuauuccauagaaacaacaguaaaccaauggauugguauucuuaagaggcaauauugucauagucaacuuuugggaccaguguuacagaaaccugacaucaucuuauuugaauauguucagguuucauacuaguaaauaaauguguaguaaguaauuuagcaaucuugaaaagugauuuaaccuuuuuaagcuucauuuuguguucuauaaaauggagauaacauuaccugccucaaaaaaucauucugaauguuaaauaagauaaugaauauaaaguacauaguguauauaaagugcuuauauuaguaccugacauacaagaccuuguauuccaaaaguauuuucuucuuacucauguuacaaaaugucaaugagagauuuagugaguauaagguuugguguucucccucucugaugugcuaaaauuugauguuuguaucuucccuuucuggucuacuuuugcacuucuuucuaguuagcacuuaccacucuuuguacauuauaggcauacugaccaagauucaguugaugaaguugaauggcauaaagggguuaacucuccugaagugaauuuuuuuuguauuucuucuaacaaaaaaaaaaaaaaaaaaaaagggauacaugugcagaaggugcagguuuguuacauagguauacgugugccauggugguuugcugugccuguuaacccauccucuaaguucccuccccucaguccccacccccaacaacaggcccuggugaguguuguuccccucuucuguguccauguguucucagugcuaaacugaaaucuuuauggaaauaacaaaaugagaauuuauauugauuauucagcaaagguuuuauugagcauauacuaugugcauagcuauuagacugccauuuuguuauagaaauuacacaugaaaaggagcuuaaaauuuuccuguaggacaaguuauguauacaugcaaauuaagaacuucggaagcaguucaagggagcuaaguugggccaggugugguggcucacgccuguaaucccaacacuuugggaggcugaggugggcagaucaccugaggucaggcguucaagaccagccuggccaucauggugaaacccugucucugcuaaaaauaacaaaaauuagccaggcauaguggcucacaccuguaaucucagcuacucuggaggcugaggcacaagaaucacuugaacccaggaggcagagguugcagugagccgacauugugccacuguacuccagccugagcagcagagugagauuccaucucaaaaaaacaaaaaacaaacaaaaaaagugcuaaguuggaucacaaugacaaucagcauuguagagaaaacaaaaucaugagaacuauagaccaaaaaaggcuuuauggagauuggacuaaagcaggguggauagaaauuaguuagagagaaguguuuaaacagaacauuauagaagaaaugaugugagugaagacgcaaacacaggaaugaguauuucagugucucauuacagagacugaugugauuagaauauguauuaaggaacagaggaaaauauuggcuaaguaggugagacuaccuaaugaaaggccaugacauucaggaagaggaauguaaacuugucuuagccagaauaaagaagaacaacuaggcucacgccugucauuccaacacuuuggggaggcugaggugggcggaucacuugaguccaggaguucaacuuggugaaacuccuggacugggaaacuuggugaaacccugucucuacaaaaaauacaaaaauuagccggaugugguggcaugcaccuguagucccagcuccucaggaggcugaagugggaggaucgcuugagcccaggaggcugaagcugcagugaacugugagcaugccauggcacuccagccugggugacaguaagagccugguacaaaauuaaaaaagaaaaagacaguaaagcuucuuuuuuauugaugauaaggucgcaaacagguaauucauuugaucaagguuacacagcuaguagaaccaggauuuaagccuggaagucagacucuaaagucaauaacauuagcuguuagacuauacuaccuccccuuucucuagugcuuccuccuaucucauuugguaugauaaauagcuuuugguuuuuucaguuuccuguaauaaccuucuuuugucaugaucaccccccaguucauccuuuacacuauaaucagaaugaguguucccaaauauaaagugauauuugacuaucacucuguguaucaaugcagaauuagauuggccacauauagggaacccaaaauagcauuggcuuaaacauaaaagguguugauuauuuuacauaaaagcagccuaggacuagaaagguauaucuuuggugucauuaguaacccaagcuaaucagucauuagugaccuacaucgucauguggacuucuauccucaaggucaccuaaaaaccaauccuuccuuucuuuuuuucuuuuuuuuuugagacggggucucgcccugucgcccaggcuggagugcaauggcacaaucuuggcucacugcaacuucugccucccaaauucaagcuauucuccugccucagccucccaaguacaugggauuacagucacgcgccuccacacccggcuaauuuuuguauuuuuaguagaaaaauacaaaauacaugguuucaccauguuggccaggcuggucucgaacuccugaccucauguucuacccaccucggccucccaaagugcugggauuaacgggcaugagccgccgugcccagcacaaaaccaauccuuucaacuagagcucccaccaucacacccauacucuauggcagaauuuuaguccaaaaggagaugcaggauauaaaggccucauucuccugggugagcucuuucuaagcagccuuuuuagaagcuccccucuaaacuucugcuuacauagcagcuuugagggaauuuagggagugucaccuuuuaucuagacacacugccagcugaaauaaacucagggucuguuaguaaggaagaaggagaaauggauauugggugagaaucagcaguauccaccacauuuuagcaggucugccagacugcagcucugucaaacuuauugcucuaucuuugacauguagcacgaggcucgguagaguaaaugaauacauuuucuguaggauaaaaucagaauucagcaacaugguauuuaaggaccuuuaugaccuggccacagggaucucucaucucgcucauuguugaaucgcuuucugcuuaagccauuuuaaauucuuugaaguuaucugaaggugcuaugucuuugcacauggugguguucucuuugcugaaaugucauccucccucuuaagugaucaaucuauuucuucaggugguucaaccuaauaaaauuacuuagccagcuugguaaacuuuuaaucauuuaagacucagaucaaaacuauuucuuuaacauuuuuagucaacaguaaauacacaacaaauauuuacaauaugccuauacugggcuaauuauucucagagguucuuaagagagugacaaguuuuguuuuuacaugucuaauuaauauuaaugaaaaggaauacgaagagugguuuauggaugggaugagaaggaagccagugaguacugagaaggugaccccuagggauuuggccuggaauggcaagagcucagacaugucagaggaagaaauuuuuuuuuuuuugagacggagucuugcucugucgccaggcuggagugcaguggcgcgaucucggcacacugcaagcuccgccucccggguucacgccauucuucugccucagccgccugaguagcugggacuauaggugcccgccaccaugcccagcuaauuuuuguauuuuuacuagagacgggguuucaccauguuggccaggauggucucgcucucuugaccucgugauccacccaccuuagccucccaaaguugugguauuacaggcaugagccacugcaccuggcccaagaggaagaaauuaauggucagcuggacaugggaugaaagaggagcuaaugaaaagaugauccaaagucgucaggcccaaaugguggagacaugcccaguggcacaaaagugugguggagaguugcuuuuugugugugugaagagaggaggaugggcacggugauggacacauugagcuuguagcaguagggcaucaaaguagaaauagcauguaauaucuuuuaucucuauugaauuauuuuugaaaauaaguaaacaacaguacuauugucuggaaaacaguugcuguuguuuagugcugugugcccgauuggcaaugcgggcaugugguagaguuauuuuauuuuauuuuuauuuuuugagauggagucucauucucucgcccaggcuggagugcaguggcgcgaucucggcucacugcaagcuccgccucccggguucaagcgauucuccugccucagccucccgaguagcugggacuauaggcgugugccaccaugccuggcuaauuuuuuguauuuuuaguagagacgagguuucaccguguuagccaggcuggucucaaucuccugaccuugugaucugccugccuuggacucccaaagugcugggauuacaggcgugagccaccaggcccggccggaguuacuuuuauuaagcaacagggguccucuuugcuuaaaauucaacaacaggacaugugcuuuguugcaaggguagauuuagguuagucaugaugaccuuccucagucuacuacaggcaaguucuuuaaacucugaguuucuuuaugaaaugaggaugaugauagugcuuacuuauacaguugcucuaggauuaagugaaauacuacaaguaaagcauuugguguggggcuuggcaucuaguaagaauaaugauagcauaaaauuucuagaacagauuucaaagagaugcuacaauaccuucuauuucuaggguauuucuagagauacuucaggaaaaaggagcacccgucuuggauaguuggguucgggcuaaugauuuugauugcagcacaagaaaaauaauuaaccuucagaaaugggccugcaucuaugacaauaagcagcaucuaaaaaagucauaaauuguuucagaaggugauuuagccuauggaauaguuugauguugguuaucucuuuuggauacuuuaggguaagaugauggcaugcaaacacugcagugacauuuucagcaaggagggugcuuugaaacuagcagccacaggcagagaggaccagggaauugaaacagaugaugagaaggacucacuuaagaagcagcugagagagauggaacuggaacuggcacaaaccaaacugcaguugguggaggccaaguguaaaauucagguuggugauuugauaaaagaacaagaagaaagaauaaacaauuaaugguccaggauacucuaguacuucagaauacaccuaucuaggucagaauuguaugaugaauacauuuucugucugcuaauguguccugcauaaucacauuuuauaucauguauucuuaacgcugauauaaacaaauauauaauuuuaaaugaaauuuuaauaauuaaaauuauaucuuaugggaauuuaauuaagcauaugcuuguuuuuuuuacccugagauuuuuugcuuacauccuuucucacagaauguggucacuucaguggcugauccugaaaaugaaaaaccaaacccccucugcugugucuacccugagagucacacauuggcugacacccguucuuuccuuuagagcuucuuuuuaucuuuagcucauuuugucaaaccucuuuccccauuaucuuucuccauauuggcgcauaauauaauuagaaauaguccuggcuucugauggacucuucuucauuucauuuucccagugaucccuaccagcaccauggcugccaugucaccagccuccaccacaccagccagcuuccaccaugugucugcucugaccuuggacauucuuagggcaaagccuauuucuuuggaacuggaauucauucaugcuucuacuaucaguaaaaauucauccauauguuuacauuuauuugugguuuuuaaaccuguuauaucggauugcaaccuaaaccuaaauuuggaccuaacuugcagggaaaaaaagaauaaaaugagcuuuucuuucacuguuuaaagaaagcacagauucuagauuuuugauaagucuuuuagcucuuaacuuuauccuuguacuaagaagccaauucaaucucuccuggguuuugugggaggaaaauuggcagcacauaccuugagacuccaaaaagcugcacacuuuuauuuauuuauuggcaaagagaaaacauuuauuuaacucagaugauuuucuugcuuuaauuaggaacuugaacaucagagaggagcccuuaugaaugaaauccaagcugcgaaaaacucuugguuuagcaaaacccugaacucuaucaaaacggccacgggcacccagccauugcagccagcaccggucacccagccacccaaggagagcacauaguuccagccuuacccaagcacaagagcacaauguucaaaccaauggaaaucugggaggauucuuccuggugucccuuugaaggaaagucaaggaggccagaaaacaagccagaauuuuucaguagcucucacucuuucuuguaugacacuuuucaaagggaugcuauuuaaacugaccuguucuauguugaauaccuauuuuccagcuucuggaaggccauguucagauccaucauaguauuacacauuauuuuguuugccugauguuuaguuggaaauaaguaauucagaacuaaaugcuuuuuuauuuagaauuauucauaauuauuuuuaucuuacauaaaaauggagacaucuguuauuccaagguugaagugauaagaagaucuuugucacaggaaaaaaaaaauugaaaccuaaacaucuuaaguuuucaggauuuauucagauaaagcacacuguggggccaggcaugaccacucucagguuuccuccugagccugauucccagggaaguguuaauccuguccaaaggaaagaaccaaucagcgaucauugguuuacuuucauuuucuguucgguacaucuggaaaugaagugccaggaauagacgggcuguucagauuauacgcuagguaaaaggaacugaaauuuuaauaaguguaggucaggaucauuugggcugugguauucuaacagauccuuuuaagaaugccacauaggacuugugaguuccuaaguacaccaaaguauggacacagaugugacuucuggcaauuauaaaguuaaagguggauauugcaccuuacagacuuagggagccuuuaccagagacgccuaaaaagccccagguucagccauugugcugaauagaguggaauauagaaccagggacagaguauuucauuuaacguugauauauacuugcuaaggaaacacuaacaauacuguaacuuuguuaaaggacauaguauugaaaugggaaauagaggucaggcucacaucaucuuaguuuaaugcugggcaacuuuuucugauuucuguaguucccugaaaauguguccuucguacccauaaagagauacaaaugcauuuguaacauuuuugauugaauauaaaaccuuuacagaaauacuuaucucauggaaagguaaagcuauuguuuaaaaauuaguggaaauauuuuuucaauuauauuuaacaugccuauaaaaauaguccuugcaggaaauuauuugauaagagcaaaacuauuuuuauuuuauaaacuauuuuggaggccucugauccuuucaaaccaaccaaacuacuauuagauauguacaauaacauuuguugauauuaaucauuggccucauuguugaacauauuauuugcaaagaaucuuaaacucuguagugccagaaugauucucaucugugccauauuuugcaauuaaaaguaacacacccuuagaagaaucaaauaagagccaucuacaucccaggaggaugcaccaaguugcucacaguggaucuuuuccucuaaaaugaucuuuuauguucuaaaaagugaaauccccuuuaucuguguuuauauucucuacagcccauaaaacugaugugauuguuauguuauacucaucagauaauacuuuucuuacauaaaucuuucauuguuguucugacaucuuucauuacaaaauuuauuuucuuaacaaaaaggaacauaacccagcauuccaagugucuguguuggcuuuaacauucucuacaugguggucuagauaagcuaauuuuuuuuuuuuuuuuuuuguaaaauguaauagcuagaaaauguuaucuuggcgcuuguuuuuguaaaucauuuaguauaggcuguuagcuuuacugguacuuuacgcuuugauuccaagaagccuugugcaguugccuuaucaaauggccagcuaaauuaaagaugcucuuuuguguugugaauuucauaguucuguacagagcuuguuucaauuuacaaaaauaaguacauuccacagaaugccuaaaguguguaauuuucuuuaaauaauaguaggugagggagaaacauaauggcucuaggucaaucccuuaucuaaagaccuuguucaacuucauagucccuuuccuuuuaaagaggagaagagaaaaauccccccuggccaggcaugguggcucacaucuguaaucccagcacuuugggaggcugagguggguggaucaccuaaggucaggaguuugagaccagccuggccaacauggugaaacccuaucucuacugcaaaauacaaaaauuagccgggcuugguggcgggugccuguaaucccagcuacucgggagguugaggcaggagaaucacuugaacccaggaggcagagguugcagugggccaagauuacggcauuacauuccauccagccugggcgacaagagcaaaauuccgucucgaaaaaucaccagguacauaccucucaaguuugauaaguccaucuuuugaguuuucuuuuagcucuuucaaaagauuacgagggcaauacauauuuuuuuuuuuuuuauucuccagccccauaucauacuuggguaugccuguugguaccauaagccuaaacucuccuucacugcaaugccuuugagucaguagcaauaguaaagacuagaaacaaagaaaauucagaauuugguaugugauaugauuguucauacaauauguuauaauagcaauauuccaaacaauauguccuucacugucuauuguuggaaaacucaugcaucccagcaugaaguaacuccuaguuuuaauuuuaguuauuuugagauauauuugagaauugcaucucuucucuugaauuucacuuagaagagauuaaccagccaaauauccaggaaaguuucaaaacauucuaguguuuuucauccuuugcuaggaugcacucuguacaaaacauuccucugaaaaucuaauauuugcaguaucuaagaauugaucauuucuauuuucauuaaauucuguggaaaaaauuaaaugaaugaaauucaacuucauaauucaguucaucagcuuuuguaucuugagaaucuaaacacgucuuuaaaucugaaagaaaccaagcuggauuuugcagugcauauguuugcuagcuucccacauccugaaccaugucaaaauuugguuuuauuuaguuacauauaauuuaaugcaaagaaauucuguuacuuaauguucuguuuauuuaugagugccuaucaggaacacuaauaggaaugccauucaaccagugucuucugccccucucccagcuguuaaauuaguacuucuucauuggcuuucugaaauguccugaguaaaguagaaaagcaaccuuuguauggauguggggauauuuaauaguauguaucuuguuucauuuuuuuccuaugauguauuaauauuuauuuuucuccaaccccugcuccauuuucuuaaaauauuuuccaguuaauaacuaguugcuuuauuuccuagcugaagugagaaaaccaacggaaaacaauacagauuugggcagaggagauagaguuacaucuuuaaaggagugagccagucacccaggagaaucacauguguaacugauguagggguuuaagucuucauacuuucacuaaaaucugucuacuaacucucccaccaaccuuugcaucaaacacuuagguaccugccugauuaggggggccccuuuaagggaaaaaacuuuuaaaaaauuaaaugccuugguuuuguuuuaucuucugggaaagaacacuuuuacuugauuagcaagaugauuauauuauauaacuugcccuuaaaaacacuccaaaauacugacuccuuuucuccaauuacaaaugagugugaagaaauucuguuguaugauuugaacacuauuagguuuguauguguguuuaauuggaagaauuuuauauagaguaucucugcugcuuuuguuuaccuggguaccacacaaccaaauacacauugagauuucaagaaaugaugaugaaagccagaaggccagaccacagcucugcagccuguuuccuacaaccagauauaaaacucuuucucgucgccaugcugauagucacacugaacuagaacugucccaacacauucuuccucucucauaauggcuuccauuuaauacaggcaaagcccuuuaccuuagcaaauucuuuaucuuucaaaagugaccaaaaugaggacuucaaccuuggcugcaccucaauaggagaugcugaucuugaguuguaaugagaaaagugggcauauaggagauuuuagugacugcagucagcugucuggcauuccuuucucaguuugcaucuaaaagacuacauaugucaagcuuaucuccaccugaauuugcugccugcuauaaaaacauuucauuaauauaucccauucuuccuaccuccaucucugguuugucauuagugguauucugaaaagcuuaagaaaaaagaaucauugaguagaaagugaacauuuuaaguuauuuuccuuuuucauuggcaauuaguuaacauguaaaaucuuuuccauuaaacuguauaacuuuuaauaacuauauauuauauaugggauaaaauauauggacugaauugugagaauauaaaugcaucgaaagacucuggugucaugaaagcacaagaauaaggcuggagauggucccagauccaagaugucccaaaagccuuuuguaucaguuucucuauuuuugguauuuugcauaaugcauggauccuuaguucaaaugagggacaaaguuucucagucagccccacuuccuuucuuucuaacuccuaccuuucccuugcagaggagguaguagagauucuggaauugucuauuuuuaugaauuccauuauuuuguccauggcaucucuaaugaaaacagguucuagaauaaaggaguugauuagucugaacaguacuaauuaacuacaaaauaaacguuagugaucagccucuuccucuauaaacaaugaccaauuagacguuuccguaauuccauguauuauguauaguacacucuauaaauguaaauguaaugcuugucuaaaaagugcaauuuauuguacauugucccaacaaauguuuacuuuuauaaucguuaugaacuugaauuggauuaguaucuuguuuuuaugugugaaugaagccuugugaaauaaacaaaugcaacugagaagguaacaaggugacuguuuuugugagccagugauguuuucaaugcuuuguguugccccuuuggccccauuaagcaguaauaaacauuuguucugaagucca

SEQ ID NO: 191155 - RNA, 61859 nt, Homo sapiens
cuuuuuuucaaagauuuugauuccaguggaaucuuugcuuuagauuuguguguguguuuguguucgugaauuguaacuccagaagcaaugccuguacaagcuccacaauggacggauuuccucuccugcccaauuugcacucagacuuucgacgaaacaauucgaaagcccaucaguuuggguuguggccauacugucugcaagaugugccugaauaaacuccaccgcaaggcuugcccauuugaccagaccacuaucaauacagacauugagcuccucccugugaacucagcauugcugcagcucgugggugcucagguaggaugggugacuuaauacuuuuaaauuucucccucucucucucucucucucuguguguguguguguguguguguguguguguugugcguguuuuucuccugagagaaaccuguugaauuaaaauuggguaacauugccuucuauuuaaauagguauaauucuguuugguacuguaaauccuuuauuucagcauguuagauuuauugugguaguccagugcuuuuuagucauaguacaguaacauccauuuaaucuugucagauauucaauaaaccuagcuaugcagaucgcuagagaaaccuaaggccgggugugguggcucaugccuguaaucccagcacuuugggagggccaaggcggguggaucauuugaggucagguguuugagaccggccuggccaacauggugaaauccugucucuacuacaaauacaaaaaaaugagcugggugugguggugugugccuguaaucccagcuacuugggaggcugagacacgagaauugcuugaaccuaggaggcagagguugcagugagccgagaucgugcugcacuccagccugggugacagagugagacccugucucaaaaaaagaaaagaaaccuaagagguaagucauaaggaccuuuuuuaacauugagaaaacuauuguucauaaaaccacugcacuuuacucaguagagaaggugcagcugcuucaggcaguuuuacucaguagacauuaacugaaaugaaagaugagaaaggugacaaaaacuauagcacaacauuugggaaccauuagaacacacuuaaugcuuuauaaaccuaaaaaugguugggaugguaaauuuuguguuauguauauauuaucacaauaaaaaaaauaaaauuuucccaaauuuuccuuucaucuaaaaggaaaaagaaaaaauaaauuagacuuuaaaauauauaaucaccaauuucuccuaggaauguaaguuugacuuaacaucugcaaaucaauuaauguaauucacuauaucaguaaaaguugcaaaauugcacacauaugaucaucucaauagacacagaaaaagcauuuggcaaaauccaauaccuuuucauaauaaaagcacugaaacaacuaggagaaaaacuucuucaacccaaaggacauggaugaaaaacccacagcuaacauacugaauggugaaagacuagaugcuuuuucuguaagaucaggaacaagucaaggaucuccacucuuaacuauuucuguucaacaucauacaggaccuucuagcuagggcaauuaggcaaguaaaugaaaccggugacauucagauaagaaguaaaaaauaaaaacaaucucauucacagaugacauggucuuauauauagaaaauguuaaggaaucugcaaaggaaaagcuauuagaaacaaaaaacuaggcagaguugcaggauauaagaugaguauauaaguaucaguugucugaaaaagcaaaagucuuucuaagguguaaaaauguguuuacaguguuucauaauuucuuucuuucuuuuuuucuugcucugucacccaggcuggaguacaguggugugaucuuggcucacugcaaucucugccucucaaguucaagugauucucaugccuuagccucccaaguagcugggauuacaggugugcacuaccauacccagcuaauuuuuguauuuuuagucgagacaggguuucgccauguuggcuaugcuggucucaagcuccugaccucaagugauccaccugucucgaccucccagaguacugggaauacaggcaugagccaccguacccagcuaguguugcauacuuucauccacaguauguuaauaacaguuuucuuaggccaggcacagugguucacgccuguaaucccagcacuuugggaggccgaggcggguggaucacgaggucaggagaucaagaccaucccggcuaacacagugaaacccugucucuacuaaaaauacaaaaaguuagcugggcgugguugcaggcgccuguagucccagcuacuugggaggccgaggcaggagucccagcuacuugggaggccgaggcaggagaauggugugaacccgggaggcggagcuugcagugagccgagaucgcaccacugcacuccagccugggcaacagagugacacucugucucaaaaaaaaaaaauaaauaauaauaauaauacuuuucuuacacacguaagaaagacugucugguacauaggcccuuaauaaagacuguuaaauaaguaauauauauguuguauuucuauacgcuggcaauggacaaucugaaaauagaucaauuucaucuacaagagcauaaaaaaaauuaagaauauauuuaacaaaagaaauguaaaauuagaccgggugcaguggcucaugccuauaaucccaauaguuugggaggccgaggcuagcagaucucuugaggccaggaguuccaagaccagccuggccaacauggugaaaccccgucucuaccaaaaaaauagaaaaauuagccaggugugaaggugcccaccuguaaucccagcuacucggggcugaggcaugagacucgcuugaacccaggagagggagguugcagugagcuaaaaucacaccacugcacuccaaccugggugacagagcgacucugucaaaaaaaaaaaaaauguaaaacuauauuuugaagacuacaaaucguuguuuaaaaguagcuuaaaacuugaauaggccgggcgcgguggcucacgccuguaaucccagcacuuugggaggccgaggcggguggaucacgaggucaggagaucgagaccauccuggcuaacaaggugaaaccccgucucuacuaaaaauacaaaaaauuagccgggcgcgguggcgggcgccuguagucccagcuacucgggaggcugaggcaggagaauggcgugaacccgggaagcggagcuugcagugagccgagauugcgccacugcaguccgcaauccggccugggcgacagagcgagacuccgucucaaaaaaaaaaaaaaaaaaaaaaaaaaacuugaauaaacauuuacucuauuaacucaaaauggaucaaaggcuaaauauaagaacuaaaacuacaaaacucuuagaagaaaauauagacauaagucuuucugaccauggaguaggcaguggguuuuuuucaagaugugacaccaaaaagcacaaggaacaaaagaaaaagauaaguugaacaucaaaauuaaaaacuauauuucaaagauacgaacaauuggcuguucacaguggcucacgucuguaaucccagcacugugggaggccaagauggauggaucauuugagaccagccuaggcaacauggcaaaaccccaucucuacagaaaauacaaaaaaaaauuuuuugcugggugugguggcacaugcuuguagucccaccugucugugaggcugaggugggagcaucaccugagcccaggaggccaagauggauggaucauuugagaccagccuaagcaacauggcaaaaccccaucucuacagaaaauaacaacaacaacaaaaaauugcugggugugauggcacaugccuguauucccaccuaucugugaggcugagguggcagcaucaucugagccugaucaccugauggaggcugcagugagccucgaucgcagcacuacgcuguagcuugggcaacagaaugagacccuaucucaaaaacaauagcaacaacaaaaaacaaagauaccaacaagaaagcaaaaagaacaaccuacagaaugugagaaaacaauuguaaaauccuauuucugauaaagacuuauauguagaauauauaaggaacucuuacaacucagugauaaaaagacaacccaguuuuuaaaauggacaaagagcugaacaaucaccucgucaaguagauuauacaguuggaaaauuggcaaaaugaaaaguagcucagcaguuugucuuuaaguaauugcaaauuaaaacaagugagauaccacuacacacaaauuaaaauggccaaaauccaaaacauuagcaacaccaaaugcuggugaggauauggagcaacaaaaacucucaucuuuuuggaaaugaaaaaugguauagcuacuuuggaagacaguuuggcaguuucuuuauaagcuuaacauaguagguauuuacccaguuaacuugaaaauuuaugucuacacagaaacccucacaugacuauuuauaacagcuuuauucaugauugccaaaaaauggaagcaguugagauaucuuuuaauaggugaauggauaaacagugguauauccauacaauggcacauuguauaaaaugaaauaaugaaaagacauagcugucaagucacaaaaagacauagauauaucucaauguauaccauugcuaagugaaagauaccaguaugaaaaggccacauacuguaugauuccaauuaugugauaucuguaaaagguaaaaccauagcaacaauaaaaguaucagugguugccauggauucaggaguagggagggaggauagaauuggugaaacaguauuucuuagggcaguaaaacaguucuuuaugauucuguaauuguggcuauaugacacucugaauuugucaaaaacuguagaacuuuacaaagauuauggaagacaaucugaaguauaugaaacaauuucacuaaagggguguaggagaaagguagauuguguaagauuaaagauagagaaagauauuaucuauaagcaguguacucuagucuuuucccauggggguacgaauuaauucugauacugcuguauguauaauacauauuagaauugaacaguuaaguaagugaaugggaaaugauuggagccaguuaacagauaaacaaggaggaagagguuagagugauucaugugauaauggauuggaguuggaggcaucaguaugaacucauuuuuagcuugauauggauacagaugguuauauacagaaauagauauacgagauaucucguguguaucucggguuauuacaauguauaucucggguuauuacagugacauauuuccuuggucugucaucuaagauggccuagaaggaacaacaccccaauaguaaugugcauacauagcauucauaucuugguuucuaauaccauucuccaauaaaaggaaccagaguuccuuggagaaauggcuaauucuaagacugggacaggaaauacacgaaaugagucuggaguagcuuguagcacuggaaaguauagagaaguauucaaaacacacacagacacauacacagaguaaugggggcuauaucaaaggcacacaggagccaacugaaagagcucucaauggccaaagcuaaaacaguuugaacaacaaaauaaauggaauuggaucauaacccagguauaagauaaauauccuugagucuacacgauacaauuaaaugauugaauaaauagauggaagaaagaaacaaaucucccgugcagaauuccaaauuaauuacauagauauucugcucucaaggauguagaaugugugugggcuacgcauagugacuccuuccaaaaaguacaguuuguggagauuauguaacuuuauaguggagaaaccugguaaacacugacuaaaccagcuguucaaauuuaacaucagcaauaauaaguuguguuggugguguguagcuuugauaugaugugauaaaaaauggcacuuuuccccuaugaucuuccaaaaauccauaaccccaauauacucaugagaaaaaugacagauccuagaucccaguuuaggggcauucuacaacauaccagaccagugcuccucaaaacugucaaggucauuaaaacaaggaaagucugagaaaguguccaagccaagaggagcuuaaagagauauugaagggcuagcgcaguggcucacaccuguaaucccagcgcuuugagaggccaaggcaggcagaucacuugaggccaggaguuggagaccagccuggccaacacagugaaauccugucucuacuaaaaauacacagaaucagccaggcgugguggcgcaugccuguaaucccagcuacucaggaggcugaggcaugagaaucucuugaaccugggagguggaaguugcagugagccgagauugugccacuguacuccaaucugggcgacagagugagacuuugucucaacuuugaaaaaaaaaagagggagagacauggagggagagagggaggccaagguggguggauggcuugagcccaggaauucgaggccagucugggcaauguagugggaccuccaucucuacaauaaaauacaaaauuagcugggugugguggcgugagcccagaugcugccacggcacuccagccugagugacagagcgagacucuuucucugaagacuaaguguaauaugguauccuggaugggauccugaaacugagaaagaacauuaggugaaaacuaauaucugauuaacauggauuuuaguuguuaauuaugaauauguugauauuggcucauuaauuuuaacaaauguaccauaccaguguaagauguuaauaauaggggaaauuguuagucgagugugguggcuugcuccuguagucccagcuacuugggaggcugaggcagaagaaucgcuggaacccaggaggcggagguugcagugagccgagauggugccacugcacuccagccugggugacagagggagacuccgucucaaaaauaauaauaauaauaauaggggaaacugaauacaggauaaugagaauucuguguacuaucuuugccauuuuucuguaaaucuaaaacuguucuacaaaauaaaguuuacuaggcaaaaugggcaaaggaucugaauagauauucuuccagagaagauauacaaauggauaauaagcauaugaaaggauggucaacaucauuagcuaucagggaaauacaaaucaaaaccacagggaagugggaggaagguagaugggaagaagagauaauuaucaaagaauacaaagcuucaguuagacuggaggaaugccuuuagugaucuauugcacagaacagugacuauaaauaguaauacauuguauguuucaaaauugcuaaaagaguagauuuuauuuaaaaucuacaaaaaaaaagugaggugauggauuuguuaauuaaccugauuuagucaucucacaucgucacauuguaccccauaaguauaugcaauuauuauuaauuuaaaauaaaauuuagacaaaccacaaugaauuacuacuuuucacccaacaggauagcuauaauaaaaaaagauaaugaguagaagaauuaucuuucuacauaaaauguagaagaauuggaacccuuauacacuccugguagauauauaaaaugcuacucugcuuuuggaaaauaguuuggcaguuuuucaaaagguuaaauacagacuccuagguauauaccaaagagaaacaaaaacuuuugucuacacaaaaacuuguacacagauguucauagcagcauuauucguaguagucaaaaauagaaacaaccuauaugucugucaaugaugauuguguaaauaaagugugauauauuuauacaauggaauuuuauucagugaugaaaaugaaugaaguacugauacaaccuggaagacccuugaacacauuguuaagugaaagaaguaagucagaaaagacuauuuauuguauugauuuugcuuauaugaaauguccagaauaggcaaauccauagaaaauagauucgucuuuccaaagguugguggaugguugggaagaaauaagggguaauuguuaaaaggguacuguguuucuuuuugggguaaugaaaagguucuaaaguugauugugguuauguuuggacaacugugaauauacugaaaaccagggaauuguauguacuuuaaaccagucaguuguaugguaugucgauuauaucuuaauuaggcuguuagagaaacaaaacaaaggaaugcaaagauacauguuaauaggaaagaucuuuugaaagaauucaguaaauuuagugggcguuuugauguuaccagugucagcauuaugagugcauaaacuauacuaaauaaaacaauuaaugaauugagcacucauacagaucuuuucuuuuggccuccaggucccugagcagcagccuauuacuuuguguagugggguugaagacacaaagcauuaugaggaagccaagaaauguguagaagaauuagcauuguacuuaaaaccgcucagcagugcuagagguaaguuuguuuuuguuucuuauuuaaagaguaaaacugcuuuuuuaaauacucaguacauaauccuauauaaguccugaggaauucccaaaaaaccuaacuagagguaaauuugaugcaauuauccauacuaaguaaaugucuacuaaagagacuuguuaccauaaaaauugugagcuauuaagcaaauguuaaugaaauuuaucuauuguaaacuaaacucauuuugugcuaaauaucaugacacaaaccacaucaaauaaaauagugaauuuuuaguuuaugugaugauggaaacauuauucgaaugaugauaauagcaaauauaacuacuuacuucagcagugcuuuccaucauuugacaauucugaaugguuugccuucuauccaguuuuauaugcuaugcuauaggcgguauaaugaauacggaaguugccauuacugcacagaaagggcuugcuauuuaauuaggaaaauaagguuaaccacugucaaauaauauaccagaacucuuaggacuucaagauuuacauuauaaacuaauuaucaauguugucuaguccuuuuuucuuucuuccucuaugauuaaaaugaguaaugguauauuuaaugucauaaugaaugcuaagugcacaugagauaacucauguauacauuuguauacuuuaaaaauguauacuuaaguaagcuuuacaugugugguuuuauuuguugcuuauuuuaaauacucuaguagucccagaacuagucacauacccacaaguuaacccaacagaagaauugcuccuggacuguaaaauugcauugugaaccuaggaauaacuucuuuacucuuuuaaaggagugggucugaacagcacuacucagaguguucugagucgcccaaugcagaggaagcuugugacucuaguccacugucaacuaguagaagaagaaggcaggauucgugccaugagggcagcucgaucuuuaggugaacgaacaguuacagagcucauucuccagcaccagaauccucagcaacucucuuccaaucuuugggcagcaguaagggcuaggggaugccaguuccuuggaccagguacauaauuaacuuuagguauuuauucugcugguaauucuaaaaguaugauguaggaauuauaagugauguacaaagccuaguucuuugcaguauuuuauuguuaccaacuaauaucuuguuugauguucauggcuugggcaauuccauguaacuuaguggacuuacuaggugaacuuagugaacuuaaaacuuuucucuuaaugccaaaaguuguuucuuuuuuuaauuuuuugauuuuuccuuuuuuucacaccuguagcaggaaguucauucauuuugauagaaguuuuucuuaaauuuauuaaucacuuuaucuguuuucuuuauaaaauauauagaauguaauacaaaauugcucacaaaaaugguguaaaaguguguugcugguuaaucuuaacuguauugccaguuaauugaauagcugcagaaaugauuaaauauuccccuucuaauaaauggauuuaucuuaucuauguacuugauaaauuuugguuuugcccaacuuucccuagcaaugcaggaggaagcuuuaaaguugguucugcuggccuuagaagaugguucugcuuugucaagaaaaguauugguucuguuuguggugcaaagauuggagccacgguuuccucaagccucuaaaacuagcauugggcauguuguucagcuccuuuauagagccuccuguuucaagguaugaaccuacauuaaagcucagcuugaaaggaaauauuguucuuuccccaaaguuaaguaguaaaacuuugaguuuaauaaaguugccuguaucuuuucagaaaaucucagcaauuuuucuuuauucuuuuaaagaauguagauggggucuuauuauaguuaaauacuauuauauugaauuuuuguauguucaauauugaacaacauagaucaagucaagguuuauagauuuuuguauuugaagagacuaagaaacuauaucaauuucuuaccaagacugugcagaauuggucugaagagagaguuauugaagcacaaauaaauuuuauuuauuuauuuuuauuuuuuugagacaaagucuugcugucgcccaggcuggagugcagugcaugaucucggcucacugcaaccuccaccuccugcguucaagcgauucuccugucucagccucccgaguagcugggauuauaggcagggccacugcaccuggcuacuuuuuguauuuuugguagagacgggguuucgccauguuggccaggcuggucucgaacuccugaccucaggugaucugcccgccucagccucccaaagugcugggauuacaagcgugagccaccgcgcccagccaaauaaauuuuauucagagauuuucuccuaguguaauuccacauauacaauaaugaaguuccauuugccauuucaguuuauaugguaaugcuggacauagucucuuaucccaaauugaauaagcaccgccucaaacauugcuacucacuauguaucauuuauuguacauccaguauuauuuuucugacuuuuuuuuuugagaugcagucuugcucugucgcccaggcuggagugcagugguguagucuuggcucacugcauccucugccuucugggucaagcaauucuccugccuccagccuucuaaucauaaucauuaugauuauucuagucuagcaucucacacuuuacacuuucugguaguagcccaucccacaaaacuccaugaagaauuaagccaaguacaaauuaaaucauuuuuagaauuacaccagcaucugaagcucuacagucaucagucccaccuagcucauugucaggcaaucccaagagucauaauccacauuuauggagaagaaacauauuguuuuucagaauauagaauuguauuaguauuuuuuucuuuucaaaaauacauauacacacacauacaccuuaaacugaauguauauguuaaaguaugucaaaucuuuggauuucauuccagcacauacagauugacuauacaaaaauccaaaauccaaaacuuuuugaacaccaacaugaugcucacaugcucauuggggcauuucagauuuucagaguaaggaugcucaagugguuuaaugcagauauucuaaaauuugaaaaaaucugaaaucugauaacacuucuggcccaagcauuuuggguaagagauucucagccuguauuuauucuuucugaaagaccuauccagaaaauguuggccuaaauccaacuugacucagaaugggaugauagcaauauaccuaccucaacaaguuaaggagaaaauauuuugcaggcaaaugguauauucauuuaaucuugcuguugaugcuaaauuuguuacauuaaaaauuauauguucauauaaagcauaaacucauuuuuuugacuucauuaugagauuauuugugucuuauuaggucaccaaacgugaugaagacucuucuuugaugcagcugaaagaagaauuuagaaccuaugaagcucugcggcgagaacaugacucccagauagugcagauugcuauggaagcaggcuuacgaauugcaccggaccagugguccucuuugcuuuauggagaccagucucacaaaucucauaugcaguccauuauugacaagguaggaccuuuuuuguuccuuacuucuuagacuaaucuuggcauuuugguaauucauuuaacaaauguauauuaaagugaauacuguauagcuuuuguaaauuguauuuauagccagugucaugucauaaccaaucacguuauaauaccacuuuguucauuuaaagauuugauuaguuuauauuuuuuauuuuacuuauuuuauauuuuauuguauuuuuacuagaaucacagagaugaaggccaacucuagagaccacucuacauuuaauuuagagaaauagagucaaauaguaagaguaaccuaaaaaaaaaauaaugaacauuuacuaaaaucuuaauauguaucuagugguuuuaaauaauucauuuaauccucucaacagcccuguauuauccauuuuagacaaagacaaagggaaguuaauauguuuuuccagcaucacauagauaauaaaugacagaaguggauuugaacuugaccauucucaguguagaguacacuaaccuuuuaccagacuauucccccccaccuuuuuuuuuuuuuuuuuuuuccuauuucuaaagauagaauuccuugaauggguaauacagugagaauugggaaauauguuuuuuaaaugcuugguguagggugggcacaguggcugaugccuguaaucucagcacuuugagaggccaagguggggggauugcuugaggccaggaguucagucacagccugggaaacauugggacacucaucucuaccaaaaaaaaaaaaaaauagccagguguggugguaggcgccuauagucucagcuaccugggaggcuauggugggagaaucccuugagcucaggaguuugagggugcagugagcuauguuagcaccucggcaacagagugagacccugucucuuuaggggggauaaaaaggcgguacauaauuuucaguuacaauguagguuguuugcucugcucuauaagucuucccuggauaccuuuaaccagacuuuaccugcaacucuuagguuuggacaggagcuuguaucggaaguuuugcaacucauuuauaauuuacggaaacgcuuaacgcuuaguaaugaucuauuagaggaguaccuuucuaccucugaagagaaacuuggcuuuuuuuguuuguuuguuuguuugagacagagucucacccugucacccaggcuggagugcaauggcacuaucucggcucacugcaaucucugucucccagguucaagcgauucuccugccucagccucccaaguagcugggauuacaggcacgcacuaccacacccuguaccacgcccaaauuuuuuguaucuuuaguagagacgggguuucaccauguuggccaggcugguuucgaacuccugacaucgucaucugcccaccacagccucccaaagugcuaggauuacaggcgugagccacugugccuggccuggcuuggcuugucuuuuauaaagauucuacaaggugguuaaucuugucugaacugaacuguguaacuagguguauauccuacaguaauuuucucauaucacacgcagugcuuuaaauuuaauauccagagaccuuugcacaacaaacugguaaacuuugcagugugugugauauuuuauagagcaauagaacuuucuguaaucaugaaaauguucuguguaugcacuguccaauauggugaucacuagucacacacggccauuaagcauuugaaaugugacuuuugcaacggaugaacugaaauuuuuauuucauuuaauuaacuuaaauuuaaauagccacauauugccaaggucaccauauuggauaauagaaaagagaauuuauuaaaagcgaugaggaaagcacuaauucuaguaaauuaauggggagagaaacaggaauuaacaauucacaaagaagacucaucaguauaucuaauugaugguaggcugaauugagagaggucucacauuugaagaaugugacagcagaggcaauacaguacacaaugugccaagcucuggaugcagagaaguacagaauuuauuuggguagcaaguaaucuacucuggccaaaguguaggguauaugggaagauaaaaauuaaauuuaauaaaucgcaaaaaugauugugauauaaauaaucuuuauauuuaaaggauuaucugaccuuugggaaaguuaacauuuaucuuuuuuaaguugcagacuccagccucuuuugcacagaguguucaggaacuaacaauugcucuccagcgaacuggagacccagcaaacuugaaccgacuaagaccccauuuggagcuguuagcaaacauugacccuaguccagguaaacccacgggaaauuaauggacuaucuuauaugugccuuucgugcugcucaaugauucuuuaauuaucuuuuguuguuccucuaggguuucccaaaguaguuacuccagaucuuuuuuacaguauuuuaaguuuccauuuuaaaucuuuucccucuuuaucucagguuaguucacuuuaauauuuauuuaauacuuuuuauacuguugcucauuucaucaggaaaauagauuucucugggcuucuuuauguuucuucuuucucccgucacaaaauuguguuguauuuuaccauucuuaccucuuccaaaucucguuuuucucauuuuuuucuguauuauguauccuuaguugcauuuccuugauccuguuuuugcccucuccaugauaucuuguuccuucaaguauccugucuuguauaucuuuacuuaggcuuuuucugcuccuucuccguaaccugaaaauauacccaaccuucauuuuucaacuugcacuuacaucuaaguuauuuuagcuucucuguguuuauuccuacuacugaucugaagcucucuuaauauucacuaguagauucccagucucugauuccaaaagcuuugucuuagucuuuaaaucacucccauuuguuuucagcauuucgauaauguuguugagcacuuuuuugauaucuuucugugaucucauaguucucuucugaccugagugcuacuucugucuuauuuguaccaugccuuccccuccugcccacuaaagaguaggcagguuaugcucuuggaauuuuguuuucucuacaugcucugauggugguuauucauucuuagcaucagguauuaccuuaguguagaauacagacucccaaauaucucuaucacuauuaucucugcaucacuccagauacaucucccagugcuugcugagauuccccaucguguccucugagugcuucaaagcaagcucaucauuucuugauacuugcucuuccuuuaauguuuccucuuucugauaaugaccucauucucugagguauguaaguuuaaaaccuuaauguuuugucuugucucaucuuuuccuuucacuuguucuacauacuguuucauacaaugggauuuaucuguucuucuuucacaauaccccuauauccccugcuuauaauuaauuccuuugagagccuccuuuuuccugagacugaaugucuuccaaguuccucuacuaugaguuccuccaauccagucuacuuacugcuguaaaagaaaucacaucccuggccugacacaguggcuuacgccuguaaucccagcacuuugggaggccgaggcgggcggaucacgaggucaggagaucgagaccauccuggccagcacgaugaaaccccgucucuacuaaaaauacaaaaaaaauuagcugggcaugguggcgggcgccuguagucccagcuacucgggaggcugaggcaggagaguggugugaacccgggcggcagaguuugcagugagccgagacugcaccacugcacuccagccugggcaacagagcgagacuccgucucaaaaaaaaaaaaaaaaagaaaucacaucccugaucuuccuuccacacucauaaacuuucauuguuuguagaauugcuuacggaauaagguuugacacucuugacuauggcauucagagcccucuuaguuuuuuaucagccuacuuuuauagauuugcucccaaaauugcuuaguaaaccagaucaauguuacuagaauauauagugauuuuuuucccugacugcuguccuuugaucauccugagcagucaaaagagaacuuucacaaguuccuaaaccauuuuugaccccauuucucaucuaccuaccacuucauuucuuuuuuuggcacacucuugaacucaacuccagucaggcauuuaucuccacugcucuauccaaacuuauuuugucaaggucauaaauuacuuccauguagcuaauuccaaaagucaguucucaguucuuacuguacuugauuuagcagcauuuaacuuuuuuuuuuuuuuuggagauacaguuucacucugucccccaggcuggaggcaauggcaagaucucgguucacugcaaccucugccugguucaagcaauucuugucccgaguagcuaggauuacaggcuuguaccaccacauccagcuaauuuauuauucuuauuauucuuauuauuuauuuuuaguaucuuuaguagaaacaggguuucaccaucuuggccaggcuguucucaaacuccugaacucaggugacccgccugccucagccucccaaagugcuaggauuacaggcaugagccaccaugccuggccauuguucuguacucucucuuccuugaaaugcuuuuuucuuggcuucuaggcuacuaauucucuucuuuauuggacucuccucagcauccucugcuuucucaucuucauauccuguacucuuuggaguguucucagaguuuaauccuauaucuguuuccuagauaaucuuaucuaucccauagcuucaaauauaauuuauguaacucacaaauuuacuguauuuuuuuuuuuuuuuuuuuuuuuuuuuuuuuuuuuuugagacggagucucgcucugucgcccaggcuggagugcaguggcgggaucucggcucacugcaagcuccgccucccggguucacgccauucuccugccucagccucccaaguagcugggacuacaggcgcccgccacuacgcccggcuaauuuuuuguauuuuuaguagagacgggguuucaccuuguuagccaggauggucucgaucuccugaccucgugauccgcccgccucggccucccaaagugcugggauuacaggcgugagccaccgcgcccggccaaauuuacuguauuuuuaucaguucugagguucauaauuauuucagaucuuagcauuucugaaauuggaaugcauuuguaugaagacauauuauaauuaacaaccuuuuuuuucuuuguuggcacauaaaguaguacguauuacaauugauagucuuuuagaauuugaaauauauauccagcccaugccuuuuuccugaacuuguauauaaaacugcuuucucggccgggugcaguggcucacgccuguaaucccagcacuuugggaggccaaggcgggcggaucacaaggucaagagaucaagaccauccuggccaacauggugaaaccccgucucuacuaaaaauacaaaaacuagcugggcgugguggcaggcaccuguagucccagcuacuugggaggcugagacaggagaauugcuugaacccggaagauggagguugcagugagcagagaucaugccacugcacuccagccugaugacagagcgagacuccaucaaaaaaacaaaacaaaacugcuuucucagcaucuaucaucuuauaucugauaagcauuucaaacugaaucuaucuaaaaaugagcucuccccugccauccuguuuguggcaacucugucauuccaguugcuuaguccaaaaaccucuucuuucucucauaauguauaucugauccauuagcaaauucuguaggcccuaccuuuaaaauccauccagaauccauuuaccuucacugcuaccauccccaucucucaggggauuauggaauagccuccuguugucugucugauuuuaacaaaagagccggagcgacccugucacccucugcucauaaauucuccuguggcuuucuaucaacucagaguaaaacccaguauccuucccaugaucuauagggccucaugugaucuggucuucuacuaccucucucaaaccucauuuccuacccuuuuuuuccacuuaauucccuccucucugauuccaccuccaugcaacaugccaggcacacuucuuacaucaaggacuuugcacuuauucuucccucuaacuuggauguuuuucccuugguauauuauucugcaugucaagaagaauuaguuacagaauauucuuugauuauagggccuuuuguaguuuuugugguguguuguauggaaacauacauauagcuguauugaacauuguacaaaacaaauauuagaagauaauuuauauauuugaaagucuccaguaggcacacuuaaacccuucuuucaggucuuuaaucaaauguaaccuucucaaggaggacuuuucuggccucugucuaaauuuuuuuuuuuuuuuuuuuuuuuuuuuuugagacagucucccucuauugaccaggcuggagugcaguggugcaaucucagcucacugcaaccuccgccucccagguugaagugauucuccuaccuuggcuuccggaguagcugggacuacaggcgugugccaccaugcccagcuaauuuuuuuguauuuuuaguagagcgcaguggcucaugccuguaaucccagcacuuuggaaggccaagauggguggauugccucugucuaaaauuuuacacauuggccccacuucucuucuuagcucuauuuuuugaauucaacauuaucuaaauacuacuguauauuuugcuuauuugucuugguuauuaucuggcucuucuccuugaauauaauggggauuuuuguuuuaaucacuauugcuuacccaacaacuagaacaauaacucagauuuagcaaguguuccaaaaacuacuuuuuugaauacuuguuuucuucaccuuuuuuccuuuucagauuccauguguccuucaaagcccaguucaaaugccauccccuagaauucuuucagggugucugagcaagaaguuaucucuacaucucucuucuuguuucauuuuacauauuucuuuuaaagaauauauuuagccuuauaguuaauuuuucuuuuauaaaucauagugcuggcacugggcaaauaccuacuaaaugaagaaaacauguagcagaguuacuuuauaugauaguucuucuauuaaacuuuuuuuuuuuuuuuuugagauggaguuucucucugucaccaggauggagugcaguggugcaaucucggcucacugcaaccuccgccucccggguucaagcgauucuccugccucagccuccuaaguugcugggacuauaggcgcgugccaccaugccuggguaauuuuuguauuuuuaguggagacgggguuucacaaugcuggccaggauggucuccaucucuugaucuugugaucugcccaccucggccugcgaaagugcugagauuacaggccugagccacugugcccggcuuauuaaacuuuuuaagcuuuuuguuuaccaaaacuuuauuuauauaaaaguucaaaauaaacaugcaaauugacuaacuguagacaguccucaguuuuguuuaauccacacaguguuggucugagcaauggucuaaauuucuuagaugccaauauuuuaaaacugggaaauuuuuacuuaaaaaucucaaguuucagguuucccugggaaacagugaauguaucuggcagugccagccuugcaucaucacauaacaacaaucaucuaaagcugaguuauaaccauacucuuagaugagggacaugcuccccaguucagcagucccugucacucguuguugucuccucaacacugagagucuaaugacaguuaccacuauuguguggccuauuuaccucuuucauguuaccuuucuuguuccuaugguuauuucaguuugcaaccccagcuuugaaagaauauguccauuccuuuaaaaugaugguuaggugaauaagcuauuaucuaaaaagcuaaggugugaagcuugauuucacugaaauguuuucaaguaacucuuuuauuaauuugauauuagggaaaauuuugaguaacauuagaguuuaaaacauuaucauugguuguauagaugcuccuccuccuacuugggaacagcuggaaaaugggcugguugcugugcguacagugguacaugggcugguugauuauauccagaaccacagcaaaaaaggagcagaucagcagcagguaaggaagcuguuuaaaacuuagaguuaacccacuguggauaugccuuaaaacuauagguaaaccacuguggguauaccuacagauacaaagccaaaaagauaacaugaacauuuugagacucugaguauagaaacuguaaauuaccuuggcaugguuaacaguuuacugcauuaggcugauaacuuuaucugacaauauugacauuaaauaauccuuauugaucugaugucaugcuggggucagucuucacauuggauauggcagcauuugauggagaaaauggauucagugcugaaguuuauuccauuuauauaagauuauuauucucuuuaguuuguuuaacauuuugguuugacaauaaguaucacuuuuuagugcuaauacugugucuuuccaauacuguucaaauuucuauagauuuucuuauuaauauuuuaagauuuuuuucauucauaaugucuuaugccauugggccaaaucucccucaaaguuuuuagaugaaaauacgaugguagaauauaauaacuucuuauagcuagaguuuuaaauuuuauucccaguaauuuuauuuugcucucaggauuuauauuagguucauuagaucuuuuauuuugcaguaguaagccugugaacguaaaacucuuaauuuaccugguucagguaaauauaaauagguuacucaguauuccuuuuugcuuaagaggcaagaaauauaaaaauuauccugcuaaguaaaauaaucuggauaugauuuuccuaaccuaucuaacacaggucaaagcuuuauuuaugaauaggcauaaaagaaaggagaaccuacaguuuuuaacucucuguuucauuagacaucuugaagaaaauaacaagaguaaugagacuaaccuuuaaagucugccauauagugauaaaauacacuaaauuuuguccaguuuaguguugugucucauauuucauuaacuuucaaauccauccuccugccuuauccuugaguuauaaauaauaagugucauuuguacuuuuggaacuauuuuaaguucuucauauauuauucugcaugucaagaagaauuaguuacagaauauucuuugauuauagggccuuuuguaguuuuugugguauguuguauggaaacauacauauagcuauauugaacauuguacaaaacaaauauuagaagauaauuuauauauuugaaagucuuaaacuacagugguuuguuuuuucauuauaaaauguggaaaugggcugggcacaguggcucacaccuguaaucccaagcacuuugggaggcugaggcaggcggaucauuugaggucaggaguuugagaccagccuggcuaacaugaugaaacccugucucuacuaaaaauacaaaaauuagccaggugcggugguggacaccuguaaucccagcuacucaggaggcugaggcaggagaaucgcuugagccggggagguggaaguugcagugagccaagauugcgccgcugcccuccagcccgggcaacagaguaagacuccuucucaaaaaaaaaaaaaaaaaaaguggaaaugagaucauaguguccccaugagcuuuuucuuuuuccauauaauacaaguauaagaaugcccaugagauuuauucaagaauuuauauuaugcuacuuguuugagaauuaauaucaacauaucagaaaaauuaggacuaccuucuuuguuuuugcuuuauuuauauuuggacuuugaaacuucagacagaaugacuuuccagcacuuuugcucuugguaaucuaaauaaauaugugaauuacuuaucuagauuaucaagauccuaaaaugacaacacaaaauuuauguuuuuuugugggggguuauuacacaucuaauguuuugauuuugguuuuagccuccacagcauagcaaauacaaaacauacaugugucgagauaugaagcagagaggaggaugcccucguggggccagcuguacauuugcacacucacaggaggaacuggaaaaguaagugugaaagucaggagacuuuggaauaagguguaaguggaauaauucgcugacauacagaaauacagaaagaguagcugcuuuaucuuaaaugaauaggacauuuuuagaauguaacacagcuugaacauuccuauucugaaaaucugaaaugcuucaaaauccaaaaaugcuugaaagccaacuugacaccacaaguugaaaauuccacacuugaccuugugauggauagcagucaaaacuucaugcacaaaauuauuuaaaauaauguauaaaauuacuuucagacuauguguaaaagauguauaugaaauauaaaugaauuucauguuauauauuugggucuuauccccaagacaucuccuuauguauaugcaaauauuccaaaauccaagacaaauccaaaucuugaaacacuucuggucucaagcauuucggguaagagauauucaaccuguacauaauuuuuaaaaaugaaaagcaguuucuucagcuuuuauugcaucaugccuauagauaggaaacuauuuuaugauuagcuaaaucuaaaagugggucauuuucacuacaaaaaaaauuaaaauuauaauaauuuuaaucaauuuuaacuuaauuuaacuaauugcaugauguauuuccaguggaaaauuuugcccuuggcucaguuuaacagauucuuuuaaacuucaaggacaagauaauuucagggauguuaaauuuuucagcucauugaagaaagaaaggaaaaaccucuuaauuuuuuuuauuuuuauuuuauuuuauuuuauuuuuuaaaaauagagacagggucucccuauguugcccaggcuggucucaaacuccugggcuuaagggagccuccugccuuggccucccaaagugcuaggauuacaggcaggagccaccacacccaccgccucuuaauuuauuuauaaauccaauguaacacuuucauuaaauuugacaaagauaacacaauuaaaacugcaaaucuacugcaaguauuaauauuaaaaaucucaaaaauuuaaauauaauucaguaauacauuacaauagaugccaugucuaagggcauaacacccugaauccaccugagcucaucugaucucggaagcuaagcauggucaggcccaguuaguacuuggaugggagacuaccugggaauauugggugcuguagguuuuuuuuuuuaauauaaauaauauaauuuuuuuuuaaagaaaagaaaauagaugccaugacucugcaaaaguaguacaauauaauuaucacaacuuagaaaauaacaugauaauauccaaaaaaugccaaaggccuuugaauaaaauugaaugucaauuaaaaaucaaauuccagccaggcgccgguggcucccagcacuuugggaggcugaagcgggcggaucacaaggucaagagauugagaccauccuggccaacauugugaaaccccgucucuacuaaaaacacaaaaauuagcugggugugguggcaugcgccuguagaccaagcuacucgggaggcugaggcaggagaaucgcuugaacccgggagguggagguugcagugagccgagauugcaccguagcacuccagccugaacgacagugcgagacucugucuccaaaaaaaaaaaaaaaaaaaucaaaauuccuuaauacaacagaaaugccauacuuucucagcaugguaauaaauuauauuauaaaucagaagccaacauaauaguaugaugcuuaauuaguaaaauauucgauucacucucauuaaagucaaggauaaagcaaaauuuucugcuaguaauuaguaguaaaauuuucuaccacuguuauuuaacauuguggaaguaguagcuaauguauguaagaaagaauaacauagccauaaaauuauugggaaaaacuuuaguacuagaaacaaaagaaaugagaauuuaguaagauggcaaauuuuaaaaaucacaaacaugaauugcccucguguaaacuaaaaagagaaacauaaccaguuuaaaaauaaguuaaaauuaaggaucucuuccaggguguauauaaauugaaccaauaaauuaccuaggaacauaagagaaauauugaguaaauauacuguguucuuggauaagguuugaugcuauaaaaguuucauuuucccauaaacaacaaauuccaagaaauccgaauuuaaaucucaccaugaugauguuaagauccuaucaaaaauucauuuguaaagaauaaauagguacaaauagcaaggaaaauucugaaaauucuggaaguuuuagacaggaacuagacuaauaacuauuuaccuguauuauggacuacagugaauaaaagacuuuagucuuuugcguaggaauagauagauuaaugaaaugcaauagagaaucuaggaggaguuugagaugcauauaggagcuuagcauaugugcuaaagguggcauuucacaucagugaccaaaugaaugauggaaaauaacugucaccuauuugaaaaauagagcuggauucuuaccacaaucuuuauacuaaaaugaacucuagauguauaagagauuuaaauauuuaggaaggcaagaaaccacagaguaguuaagaggauuuuuguuuguuuguuuuuaguuguuaaauaaggaaagaaggaaaagauuuuuuuaagaacugcaacccagcauccauaaaggaaaagauugauaaauuugauuacauaaaaauuauaaaacuaagauaugguacaaauacaguuuuuuauaaaaagcuuggugaggaaaugacacacagagggcugauauccuaacauaaaaugagcucuuacaagucuguaggaaggagaggaaccaauagauuuauggaucauaaacauaguuuacggaagaaauacuaauggccaauuauccugugaaacuauguucaaucucacuaguuguuaaagaaaugcaaauuaaagcaacuuaguauuuuuggacuaccaaauuaacaagaccagugcuacccaguauuugaugagguuuugaaagacguuuuucuucaugaucaguaggacuuaaaauaguuuuagagagcaguaugacauaaaaauuucuaauuugcgugcucuuugaccucauucugccuuugcuuauuugguuauucacacagggugcaaguacauguucauaauuaucuguuacuuuuuuuuugagacagggucuuacucugucucccaggcuggagugcagugaugcaaucauggcccacugcagccucgacuuccaggcuccaaugauccucucaccucagccucccgagaagcugggaccacaggugcaugccaccaugcccagcuaauuuuuguauuuuugguagagacaguuuucccauguuucccaggcuguucuugaauaccugagcucaagugaauccacccaccucagccucccaaagugcugggauuacaggcgugagccauugugcccagcacauuauuuuaauagccaaaaaaaacccaaccagccuaaaaugaacugacauaaagggaugucuaagauuauuaaguggagggaaaaauuagcaguaauauaugacucaacugcugcaaauaauaaucuuauaugaauauaaagcuaauguauaaaggaacaauuccauauaaugauacacuagacuuucaacaauaauuaccccugagggguaguuuucuccccaaccucagaaauuugucaguuuugggaaacguggaaaaauagcauuauuacucugaugggguuuuauuuauuuuuuuauuuacuuuuuuuuuuuguuuuuugagacagggucucgcucugucgcccaggcuggagugcaguggcacaaucucggcucacugcaaccuccgccucccgggcucaagcaauucuccugucucagccuccugaguagcugggacuacaggugccugccaccacacccagcuaauuuuuguauuuuuaguagagaugggguuucaccauauuggucaggcuggucuugacuccugaccucaggugaucugcccgccucggccucccaaagugcugggauuacagguaugagccaccgcgccaagccgagguuuuauuuuucaaaauaaaaaugcauuagcaguuguaaauggacuugcuuucauuguugaggaacaaagauccuggagucugauggcuuauauuuuuuccuuugguuagauuucagaaucgaugugcuuguuguaccacagcaucucuuuaaacccaggcaauuauucuguauugguuccauuaaccuacuuuuaaaauaacuuuaauuuuguauuggcauacauaacaucagcaucucugaagcaguucuaauaaaagucacuauccuuaauugcuuaaauuuuuuuuugaaacagggucucacuguguugcccaggcuggaguacaguggugcaaucuuggcucacugcaaccucugccucaggcucaagugauccucccgccucaaccucccgaguagcugggaccacaggcaugcaccaccacacccgguuaaguuuuuauauuuuugguaaagacaagguuucaccauguugcucaggcuagucucaaacuccugagcucaagugauucgcccgcuucagccucccagagugcugggauuacuggugugagccacagugccuggcugcuuaaauuuuuuaacagaguaaaugacaaauguuucacagugcauacuggcuuuguuuuucuuuuauuccuaauuuuuuaacauuggcucauuguaucccaaggcauuugagggagagcugaaguaaaauauuucagaaacuaucuucuaaagauuuuucuacuagcuucuccaauaaguuuuagaaauacaaauguccacagaaauauauuauagcaaaaauauuaauagcauaauuuauaauaugacaaauguuacucuuuuuuuugagacagaaucucgcucugucgccaggcuggaguucaguggugugaucucggcucacugcaaccgcugucucccaggcucaagugauucuccugccuuagucucccuaguaguugggaccacaggcacacgccaccacacccagcuaauuuuuguauuuuuauuagagacggagcuucaccauguuggccagacuggucucgaucuuaaccucgugauccgccugccucggccucccaaagugcugggauuacaggcaugagccacagcacccggccuauguuacacauuuuuaugaggaauuuuauacuuaauaugucuugcugcuagagauuuuaugcaaaauauacacacugauagaguuaauguuucaagagagaauauuucuagaaaauaauauuaaguacauuuuaguucuugguuuugcuuuuauauuugcuuuuugauaugugccuaugcuuuuuauauagauuucguaaaaugaauaagcgccugguuccgagaagacccuugagugccucuuugggucaacuuaaugaggugggccugccuucagcagcuauccuuccagaugaaggugcaguggaucucccuagcagaaaaccuccugcucugccaaauggaauuguaucaacagggaauacaguaacacagcuuauuccgcgagggacagaccccagcuaugauucuagucugaaaccaggaaaaauagaucaucugagcaguagugcuccuggauccccuccugaccuguacgucauuuuucuaacucuuauuucaaaauuucuucuucauaaagucgaaggaagauagaauaauuaauguuugggauuuaaaaaaaaaaaacccugauuauuuuuuuuggccuuuauuuuguugcuuuuuuauuucccaugcuaguguuuuuuaagaaacaauuagcauagccaggcaugguggcacaugccuauaaucccagcacuuugggaggcugagguggacgggucacuugaggccagaaguucgagaccagccuggccaacaugaugaaacccauuucuacuaaaaauacaaaaauuagccaggcaugguggcacaugccuguaaucccagcuacuugggaggcugaagcaugagaaucgcuugaacccaggaggcggagguugcaguaagccgagauugcaccacugcacuccagccugggugacagagcgacagagcaacagagcgagacucugucucaaaaaaaaaagaaaagaaacaauuaacauaggggaaauaagauuuaaaaauugcaaauuuuguagaagggaggacuauuagaauaagugaguuucccaaauuguagcaaucuuuuuuacuuguaacaauuuaugcacaugagaaguauuuuuuaaacaacuuccauaauauuauucccuuaggcuagaaucuguuccuaagaguauuucugccuuaccugugaauccacauucuauaccuccaagggggccagcagaucugccuccaaugccuguuaccaaaccacuucagaugguaccucgagguucucaguuauauccagcacaacagacggauguuuauuaucaggauccucgaggagcagcuccgccauuugaaccagcaccuuaucagcaggguaacgauuuuaaauuuauauugcuaacuuuucuuaggaauuaucagaacuguucuucaggucagagugaucauuuacacaguagccucuuuaagauaaguaaauguauaaaugcauuuuuuaauacuuuggaaaaauugagauuuuaugauuaacuaaauacuaugaaauaaaugaaacaaaguaauaaaaaucaaaccgccauaucuacuaaaagcaguugcauaauacauguguucauauauaauauuuauggaaauaacaaguuacacaaguaggcaauggaaauuugcugaguaaggcagcauauauucuccugaccaaaauuuucuucaagcaugaaaaaagaauuaauauuauaguguguguaaauuaaacacccacaguacauuuuucuucuuuuaauuauuauuuuucugggcccuguaauauauaugaaaaaaugcagcauacacaccuuuagagaguuuacagaauagaauaaauaaugguaaagaauagaaaacuauaugcaugaguaguagaugcaugugugugguguuuauguauguguuaaaaauuaagugaucuguugugguuaauauuagcuugauagagauugacugaaagacucaagggagaucauugagaacuugaggaaucaaaaagacuuaauggaagaaaugcccuagagguauuuggaauagaaaaaaaaaaguuaugaauggauuggaaaaaugagaguugaguuaggaggcuguuaauccuggugugaguacugacgaauuaguguggugggaaaggagaagaagggauuucaaaaauagacaaauuugaaaauuagccagcuuuaaugauaauaccagguauggagaaugaaggaaagaaaauaaacuaacguuuuacauauauaguuuauauguaaaauaaacacugaaugauuuuaaguguuggaucucucugucagaagcaguauaguacuauaauuuuuaaaaugggaauagauuaaaagugcugucuucuuuuuccgagucugucauuuaauuuugaaucauguugucuucucuacauucauucaugagaauguuuuuuaauugauauggcauuacuaauucaugcaaaauaugauaaaacgugauuuguaucuuccuuugaccauccauuauaggaaaaaaugcaacucuuuuuguagccuguuuucaauuuuagguaaauuauuuuagcuauauuaagcagaaagagauuuagugcaggaguuaggugccugccauauugguggagguacuaaagaagcaaacagugcuccagaguuagcugccaagagaacuuguuacaaugaagaagcaguagaaguagaaacuucuguccuaacugcuuaauuccaagaucacgucauuugaggcaaaaguuggaaaacugagaaacuauugccacaacuguugucucaagaacuguagagccaagcaguagcuacuaaucugcgccagcaaaauuggccuuuuguguuccaugucuccucccaguuauuucaguuucaaauucaaaacucaugcaagugauugauuuguggaaccugacuucaaggauaucugggaaauguaguuuuuuuguuuuccagugucuucauugcauuaagacacaccagaaagagggucaaacaaugagagccaaucuacuauuauagauuauaaguaggguaguuuuuucaaugacuuuuacagauaauuuuugcuuauuuuuuaaaaagcuaaccugauuauauaagcagauggaaaacucguaaagaaauaaguagauuaucaauacuuuaguguuucaguauuuuaaaagguaaaaucuuacauagaaaacuaaauuggcucauuauuugcuuuuggguccucuuuuguauugugcagguauguauuauacuccaccaccacaaugugugucccgcuuuguccgaccuccaccaucugcuccugaaccugcuccucccuacuuggaucauuauccacccuaccuccaagaacguguuguaaacucucaguauggcacacagccacagcaguacccaccuauauacccaucucacuaugauggccgucgaguguacccugcuccgucuuacacaagagaagagauauuccgagaaagcccuauacccauugagauuccaccugcagcaguaccaucguauguaccagaauccagagaaagauaccaacagaucgagaguuacuauccaguggcuccucauccaacucagaucagaccuucguaccucagaguaugcuguauuuuuuuuuauuacauagacuuaauuugacuguugcuugcugugauuccuuacuuuuuaugcaaugacaauaacccuuugaugaauucuuuuuuauaagagagcuucuuuuuuuuuuaaaucuuuucauaauuuggguauuuuuuuuuuuuaaacuauauaaugagaaaaaaaucugccuccuccccacaauuaaccuuucuuaguuucugaacuuuagaugguuuaauuaacaauucuagaucuacuugguaauuaugaccaaauaaaagaaaccuaaauuuagcuauuuggaagaucuugagaguuugggggguuuuguuuuacuuuguucuguuaaguguugguguuuccaaauguuaagaaggguauacaagcuguuucauaacuuaaaauauacgcugaguauauuaaaugaauuaaucuguccugaaauucucuuucaauuuuaacuaaucuuucuauuuuuaggaaccuccuuauagccggcuuccuccuccuccccagccucauccuagucuagaugaacuacaucgccgacgaaaggaaauaauggcccagcuagaggaaagaaagguuaucucuccaccuccuuuugcaccuucaccaaccuugccuccuaccuuucauccggaagaaguaagcaaaucauuuuuagucucauuuauccguguuuuuuuguguguguccgguuuaagucaucuuugccuauucccaauggugugaagauuuuuuuuccuguuuuccucugaaagguuuuuuaucauuuaacucuacaauccaucuagaacugauuuuuguauguauguaauguaaugcauuaggagucaagaucuuuuuuuuuguuccuguaaggcacugacucggcacaauuuaaugaaaucagcaugcuuucccugguguccugcuuuaucauaaucaggugaccacacauguguuuccugacccuauucuuuuccgucagucuauuucuauccuugaaccgaugccacauucucuucguauaguuuuauaauaagucucaauauguggugguuauauuuucuaguauuguuauuuuucaagaaucagcacguugauuuccacaaaaauaucugcuucaauuuugauuaggauuacaucagaucuguaaaucugugcuguccaguaugguagccacuagccacauguggcuguugaacauguaauauguggccaguuuaaguucagauguacuauagucaucaaauacacacugaauucaaggauuucauaccaaaaauguaaaauucauuaauauuuuugauacauuggauuaaauaaaauuauuaaaauuaauuucaccuguuuuuguuguuaauguggccaccaaaauguuuuaauuuuauauguggaucacauauuucuauuagacaguguugcuuuauuuuuauuuauuuauuuuuuugagacagagucucacucugucacccaggcuggagugcaauggcgcauuuuugguucacugcagccucugcuucccagguucaagcaauucucaugccucagccucccaaguagcugggacugcaggugcacaccaccauuccuagcuaauuuuuguaucuuuuuuuuuuuuuuuuuuuuuuugagucggagucucauucuguugcccaggccagaguacaguggugcaaucucaacucacugcaaccuccaccuccuggguucaaaugauucuccugccccagccuccugaguaacugagauuacaggcacgcaccaccacgcccgacuauaauuuuuguauuuuuaguagagacacgguuucaccauguuggccaggcuggucucaaacugcuaaccucaggugauccucccaccucagcuucccaaaguguugggauuacaggcaugagacaccacgccgggccuagacaguguugucuuagaucaauaugaugagaagugacagcuuucuuuuuucugagacagaguguugcucuuucgccaggcuggagugcaguggugcgaucucagcucacugcaaccaccgccuccuggguucaagugauucuccuaucucagccucccaaguagcugggacuacaggcaugagccaccaugcccggcuaauuuuuuguauuuuaguagagacgggguuucaccauguuggccaagauggucuugaucucuugaccucaggugaucugcccgucuuggccucccaaagugcugggauuacaggcaugagccaccgcgccuggcugagaagugacaucuuucuaauaucaagucucuaugaacaugauauaccccuucauuuauuuggauuuucuuuauacuucauacuucagugucuugcgcgucuuacauugaauuuuauuccucgauaaccaauguuuuuugaaacuauuuuaaauagaauuguuuggaaauuuuuauuuucuauuauuaauauagagaaauuaaauagauuuuuauguauugacccuucuauucagcaggcuugcuaaauuucuuuauuaaucauaauaauguuaguagauucuuuugaauuuucugugcacacaauuauguccucugaauaaucuuuuuccccuuuuuaauccuuuuguuuugucuuugucuuauuauuuuggacuccagcauaauacugaauagaagugaugauaacacauauucuugacuccuuucuaaucuuugaguaaauggagcuuuuaauaauaauuuaccauuaucauguuugcuguaggcuucuugguagaaaaucuuuaucauauuuaugaagguuuucucuaauccuaguuucagauuuauuuuaaauaagaaagaauaucaaagauuuauuuaacucaguaaugaggaaaccagccagaaaaguugguuuaaugaauaggaaaaaacagguaaauauagauagugaaaaucagaaaaaaaaaacagucaaauaagauugcucaaaaaaaaaacugguuaauguaucacagggcaauaaccauaauuuggggagucaacuucuuuguauuucuguaugacaaugcuaguaguuauagugaauaaguguugucuuauuaucuuaaugucuagauggucuacagugauguucguuuuucuauuucuauauugguaauuuuuuuuugucaguccugcuagggauuuaucaauuuuauuugucuuucaaaaagccaacuuuuuuuuuuuuguuuugugagacagagucuugcucugucgcccaggcuggagugcaguggugcgaucucggcucacugcaaccucugccuucuggguucaagcgauucuccugccucagccucccccaguaacugguauuauaggcaugugccaccacacccagcuaauuuuuuuguauuuuuaguaaagaugggguuucaccauguuggccaggcuggucucaaacuccugaccucaaaugaucugcccgucuuggccuuccaaagugcugggauuacaggcgugagcuacugugcccugcccaaaaaauccaacuuuaaaguaaucguauuuguuuuguugauuguacauacugcuuuagcuuauaguuuguauuuuuuuuuuuaauaaucaaguaagguuucucaggauuacaguugauacuauguaaggaacuugucuugcauccuuuauguauagaauuaugauucuaaacauugcuaacugacaaaucaugaauaauaaaugaaaauugagaaguacaucacacauaguaaauaguaucuuguuggguauaugaaggaagucuacuaaauagaaguuguucacaauaucuaguuuucucaucuaaacacuuuggaugaguuuuccacaaaaauguagguuauuaguaaagucacaacaucuucuauuaauguaguuuuauuuguaaaguaaaaacagccaggugugcauuagcucacaccuguaaucccacacuuugggaggcugaggugggaagauugcuugagcccaggaguucaagaccagucugagcaacauagugagaccccaucccuacagauuuaaaaauaaaaaugagcuagguguggugggacacgccuacagucccagcuacuugggaggcugaggugggaagaucgagaggaucgcuugaaccugggagguccgugcuauagugagcuaugauugugcuacugcacuccagccuggguaacaaagacccugucucagaaaaauuagagggggggaagaaaacaggugugauauuuuuucaaaaauucuuuauuagaguacacccuggaacuuuguuaugccauauuguuuuauaagaaauauggaaaacaauaugacauuguaaaaacugagcaguuuuugguaucaaacauucuaaacuuugagguucaguuguguccuucacugugugaucuuuuuaaaauuacuuagccucccugaauccugaggugcacguuucuucauuuauaaaucaaacauaauaaagccuaccucauagugguguggugaagaugaaacauaaggcaucugguauguagcaggcauucaguaaauaauucauauuuauuauuguuauuuuuacuccuaauaaaaauuauaauaaugucugaguauuaaggaacauuaucuagaaucauuuuaguuacugagaugcaaagacauauauuuaaaccucaguucugauuauaaacaaccugaauacaaaaauuagccgggcaugauggugggcgccuguaaucccagcuacucgggagacugaggcaggagaauugcuugaacccagcaggcggagguugcagugagccgagaucgcaccacugcacuccagccuggaugacagaacaagacucguucucaacaaaaauuuaaaaauaaauaaauaaaacaaccuguguauaguuguacuaaauucauacauuauagaaauacaugauauagaaagagaaguuucucgaaaaucucauuuucuauaaccauuuauuauguauuuaaacuucuuauauauauuucaccuucuuucugugcaugaacuaacaucuuuuuaguagacacauuauaauuguacaaguuuaugggauacagagugauauuucuuucuuucuuuuuuuuuuuuuuuuuuuaauuuuuugagguggaguuucacucuuguugcccgggcuggagugcaauggcgcgaucucggcucaccgcaaacuccgccuccuggguucaagugauucuucugccucagccacccgaggagcugggauuauaggcaugcaccaccacgcccagcuaauuuuguauuuuuaguagagaugggguuucuccauguugaucaggcuggucucaaacucccgaccucaggugauccgccugccuuggccucccaaagugauauuucaauacauauauacaauaugcaaugaugaaagcaggguaauuagcauaucaucucaaacauuuaucuuuuauuuauuuugggaacauucaaaauccucucuuccuuggacaauuguguaugugauacucacugcuggaaggucaagguuacagaaaugcaggaugcuuccagagaguuucaggucacccuuugacugguagguagguagcauuuaagucauucagaacagucauccaaauuuucuuuucuuuuuuuuuucuuuuuuuuuuuuuuugagacagacucuugcucuguugcccaggcuagagugcaguggcacgaucucggcucacugcaaccuccaccucccagguucaagugauucuccugcuucagccuccugaguagcugggauuacaggcaugcaccaccaugccaggcuaauuuuuguauuuuuaguagaggcaggguuucaccauguuggccaggcuggucuugaucuccuaaccucagaugaucuagccaccucggccucccaaaguguugcgauuauaggcaugagccacugcgccuggccagucauccaacuuuucuuugaagaagagagcaguguuacauuuaauuguaaauuuuuguauuauguaacauuguaggaauaacauucuuccugugggcuaaauaaauaucuccuuaugauuuucagauuuuauuucaaggaaaaaugcuggguagaucuacuguuguccuugcuuuuuguaucuacaacauuguugacauaguguuuaucucaagauuccuuuauaaauuggccgggcgcgguggcucacaccuguaaucccagcacuuugggaggcuacagugggcagaucaugaggucaggagaucaagaccauccuggcuaacagugaaacccugucucuacgaaaaauacgaaaacaaaacuagccgggcgugguggugggcaucugcggucccagcuccucgggaggcugaggugagagaaugacgugaaccugggaggcagagcuugcagugagccgagaucgcgccacugcacuccaaccuaggugacagagcaagacuccuucucaaaaaaaaaaaaaaaagccaacaucucuuacugcaaacgugauguuguuguuguuguuguuguuguuguuguaugaagauugugguuucucuuuuuuuuuuuuuuuuuuugugacagaguuucacacugucgucugggcuggagugcaauggcgugaucucggcucacugcaaccuccgccucccagguucaagcgauucucccgccucagccucccgaguagcugggauuacaggcgcccgccaccacgcuuggcuaauuuuuuguauuuuuaguaggaacaggguuucaccguguuagccaggauggucucgaucuccugaccucgugaucugcccgccucagccucccaaagugcugggauuauaggugugagccaccacacccagccuaagauugugguuucuuucuuccucaaaucgaaaaucauuuuguugauauuccuuucuuuugucaaucuauccuagauacuuuccauuuuauuuugacuuucaagauccuaaguagaaaauuuuaaauguuucuguuuucuuaaaaaagagacagggucuugcuguguugcccaggcugguggucucaaacucgugggcucaagcaauccacccaccaugccccguccaaauuuuuuaugucauuuguaaauaaguaaauaaaccuggauggaauuggucuauagaaauaauggauaaaauuguauauaaagaucaguuuaugauguuaaaaguuuucuucaaaaaaacauaauuuuuucaaaucaggaaaaacaauccucucuucuaguuuuuagaaaauauauaguaaauuauuaacuguacucacccugcagugcuauagaaugcuagaaguaauuccuccuguguagcuauaauuuuguaucuguuaaccaagcucucuccccuucccuccccccauucccuuucuagucucucauaaccacaguuccacucucuacuucugugacucaacuuuuuagcucccacauugagugagaacaugaaauauuugucuuucugugccugaccaauuucacuuaaugugauguccucuaggcucaucuauguugcugcaaaugacaggauuuauuuuuuuaugucugaauaguauuucauuguauauauaccacauuuucuuuaucaauucaucuguugcuggauaccuagguugauuccauaucuuggcuauugggaauaaaacaugagagugcagauaucccuucauauacugauuucuuuuccuuugaaugaaugcccaguagugggauuguuggaucucuguauuauuauuauuauuauuauuugagauggagucucacucuguugcccaggcuggagugcaguggcaugaacuuggcucccugcaaccuccgccucccagguucaagcaauuuuccugccucaaccucucgaguagcugggacuacagucaugcaccaacacgcccagcuaauuuuuguauuuuuaguagagauaggguuucaccaccuuggccaggcuggucuugaacucccgaccucagguggucugcccgccucgaccucccaaagugcugggauugcaggcgugagccaccuugcccagccucauuauuauuuuuuaauaggaucauuuaguaaauacaucuugguuuuaugucugucuugccuuuguuuuuguuuuuaccuaauccauucuccuggccgucuuuguaugucaguauauaaauuuaucucauucauuuaaauagcuacauauaauacacuacagagauuuaaaaaaggagcacucuuggccaggcaugguagcucacgccaguaaucccagcacuuugggaggcugagguggguggaucaccugaggucagguguuccagaccagccuggccaacauggugaaaccccuucucuacuaaaaauacaaaauuagcuggguguagagguaugcaccuguaaucccagauaccugggaggcugagucaggagaauggcuugaaccugggaggcagagguugcgugagcagagaucaugccacugcacuucagccugggugacagagcgagacaccaucucaaaaaaaaggagcacuguaauugguaggucaugugguuuaaaaguuggcuguucuaucuaaaguuaguaaguagaagaaaaauaaaaaaggauaaaaauuuuuuaaauaguaguaggacaaagaaaagggaagagguuaugaauaauagagacagaagagugauugacaaugagugauauuagugagcagcagacccuaugucaaugcagaaggccaauaaugaugacucagaaaagagauguuuuuaguauagcgggaggcauagauccacuuaaaugaaccaauacaaaugaacacugauaccccuagauaucaguguauguaugucuugugauaaaaugaaagaaacauuaaaguuauaguccuagcacugcccuauacugguauagccuuggucauaucaucuguguugucuaucauggauuuaggagcuuauuagguaguauacaugaaaacacuuugaaaauguaaaacauuuuauaaaugugaauguugcaauuuuagugaaaauacauuagccuuagaauagcuauucuguuauuagacuggagaacuuaccuugagaagauaaaaauuagacauccuuuucaucucauugaaucaaccuaaggaacagaauuuauucaagauaugaauuauugcuauuaaagagauuucaguaaaaaguuacuacaucaucauguacuauaaaaaucaaaauuuuuaauguucuuguuuaccuugauuuuauugaaagaaacguugaggagggucuagcaaaacuauggcuugguacauauaugcuuaaauguuuacugaucuaaugaagaaaaggaugagcaaacccauaaaauccuaguuugauuccuggaaggauauugaaauaccuuuuuuuuuuuuuuuuuuuuaccuucugcuaagguaaaaaaaaaaaacaaaaaaaaaaaaccugaaagcuaaaaaucacucuucacuuauuuuauauuuuucauaguaguuuacaaaaaucuucuauuguggcacuuaaaaaucaaauaaucaucauuauguugcuucagcacgauguucuaagaaauucccugcuuucucugucuuguuacucauagacccauuuccuguuuuguuucuuucucuuuuuuuuuuuuuuguuuuuuuucuuucuccaucuguaguuuuuggaugaagacuugaagguagcugggaaauacaaaggaaaugauuauagccaauacucucccuggucaugugacaccaucggcuccuacauuggaaccaaagaugcaaaacccaaagauguuguggcagcagggaguguggaaaugaugguauguguaauagcuaagcaauaauuaauacaaauuaagauaaaccaaauaaauuuuuacccauuaccauuuaggcacaaauaauucagcuuugcuuaagaguuucagaccauauucuauacucugcaguugaguuaucuuuaaacaguauagguuuuugauucauuuagguguaaauaaaaauauuuuaauacuuaccgagacagagcauuuauuauauuucugugcaaauagcaauuucucaacaauuguuuauaacccagauuaaauuauuuuacauaauuaauuaagaucuuggacuucuucaccaaauaaguuaaaauucuuugucacggagaauggcaugaacccgggaggccagagcgugcagugagccaagaucgugccacugcacuccagccugggugacaaagcgagacuccgucucaaaaaaaaaaaauuuuuuuuucacagcucugaaguuuaaauaacaaaguugaaucuagugaacaaaaguaguauuugagucagaauuauagcugcucagcuucaagugaaugcugagauacugaaauuuaauacuuggguuauuuuauucuuuagugaaaaaucauguaacaccaguguuucuaauaaccaaguugaaaauauuaucaaaaucuuaucucuuuuuuugggggggggauggaguuucacucuuguugcccaggcuggaguucaauggcgcgaucucggcucaccacaaccuccacuucccagguucaagugauacuccugccucagccucccgaguagcugggauuagaggcaugcgccaccacggccagcuaauuuuauauuuuuuaguagagaugggguuucuccauguuggucaggcuggucuugaacucccgaccucaagugauccacccgccucggccuuccaaagugcugggauuacaggcgugagccaccgugccuggcuucaucuuaucucuuuuuauagagauaggaucgaucuuugucacccaggguguagugcaguaacaugauuaugguucacuguaaccucaaacuccugaacucaggugauccuccugaguaccuaagacuacaggugcuugcuaccacacccagcuaauuuuuuuaaaaaaauguuguagagauggggucuugcuauguuuccagacugaucuuaaacuccuggccucaagugauccucccgccucucccucccaaaaugcugggauuacaggcaugagcuacccuaccuggauaguaucuuaauucccuuuuuauuuuuuaaagaaauaaaauuuucaagaaguaguuauaucccccuguauaaaucccccaagucucauuuuucucccuguuucauucccucuaaguaaucucuauccugaguuuaguauuuaucauuuucauggauaauuuuauuuccccuaagacaggaucucccucaugcuggaguacagugucacaaucacagcucacugcagccucacacuccuggacucaagugauccucccaccucacccucccaaguagcugggacacagaugugugauacuaugcucagcucuuuuuuuuuuuuuuuuuuuuugguagagaugaggucuugcuauguugccuggguaggacaggcugguccugaacuccugggcucaagcgauucuccugcuucugaaagugcuguaguuacagaugugugccaguaugccuggccauggauaauuuuauacuauuccuaaacaauauuguuuuauauguuuauagaccuuauguaaauuguacacuucagcuugcauuuucauguuuucacuuagcauugcuuuuaagauguguacuuuuuuuuugagacggaguuccacucuguacccaggcuggagugcaguggcaugaucucagcucacuacaaccucugcauucuggguucaagugauucuccugccucagccucccgaggagcugggacuacaggcacauaccaccaugcccggcuaauuuuuuuguauuuuuaguagagauggaguuucaccauauuggucaggcucgucucgaacuccugacuucaggugcucugcccuccucggccucccaaagugcugggauuacaggugugagccaccacgcccagucuguauuuauaucuguagcucaggauuauugauuuuagcugcuuuuacgagauauucuguguaacugauaccauacaaugauuauuuuuuguauugguggacauuuaggcuauuucugaucuuucacuguuagguaugguacuccaacaaacauucuucaaacauucuuauguaugucuucacgugugugaaaguuacacuuagaaaugguauugcuggcuggguacuguggcucauaccuauaaucccagcacuuucagaggccaaggcaggcggaucacuugaggucaggaguuugagaccagccugggcaacauggcgaaaccucaucucuacuaaauacacaaaaauuagcugggcaugguagcaggagccuguaaucccagguacuugggagguugaggcaggagaauugcuugaaccugggaggcagagguugcagugaaccgagauugcgccacugcacuccagccuagacaacagagugagacuccaucucagaaaaaaaaaaaaagaaaugguauugcugaaagguaugccuucacuauuauucuuaacccauuuguccuuauuaacucuaacagagguuuccuagguuauuauauagauuuucauagauaaauacuuuuccaggugguuaagaaaagaccaauauuugcaauaaaaaaagauuuggaugcugauaaccacuguaaaugagugaagugauaucuaauagcauaaauacaauuauaugccagccccacccccccccccaaaaaaauagagaguuuuagaggaagaaaaagcaaaauaaaauuuuuuuuuuugcaguagaauuacagaagcauuguuuuuaggcuguaguaaggcucuuauuggaacgaaaugaggggaaauuaggcaggaaucuuugccuuguacuuggcuuucaaaaggaaaggguuauuauauuaaaguaacacgaguauuagcaaaauaaaacucauuuucuuaaaucaguaaagaauuaaaaaguuugggccaggcauggugacucaaaccuguaaccccagcacuuugggaggccaaggugggaggauuguuugagcccaggaguucaagaccagccugggcaacauagcaagaccccaucucuucaaaaauuuuuuuaauuagccaggugugguggugcacgccggucccagcuacuugagaagcugaggcaggaggaucgcuugagcccaggagguugaggcucacacaucacugcaguccaaccuggugacagcagaacccugucucaaaaacaaacaaacaaaaaguugcaauccaaucuagagguaauugaaaaccucccaaauaggugaaagaagucuaaccuaguauuucucaaauguuaaugugcauacaaacuauauauuugugugucuauauauauguguaacauuauauagggauaaauauauauuuguaugcauauauauauacuaggucauuauauauauauauauauuucuucaagauugaauuggcuuuuauuagugauugauuaaucaggaagcauuucaucugugaaauagaaagaugcucuaaugagcuaaacagagaaaaggaacaaaacucagauuaguuguuucaaaguuauuuuccuuauaggacuaaagcagaagggacuuaccaguucaaauugagugguccucuuaugauugauugcugugaaucuccuguuuuuuggaaaacuggcccauuuucaaguucaguuugauuuuguggcaucuagcauaagugauuacauucugcuuugaucuggugucuuggggcuuagugcgggagcuuaguccaaaacaguggccucccauaaauuuuaaaaauauauuucuuaggccaggugcaguggcuuauaccuguaaucccagcacuuugggaggcugagcuugaggcaagcuaagcccaggaguuugagaccagccuggucaacauagggagaccucaucucuauaaauaaucaaaaaaaauuagcugggugugcugguacaugccuguagucccagcuaccuaggaggcugaggugggaggaucacuggagcccaggagguugaggaugcagugagccaugagagugccccuacguuccagccugggccacggugugagacccugucgccccucaccucagagguuuaaaaaccaguguuacauaaaaacaaccaaagguaacuaaugauuuuagucuuaccaguaagagugcuguacucuucuuuaaccuuauuacagaucuagaaaaaauuagguuacagagcgaucugagugugggguaauuucucauuuugcuuuuuuaucagaauguggagaguaaaggaaugagggaccagcgauuagaucuucagagaagagcagcagaaaccagugaugaugaccucaucccauuuggagaccgaccaacagugucucgguuuggugccaucucacgaacuuccaaaacuauauaucagggugcugguccaaugcaggcuauggcaccucagggagcuccuacaaaaucuauuaacauuucagguaagaaucucagagguaagcugaccuaaaggguucauaaucuugacuuucagcauuaccccugcucuccauuuacuaucaguguuuuuaguaaucuugcaaggcaguaauuuucaaacuuuccauggaaucaucccuguaagaaagguaauauaacccagagaauuuuagguauauaaacugaaauuaaaugucuauaugugaagcuuuccuaauguuucuuccccacuccacccccaccccaaauagcuuaauuguuauuugggggaauaacauucucauuauacaguaauuuggaagaaaaacuacaaagacugaaaguucauuggggaagaaacaaacauauaucagcacccagcaucaugcugccugauauuuagaaaaacaaaguuaaagaauuuuaaaaaucuggacauuuaggguagauaccagauaccuguguaugcaauacgcugaugucuuucagauuaugaauaccuuaaaagaagaaucaaaucugugaauuauaccauaauaaaucauucucuuacagauuauaguccauauggaacccacgguggcuggggagcuucuccauauucaccucaucaaaacauaccuucucagggacacuucagugagagguaugagucauucuuuuuacuugaacaaacauguagaaaccuuuaaaauuaggcaacuucuuuuuguuuuucuggucaguaauauguuaacaaaaugaaauguuaaaauuugauucacacuuucuuucuaaccaaagggagagaauaucuaugucagaaguggccagucauggaaaaccccuuccaucugcugagagagaacagcuacgacuagaauugcagcaauugaaccaucagauuagccagcagacccagcuacguggacuagagguaccagccuagagagccauuuuauuccaauuuuugaaggguucucagagauuuuaaauaggaacuuuugaggcacugugaacaaaaaacuuuaaggucuauuucuuaggaguuaguauagguuucuauucuucaaagaauucaauacuggauuuagcucugggacaacagaaaacguaaaauuucugcuaccuaaaaauagaaaacagauuacguaaaauuucccaacaggagcuuauauucccugauggcacauuuaagguuuuuuuuguuuguuuguuuguuuguuuguuuugguuuucuuuuuuugagacaguauugcucuguugcccaggcuggagugagguggcgugaucucaacucacugcaaccuccaccuccuggguucaugcaauucuccugccucagccuccugagugguugggguuauagauguacaccaccauacucagcgaauuuuuuguauuuuuaguagagauaggguuucaccccuguaaucccagcacuuugggaggccgaggcaaguggaucacaagaucaggaguuugagaacagucuggccaacauagugaaaccccgugucuacuaaaaauacaaaaaauuagccgggcaugguggugugcaccuguaaucccagcuaaucaggaggcugaggcaggagaaucgugugaacccaggaagcagagguugcagugagccaagauugcgccauugcacuccagcccaggcuacagugugagacuccgucucaaaaaaaaaaacagaacuuugacuuaaaaaguaaaacauaguuccgguguaauaagaauaauaacacuuuucauuuacguaguucuguaccauuuaaaaaucacuaccacuuaucuuauuugacccuuagaauaucccugauauuuuaggcaggugguauuguccuccuuuuuugauugaaguauaugaguuucucagaaguugaaacacgaacccaagucuucauacuccagauucaguguucuuuccaucaugcugccugacacuuagaaaaacaaaacuaaagaauuuuuaaaaucuggcuggacguggugguucaugcuuguaaucccagcacuuugggaggccagagcagauggauugcuugagcucaggaguuugagaccagccugggcaacauggcaaaaucccuucacuacaaaaagugcaaaaauuggccaggcaugguagugcacgccuguagucucagcuacucaggaggcugaaggcaggaggaucaccugagcccagggagguugaggcugcagugagcccugauggugccacugcacuccagccugagugacagagugagacucugucucaaaaaaaaaaaaaaaaggaauuuuuaaaaucuuuuaagugccacauaaggaagacuagguuuuguuuauacaucauccuuuacguuggaacauauucuuugaauauggaaaacugaagacauucuaaugauaaauauauuguccuuucuggaggaaaaaaugguacuguuagaacauuagucugucuuucuaccauaaucuuuaauaauaaguaagccaucacuuuaggggggaaaaaaaguuauaagacagacuuucuuaguagacuuucuuuuuaggaagaccaguaggagauuguuuuuggaacauauagcuggcuugugccccuauguacgcaauuagauuuaggaauuuuaaaaaucuauguaauacuuagauuuugucugcuuucgccauugcuuauuuacauugauucagaacgucuugccgauuccugucauagaaacagaaugccauguuugcuuauggcaaucuuucguucauuaacuuuuuaaagauucagaccuucaacccaauaaggcauuacuccauaucuucaaaugcaugguuuuuuguuuguuuguuuguuuguuuuauauacuuuaaguucuaggguacaugugcacaacgugcagguuuguuacaugugguauacaugugccauguuggugugcugcacccauuaacucgucauuuacauuagguauaucuccuaaugcuaucccuccgcuuuccccccaccacaugcaugauuuuuuguuuuaaaguuuccaggagcauuuucuguccaaaaagacuaucaguauuauuuagaaacuugccacauauuuaacucaguacaguuaaaaguccuugccauuacugagguuucauugaaauaaguuauaggauuuacuucagagaaaauuaccauuaaaaacagagggggaaagaugcacaucuguaguugacuuguuuuucuuccauuuccuuuuuuuuuuuuuuuuuugagagacaaagucucacucuguugcccaggcuggagugcauggagugcaguggcaugaucauagcagcucgcuguaaucuuaaacuccugggcucaagugauccucccuaguagcuaggacuacgggcccacaccaccaucccaggcuaauuuuuugguuuuuuuauuuuuuauuuuuuguagaggcgaggucuugauauauugcccagguggaucucaaauuccuggccucaagugauccucccaccucagcuucccaaagugcuagaauuaaaggcacaagccaccaugcguagccaacuucucuuucaaaucagaaaauacaaggagcaauuuauacauaagaugaaauuacuguuuacuaaauuuaaaugucccuauuuuguuauuuuuuuguuugaaugguacucaaagagaacagcaccuuacaguugcauuauuuuguugcaaauggcugggugauaagcuacucaaggcuguggucuggaauugagccugguuauucugugcauggugugaaguguguugaguuuucugugugcuuggcuuuaugcacuaggcuguuaguaacaggcugguguugcagagggaggcaaacacccuggcaggccagucacagcccccaccaccgccaccuccaaaauggccugggaugaucucaagugagcaguugagcuuggaacugcaccagguggaaagggaaaucgggaagagaacacgggaacugaguauggugaguguuaugguggggaaagagagggaaggugaaaugaaaucuuucauguggcucuagaauuaucuagaggcacagaaucaucacuucaaggcacucugaugagugguuaauauuuaaaauaauucucaugcaggugggcuaccuuccgauuuuaucauucccuuccucauucucuugguuuggguguguucuuugucuuauaauucuucguuaacuuuuagggaaaacaagguuuuaaugcuucuguaauuuaagaacuuaauggaagucuuaaauuucuguuuagcauacugauuagggaagcaaauaggaugguguuuacuauuuugcaaugacaacauguuauauaaagauguauucaccaaauaacauucuaguuucauagccuuuauaaugaugaccuauuuuugcuaugagugauaugcaaucugcacauuguuuccuguauccauuauguaugcuuaggaaaaacuauauccauuaauaugcuuaggauuugcuucauagugcacagacauucauuuuaguaaauuuugaaucuuaggggcuuccucagguugcaugauaugauuuuuuuuguugcuuaguuuucauaaucuuucuuuuuuuuuuugaggcggagucucugucgcccaggcuggagugcaguggugcgaucucggcucauugcaagcucugccucccggguucacgccauucuccuaccucagccucccaaguagcugggacuaggcgccugccaccucgccuggcuaauuuuuuguauuuuuaguagagacgggguuucaccguguuagccaggauggucucgaucuccugaccucgugauccgcccgccucagccucccaaagugcugggauuacaggugugagccaccacgcccagccaguuuucauaaucuuucuaagcaaauaaauugagcaugcagguuuuuuuugcuuucaguaaguauguuaaagauauuuauuguacuuugguuuucuuuucuuuuuuuuuuuuuuuuuuuuuugagacugagucucugucacccaggguggagggcaguggcccaaccucagcucacugcaaccuccgccucccauguuccagugauucuccugccucagucucccgaguagcugggauuacaggugccugccaccacaccaggguaguuuuuguuuuguauuuuauuuuuuuuuuaguuuuuuuuuuuugaggcggagucucgcacuauugcccaggcuggugugcaguggcacgaucucagcucgcugcaaccucugccuccuggguucaagugauucuucugccucagccucccaaguagccaggauuacaggcaccugccaccacacccagccaauuuuuuuuauauuuuuaguagagacgggguuucgccuuguuggccaggcugaucucaaacuccugaccucgggugauacgcccaccucagccucccaaagugcugggauuacuggugugagccaccaugccuagccuuuuuuuuuuuuuuuuccuuuuuuugagagggagucucacucugucacccagguggggagugcaguggugcaaucucagcucacugcaaccuccgucuucuggguucaagugauucucccccucagccucuugaguagcugggauuacaggcgugugccaccacgcccagcugauuuuuguauuuuuaguagagacgggguuucgccauguuggccaggcuggucucaaacugaccucagcaguccaccugccucagcccccuaaacugcugguauuacaggcgugagccgccaugccuggccgccuuucuaggucauuguuuuuuucugagaaauuuuuuuucauguuagcuugaggcauugucugucuuauuguccagcuugguuagugagcaaguggauuguauucuguuauguuuuuauguaugucacucuuuuagucugccaguuucuuugguuauuuuacaaaauugaauaugauuucuggaucaucacuuuguauuaucuguaauuuggucucucccauuaacaccauuaaauagaugauaacugauuuuauuuccuucucuuucaaaggaaaaccaguguucucuggacaugaaaagcaaacugaauacaaguaaacaagcagaaaauggacaaccagaaccacaaaacaagguuccggcugaggaccuuacauugacauucagguaaagaaaaggagauugucguagccauauuaaauuacacacaaaagagaaacuaauauauuauccagucauaucagaaauacccucauaaauauaauuugauucuuaaaauaucauuauucuguguacauaaagaauauuuuugcggccgggcgcaguggcucacgccuguaauccagcauuuugggaagccgaggugggcagaucacgaggucaagagauggagaccauccuggccagcauggugaaaccccgucucuacuaaaaauacaaagauuaguuuggugugguggcaugugccuguagucccagcuacucgggaggcugaggcaggaggaucacuugaaccugggaggaggagguugcagugagccaagaucgugccacuguacuccagccuggcagcagagugagacacggucucaaaaaaaaaaaaagaauauuuuugcauaaaucuggaguuacaaaacuuagauccaagguugaauuaucuguuaauaccuaacaaaggaaaauuucugguuauguuuccaucuuccccuuguuuuuaaauuuauuucgaauacagccuuauaucuuuacauuauaaaaauacuauaugcucaauguaaaaaaaaagaaaaaacaaaaaauaaagucacucccccaucuuaaauauauuauaaaaaauuagcuuuaggaaauggaaaauuuuagaaaagggcaaauuuuaaaauugccuguaauuccaauauucagagauaacucuuguuaacauuuugguguauuauauuaucuuuccaguuuuuuuuuugagacggagcuucacucuuguugcccaggcuggagugcaauggcacgaucucggcucacggcaaccuccgccuccuggguucaagcgauucuccugccuuagccucucgaguagcugggauuauaggcaugcaccaccaugccuggcuaauuuuguauuuuuaguagagacaggguuucuccauguuggucaggcuggucugaaacucccgaccucaggugauccaccugccucggccucccaaagugcugggauuacagguaugagccaccgcacccggcucuuuccagucuuuuuaaagugugugggcauuuagccucuugcuaguuuuacaaacccagcacuccaucucccugguuuuuaauucagucuauccuauaucauccaguauuauucuguagauacggaaagauacauaucaacuaccaugaacaacccuacaauaaacaguauuacaauuaaugcuuuguuugcauaucuuaaauuauuuucuaaggcuauuuugaggcuuuugaaugcauaguccuaaguugccccccugaugauauauaacaaaaauuucuaaugcuuucagacuuggauuuugacuguuuuuuuaauucaugcacuaucuuggauucuuuuuuauuuuuuuuuugagauggagucucacuccgucacccaggcuggagugcaauggcaugaucucggcucacugcaacuuccgccuccuggauuuaagugauucuccugccucagccucccgaguagcugggacuacaggcgcgugccaccacacccggcuaguuuuugcauuuuuaauagagacgggguuucagugucuuagccaggcugguuucaaacuccugaccucaugauccacccgccucggccucccaaagugcugggauuacaggcaugagccaccaugccuggcuuuuuuuuuuuuuuuuuuuuuuuuuuugauaaaaucucauucugucacccaggcuggaguguaguggugcgaucuuggcucagugaaaccucugccucucagguucaagugauucuugugccucugccucccuaguagguuuuuacaggcacacaccaccaggcuaauuuuuguauuuuuaguagagacaggguuucaccauguuggccaggcugaucuccaacuccugagcucaagugauccaccugccuuggccuccgaaagugcugggauuauaggcaugagcucaaaauuauuucuuguaguagcaaaccugcuaaaucagggauaaguacucuucuuaaaggccagguaguaaguauuuuaagauacgggccuuacaguuuuugucgcaauucucaacucugcucugugguuugaaagcaguggauaauacguuaaacaaaugaccaggcuauauuccaauaaaacuuuaguuacaaaaauaugcaccugaaaaaaaaaauacgcaccuggcuagcuuuaguuugccaacugugugcuaaaacauggauaaggggcuguagauuaaaauguggaagccauuuauauauuuucaaucaugcuaaauuauauccccuguugauuuuauuguaguaaucauuuuucucucucuccuuuuucaaaauuuuaaaaugucagcagugauguaccaaauggaucagccuugacacaagagaauaucagccuccuaucaaacaagaccagcucucugaaccugucagaggacccugagggaggaggggauaauaaugacucccagagaucaggaguuacucccaguucugcuccuuaaaauaugaggaguccuacuuuuaucuucugcuccuaaucaguuugucgggcauagggguaggagaacgcauaacuucuaaacuuuuucucuuaagagcggucagagaaauccaggaaauucaccagaggcaaugugcacaaacaccacuacuaaaaacaaacccugcacauaguucacauuaaugcauuuuuuuaauuuaaagaaaaagaaaauuagcaguaucugcaagcaauucagauuaaauuuguuuuuguucugugaaugaacuuuauuuuaauaacuuuggacgccuuggauccagggcuuuaaaaaaaaaagauauuauauauacacucuguuugauuaauuguaugaucuuaaugaaguagguuuucuuguauuuugguauuacauacccaguguauaauuuguauaauuccucacccccaauccuuaucaauucucaccaccccauaaacuuaaaacagaccaaaaaugucagcuuucagagaauucuguggugcuugagaaacagacaguacuagacugaguuauuagaaaaugugcagcaaaccaacuuuucccagagcuguuauuuggaauucuuuaucccuuucuagaucacuagcuucauuggauacguauauuuuucuugacauugaagcuuuuuguuuguuugggaggguuuuauuucuuguuuuuauuuucaacuuuucaaauagaauuaccaauuuugaaguccucauuuucauauuaaggaucauuugcauucucuuaauauaaucagaaagcugauucaguguuuaauuagauuuaaauguugaucaagaauuaacuguaacuuacuagcacugaaaauacauguuugguguuucgccugcguucagcucaugguuggaaauuugaagcagugcuuuucaaauuaaacuuuugcugacaucauaggaugcuaaaaaacaaggacaaucaacuauguuuuaaaacugcaacauuugauuugaacuuaaaaugaauagagccacauuauuuuaauggauguuuuguuuuacuugugaacugauugagucuuaaggauaguuuaugaauugaucacuuguugcucagaaucauuaguauaaguagguaggaaauaguuugaagucauuuuucauagacuuaacuguccaauguugcaaauguuucuucaugaaaauauugaaaagaguaagguuuuuuuuuuuuuuaauucugcugcacauauucugaugccaugugucugugcuuaauuaacuaagacccuauaaaacguguuuaguggggacuguuugauauaguugcccucuccauuccucuauuugccugauuuuuuucaguuucccuuucuguauuuuacuacuaaauuagaaagcacugguuauguaauaaguuacuacauugcuuugguugaguaaaaacaagaguuuauauuuuucuuguuucuuauuuucuuaacccuuaacuccugcugaggucauaacaaccucagucuaagcucuguguccaucauacuguuaacuuaaacaaauggguggugggggugggaaggguaauacaguccugccauugccuaccaguaggagaguccaaacagaacacucuuuugaguagcaauuauuuaauuugcccagucaaggcaccguguuuauauacuauuucacauugaauuugauuaugcccuacagaccuggcuggucaaggauuugauauacacauauuggcuugggauucgagcuuucuuuuuuauuuaaauaaaaauuuauauauauauuauauauauacauauauacauagcuauaucuguauauauauuggguauguuuuaaggauuuuuucgcaugagcgcagcuguugcgauaaauugaccgauugggaggugguagaagcacugaaugaaggugaggcuuuuuuuuuuuccaguuuucuuauacauuugucuucuuuuuuuaaaaaaaaaaaaaaaaauauauauauauauauauauauauauauauauguaugcuuuuucuuuuuuuuuuggcuuuuguuugcuuuuugacuuuuacuuaaaacccuuuuacauuuccacuuuaaaugccuauuguuuauugggagaaggaaagaaacuuuuguaugucugacagagucccaagauuuuucauuucucugcauaacaguaaaaggcaacauuauuggccuccaaccuucuuuuuuuuuuuuuuuuuuuuuuuuuggagagggagucugcuucuguugcccaggcuggagugcaguggguugaucucggcucgcuacaaccuccaccucccggguucaagcgauucuccugccucagccuccugaguagcugggacuacaggcacgcgccaccacguccagcuaauuuuuguacuacaaccuucuuauaagcagauuuggacugaucuucuccuuuggguaugucagaucauccuaaauuuuagaagcaguugauucacuuuggaauucagaaugauucuuguauuagaagauaauuuguggguauuaauuuuuguuuaaguuuaaaauaaaaguaaagauucauuuuggauaucaguugaaaccccuuaguaacucaguuucuguuauucuuguucucauuuccuuuaaauacacuuguucuuggcuuuugccauuuugauucugugaaguaggcaggagcagggauuaauuuauacaguauuccuguucugaacaaaaccagaaaagucacuguauaaacuugacuuaaaauaguaucuuucucuuuucauguauuuucauuugggggaaaaaaaaucucuuuaauuguaaccugaauucaagcuguaccccuccaugguccuacacucuagagcuaaucugguugggcagaaaggcagaaggaugguauauugucccauugugccuauaauguauuuuaaauuggucauuccaccuuaccuaauggaaauucuugcagcuuuccuagugcucaucagcgguuuuaggaauucacuaacacccccaaaauuuguuuuuuguuuuuugcuuuuuuuccuuuuccuuuucucugugauaucaugagccuguaaggacaaauggcauauuugggcauaacugcuugacucuguaacuacuuuuuuaaaaucaaaauugaaaagguauuaauugcuucuggcuuuuuaauuuuuuuuuuuagagacaaagaugaaaccagauaggaaauacaguuuuuauguuuucuacuuacuaaaauauuaguuucuucuaaauauuacuuuauuuguauuucacuaaauuccaaagcaaaaaucagauaucugagaugaacaauuuugaauggguuaagguaggaguaauaagcauuguguucacucauacauaggugagggaauuuuauuuauagcgagaaauauaaaaguauuuugacuuacucuuuuuucaaggagucgcuaggaaaggguagaagaacugagaauaagacaucuagauuccauuucugguuuauauguagcucuuuugccuaauuuauauauaauuuugucauaagauaaguccaguaacuguccugucuuagauaacguacagaggcugaagugaccaaagauccauuccuuauuacuuuucuaauuaaaagaagaguuagcuagauuucuaguaguaguauucuagauauugauaagacauuauuccuaaugccaacuacaaauauucaacuacucagaauguauuuaaaaaauuguuugguacagcauuaauguuggugauuccuuucucccaucuuauuucccuucccuucuauucuuucccauguauuucuuuugccuaaaagaauauugguaugauucucauuugcuacuuugaguauauaacuccaucagacuuuccagaguucuucagggauggagcucaaaguuuacauuuuuccauauaugucuuuuuuuuucuugaccuuuuuccacccuguaauuuccccuugacuuacccacugcccuccccaaucugcaacagugacaguuugcugccucaaaacagagcauucaaaugaauucgcuuagccaauaacuucugugaaguugccuuuucuaaugguguuauuacucagugaugcacaaaugugguauuugcccuacugguaggcaaacaaaggucugguuaagaaugguaaccugcuguuuucuuuaaaggagagccaaagacuugugcuuuacucuguuuugguuuugggggaaguaguagccauuuugaucaugaaaccuuuuaguauuugugaguugauuguacuguguaaguagauuuaucuaaaguuaacuguuaaaguuagcuagccuuauaaaauguaaaaguaaugaaaauucaucaguuucucuaagccagugaaugucgucuuuuguaauauuguguauaagcauuugugcccaccccagcuucugcuaucacuguggucaagucaugggucugaguaaaagaauucuugaguaugugacuggugagaaauaacuaacuauagucaguacauguacagauuguuaaaauucaagacaaaauacuuucacuaaaaaaaaggauucgucucaguaaagaaguauucaguugcugucacuuacauacaaauggugguggguagcagucucaccauuuuucuacucucuuuuugcucguuuuaaauaauugaguaaagguuuuauuuguaaaaucuaucuguaaaaagcaccuguaacgauuuauaugucauugaaaggaauggcccaguuacuuuuuaggagagauuaauaaccuaccuggaaauuaacugcaguguuuacuuagauuuuuucccccuaauaagagucuaaguguguuaaauuuuuaacugaugauaugguuacaguguugcaaggugaucucuuccccugaaaaaucugccuauccuuuuaagaaaaauuagaccuacuaaacuaaagcaaauuuuacuuucaucauuagcaccuaaacaagcaagcagucuacuacugucaucauuuuaccugagugcccauuuugcugauccacauucauaccuuucuaccuuggacagcuaugauuuuuauauuuauuuguugcuucagcucagguuuaugaaauuuuccugcugaaaugacuuauugggaguuguagguugauuauaguuacuauuaaacauuuucucaauuuagcuuuucugagccacuucaagaagaaagcuguuuuugucaaaagguacuauuaauuguagcaaguaaaucuuaagauuugaauuuuuaagauuuuauuucuguguucacuaaagaucuuuccacaaguaauagauuauaauugauaaguaauacuagcuauaguguuaauaaagaguaagacuaucaccaccaggaauaaguaacaccuuuuaauaauaaaucuauuccuaauagguauguuuucaauacugcacugaacaaaguggguaaagagcccuuugaaaucuuauuguaauaaagggacuuaccucaccacuggaauccuuguuuucagagccucuggauuuucagccaaacacugaauuucuccuaaacuuuaucccugaaacaucccuagagaacgaacuuuauuuucacaagaaaauaaggcacaauaagggggaagaacuuaaaccucaacauaauaucguguccaaaaauguguauuuagaaaaauaaaauccuguggaguuuguuauccuaauguuuauuuuauacuagauaaggugacuuguuuucuuguauugaggucuuacuguuucagauuuguuuuuguuucuguucuaacucuaagcagacagagcucacaagucuuuggcauccauuuuagguuguacacucagagucaucuuauaacuggaaacugucagguggucccccaccccagugaguguaugaaagagucaagaaaaagauuggaaacaaacuauugggugaauaauugguugcucuauuauuauuauuauuauuauuugccuuuuuuuaaucaccauuuauuuguguaaucuuucuccauugauuggcugucauucuuauaauaucugaacuaccccauaaaauaauucucugacuuaaaggcauuuagcuuuugcuuaucguuuuuacauccucuauucaacuaagacacugucuugagaguuauuuuuuccagauggaucguuggccuaaauuuucacacuucuccccuguucauccuuuuuccucuucccugcuuccugggaauaaaaggaacuuuuuuaaaaaaauuaauuaguccacaggucucauuaucuuucuuuaugauuaaucuaugacuuuuugguacaagaacaauggaaaaagugaauuaagguaaugaacaaaaccuuucacccacuuaaacauuuuccaguuuugagauuccucuucguguuuguggugucuuccccuuguuaccccuucugcccuuuuucucugacuaugguaauuuggucuuuaggcucauaucagucuccccgagacauucugcagucauuaucaccuuuuuggguggauuuuauuuuguuuuauuuuguuuuuuuuaaaaaaauaacuuuuuaacauuggugcauauuugcuugggauagagcuuguguaauuuaccaaucguauugauuguaagugauugugcccugcagagguauauuuaacaagacaaaaauaaucuugguuaauaaaggagcccaugagauuugagucagguuguaagugaaaucacuuacacuuuuggauagaauuuauacuccugcucuuauaaaucagugguagacuuaccauuuuuuaaaguuuucuugcauuuuuuuguuuuuuuauugccacagcucccuauucuuucuugccugccuccaccccccuguucaggaaaaaaaaaaauugagccuuaaagugacagcugauuuuuuaauugcugaauuuugugaaauuuuacuuuuuccaaguguuuccaacuuuaaaaagagaagugaagacaaauagguuggaauggugaagacaaauggauuggaauuucacaggcugugaauaauuccuuaggaucuggcaaaccgugaagucuuauuugaagaccuuaucuccugagaguucuuuuggaguaggaaaaagaacccuauuugaaauagaccguuuuucucuuguuuuuaaucuguuuaauauuucugauuuuuaagcagcuuucaaaacaagugugguggaaaaaaagaaauaguaguaggaagauguuuagggcagcagaacucugggucuaaauaaguacauguucccacuuguugccgauuuuugagaguacuagggccaucuuucucaauuuuguauuauuugugugcauguuuauaucaaagaugcccauuuuguuaaaaugcuauuuccuuuauuaccuuggaaacugacucagccucauguugcuccuaauuaguguuuaaggcucccaugaguugcagauaaaaugauuuauuuuaacaaguagaaggaggugauucaccuuuuggauuguaaauauaugaaaaugucuacaaggucuuuaucugcuuucugucagcauuuauauuaaaugauaaauuaaugaggaa

SEQ ID NO: 191156 - RNA, 33886 nt, Homo sapiens
gauaaguaaaaugacuuuuacuauugauaucaguuuuguuuaaucugaaacuauaaaauagagauauaucuaccuauuuauggauggauaauaccaucaucucauauuuguggaaugcuuuauaguuuuucaaaguacuuuuauucacuuuaucuuccauauauguuaucuccucugauuccagcaauaacagcccggugagguagccagggcaaguauguauuuuacacauuagcaggaagggaggcuaagcgagguuuauguaacuuacucaggcugaaacacugaagaaaaauuugugacucucauuucagugauguuuucugcauuauuaaaaaauauuaugcuacuccucacuauauuauguugaugguugaaaugucauuauaaagcuuaauuuauaugauucucuugaugaggaugaugaagcaaaugcuccaucaacucacuaguuuacaggggcaagcauuuuccuacauuucacacauaauuugauuaccucuguccuaagugaauaaucuacuaucuggguaugagaaacaugauuugaaaacacuaaaccacuauauuauuucaacaaagaaccaucuuucacaccuaaguaaaaaggaacuucaaaaaaaguccuaaccaaaaaaaauccaaaugaugcaugaaaucaagucaaaauuggguaucuuuuaucuguuucuucguuguggugaagaauguugccuggauuccuuccaucuaaagacuugauuguuagaccuguggcagaacucuagaucugacuuuagccuuggggaagcaaagaggacaaaaccuaaaagcucaacuuucugcaugguaugcaugauucaaugagcucuuucugcuuuggagucuguuggcuuggagacucggauaugauagggcuucaguuccucaggagggacagaaucugggguauugcucaugaggucauguccccggaaggacuuugggaaggcuaugacaucucugaugcuuggagauccagugacaaggcauaucagucugucuaacccugugaguaaaauacaaagauaacagaugagaaauguaaucuaauguuggaaauaacuuaguuuuucuauaaaaguuguagaaaacuuuuaaauaagaaucuuuaacaaacuguagccaaccaucguucccuaccuuuuuagagaacuuuuguuuguuugagagguucuuuucuaucucauucuggaaaaguauucaggacuaauguucacaugcuacuuggauugucacagcgauuaguguuccuaguaaaggcuuacuaaaggcccuaaaacagauucaacaguguauuuggugcuuggcagggaacuccauaaacacagaaggaagucccuguuguuggggccuacaaucuaggugagcuuccuagaauuucuuacucuuccuugcuuugacaaaacaagcaaagugaguaaccauggcaaucagaaggacacuggcaucuuccuguuuucauacaagcugaacauuauggagcagugcuuuccagacuccaaugagugcguaugugaggccauggggauuugaacaauauugacuuaagaucugcaguuuuaagcuauuaaugaucuuucaaaugcaaauuaucaguuaaguuauaucuuuauaacuguuaagauauauuuaaaaaauauauuacugaaauuucaacagaaacuuacauucucauggaacucuuggacucauccuuccaccucuaccaacacaaacugagaaccugaauuugagacagugcaauggaauucaguuuaucuuauaaaaggaaaaguuguuuaccuaaggcaauuccuccaugagggggugccccauaaucuaaagccuggagcagaugggagagcauuuucacauccuccugaaauucaaaagauaauucaguuuaaauauauuuugaagguccacuaagugccaccaucuaggcuuagaugauaaaggggaaacaaaguugaguuuuaaaacagcuaaaacugacuuaaccaauaauaaaaguuuauuggaaaaguguaaagaaaaaauuaccuuaagugauuugcagguuaguaagggaaaaagacaagucauagaugauuauaacauguacaaaaaugccugguguucaguaaaugcagcuuuuacuguauucacaaugcaaacagagugagaccaaaugaggagguggggauaaaaagcaggaaacucuccugucacagagaccaagggaagagagcauuacuaagugggcaacauugucaaaugcugccgggaggaaggagaacuuaagggccaagaacaggccacuggauuuagugaucuugugaguaacuuuuguggggcaguacauguagaaauguugaaaguguguuuggaaaugguucuccaaccaggcuacaaaucaggaucaagugggaagcuucaaacaaacagaggccaaagccuuaugcuuagaacucuuuuauucaguuggucugauguguagccaaggcaccaguguuuuuuuuaaugcuuuccaggugauuugauuguaaggugcagcagggcugagaaccacuauuuagggaagcaacagaaguaauguauucuaggccaggugugguggcucacaccuguaaucccagcacuuugggaggccgaugcaggcagaucaccugagauuggggguucaagacuagccuggccaacauggcaaaaugcuguaucuacuaaaaauacaaaaaaaaaaaaaaaugcugggcgugauggugugugccuguggucccagccacucgggaggcuaaggcaggagaaucacuucaaccugggaggcggagguugcagugaaccaagaucacgccacugcacuccagucugggugacaaagcgagaaaaagaaaaaaguaauguauucuuagugacucuugaaaaguuugacaaugagaggaaugaaaaaggcugaaaacugcugacuggaagcugggcugggcaggaggaucgcuugaucccaggaguuugaggcugcccuaaguuaugaucaugccauugcacucuagccugggugacagagugagacuccaucuuuuuaaaaucaaacaaacaaacaaacacacaaaacccaaugggugauuggaggcuuugaauuggcaggagaaaaguuaacagauuucggcugggugcgguggcucacgccuguaaucccaggacuuugggaggccaaggcggguggaucucuugaggucaggaguucgagaccagcccggccaacauggugaaacucugucucuacuaaaaauacaaaauagccggguguguuagugcgcacguguaaucccagcuacucaggaggcugaggcagaagaauugcuugaacccaggcggcggagguugcagugagccaagauugagccacugcacuccagccugggcgacagagcaagacucugucucaaaaaaaaaaaaaaaaguuaacagauuucacaaugcccuuaaacuuuaaggacucugaaggcuuaaagcuaaaggagucaucucauggucugaguucuccuuccauccuaccucacacuugucaguuaaucccacaaaacgaucuuuuaggaccagacucucucagaccuuuuccuuucugaaaccuacccaagccuucuacagcaucaccaacaaacuucaaauucuuaggucugcaccuguacagacucuucuuuuacuuuuaaaaaauccugauuacuccacuaucacuaaaauauaucccugccuuaaauauagcuaaaguaguaucuaauaagugauauaaaaucuuuucaaacuucucucucuuucucuaacauuaucaacauuuuuagucacuucagacugcaugguuuucauuugauuugauuuuuauuuuuucaagcugcaugguuuuuuuaagcaggguagugguuaggagcaugggcuuaagagccaccucaccuggauucaaauccugacucugcuuacuuuuguacugucacuuuggcaaguuaaguaaguugccucaguaaaucucaucuuuagagugggcagaauaaggauauuuaucugcacuauuauaauaaggguauuuaauaugcacuauuaauuaguauuuaaauaguacuguuuaauagugcuaugugccagauacuauuuaagcauuuaauauuauuauuuacuuuuaauauuauuauuuacuuuuccaaguccuacauuaaagguagagagauagcugaugcuauuuuguaucuugugaauccuccaaucauaacaaauguuuaauaaaauaggcugauuuaagucagaugcagugguucaugccuauaaucccagcacuuugggaggccgaggcaggaggagugcuugagggcaggaguuugagagcagugugagcaacauagggaaaucuuaucucuucaaaaaaauaaaaaaauuugccgggcaugguggcaugugccuguagucacagcuacuugggaggcugaggugggaggauggcuuaagcacaggagacugagauugcagugagcuaugaaugcaccaguagacaccugccugggugacagaaugucucaaaaacaaaacaaacaagcaaacaacaacaacaacacaaaacugaaaaauauucugguaaaaaaauaagcccaggauagcagaugauguuuguuaccuuuaguaagguugccaggauauaacgcugcagcucugcauugugaauucgaauugaaccaccuccuauuucauugccauuuaaaaccaagucauaguguuggcuacgggccuagaagauucacagauacuuuauguuagagaaaaugucugguuuucuguucuacggguugaagacccuguagauuuuuaaagacaauguauuacuacuaacucaaacuccacaauuucuucuggggcuuccagaacuggguccuaucuuucaucagaccuugaagucugaaguucuuugccuuuauauacacauuuccuuuugauuuggaaguauagauacgguaccuuuuugggcucaguguacaggagauguaugucacugggguggggagcaguaaauggguggugggccgauuccagcucucugggauuuuccuccuugggcaggaagagugggaaaucuaccacccaaaggaaagagaacagaguggggucacggagcaccacuccucuuguuucuagaaggucagcacauuccagucguaauuuuccuaacaaagagcacugcaaacagaagacguaaacauugaguuaacuucuugacagagcaggcaggaaaugacacagccuggauuccgaagccaggccauucucuaggaaaggauuagccaauuaacagauaggaugcccuuugcuucucaggacacaaagaucugaggauaagucuaauugcaacaagguugagaacaaucaucacacucaaccaacugggugaguacugauaacucggugauuaagaacacagggaucagcacuucauagaccugggucugaaucucaguguggcuaauuacgaacuucucuguacccuuuuucauuguaaaauugggauaaaaauaucaacuccaaaagacugcugugaagcuuaagauaauauacauaaggugcaggaccugacaaaguaugugagugguagucguucugauuauuuccucacuucucuugaaggguuguggugaggauuugguaagugccuggcacacuguuaauguucagugaaggcuggcuaucacuauagguaaugcagauuagagguccauuuaagagugcggaggggugcaguggcucacaccuguaaucccagcacuuugggaggccgaggcgggcggaucacaaggucagggguucuagaucagccugaccaacauggugaaaccccgucacuacuaaaaauacaaaaauuagccgggcgugguggcaugcacuuguaauccuagcuacucgggaggcugaggcaggaaaaucgcuugaacccgggaggaggcagagguugcagugagcugagaucacaccacuguacuccagccugggcaacagagugagaccaucucaaaaaaaaauaaaaaauaaaaaaaaauaagagugugaauuuuggaacccaacuucauggguuagaaauccggcuccuccacuuccuagcugugugacugugagcaaaauuuuaagcucugugacucacuuuucuuauuuuuaaaauagcaacaguaucagaacuucuuucauaggguuggcaugaggauuaaaugaguuaauguauacaaagugcuuagaacgggcuuggcaaauacuaagugcuuaauaagugcuaccuaugguaugcaggacuucccugagaaaggacagcugguuagaacagugacauaugccuagagacaugauaggguauuauuuugcagcccauucuaucuuacauuuacgucuacauaacggaccuucauugugacauuuucagaauguuaauguuauuccucgaaagucugguuucuagcucucuuucaaggaaggccuuguaggaaucagaccuauaacuuccugagaaugaaacaccagcauguuuaguucauaccaagagaagguuuaauagccaaauuaguuaggaacaaaaucccauguucuuuuuuaagaaaugcauucauaauaaaauuuggaaauaaauagcuuucuucauuuuacuauuguaggggaaggggagacgggggauuacauuuagcuuugaagcugaacucugaaacuuuuucuguggaagaaacaaugacaaaugaaaauauagauuagaagaaagaacuugaugaaguacuaguuagacacacuaucauuuugaaaaaacuauauacuaaagugaaaaaauaaauuuauaucaugcuugaucuuuacaguacauuuuuaauauucauauuugacuuuguacuauacuuuucuauauuuuacaaagaucccuaaagcuaauucagucuuccauauccccugaagaaucaugacucagccagugcaugauggcacucaucaccuacagcugcuguucuugaggaaaaagggucccacuuugaccaaguugguccaggggugucugccagcccuccagcucgccaguggucugauccgucccuccacaauuuacgaaugcaugauguauaaaaauuugagacuccuaauuuucuucauuugugaaaucuugacacugaaaauauuuuuucaugguuauaugacuaauuucacuaccccuuaaucuaaguggcuuuucuaauuagggucaggucuaaucuauuuaaguaaugccaauggaggcugguagcuaugaaaaaaaacccuuuuuuuuuuuuuuuugagacggagucuggcucugucagccaggcuggagugcaguggcacaaucucggcucacugcaaccucccccucccagguugaagugauucuccugccucagccucccgaggaacugggacuacaaaauacaaaaauuagcccgccaccacacccagcuaauuuuuguauuuuuaguagagaugauguuucaccacguugaacaggcuggucucaaacuccugaccucaggcgauccacccaccucggccucccaaagugcugggauuacaggcguuagccaccaugcccggccaacccuuaaguuuuuauacagugcauuauaaagcacuauaagauuuaugcaggcugggcacgguggcucacgccuguaauccuagcacuucaggaggcugcggcggguggacugccuaagcugaggaguuugagaccagucugggcaacauggugaaacccugucucuacuaaaauacaaaaauuagucggguauggcagcgugcgccuguaaucccagcuacucaggaggcugaggcaggagaaucucuagaacccgggaggcggagguugcagugagccaagauugcaccacugcacuccaaccugggcaacagagcaaaacuccgucucuuaaaaaaaaaaaaaaaagauuuaugcagagcagcuccauuuuaugaauuaacagucuacaguucaaacguauacuauauacauaggagaguaaggcauuguucagcaucaacagcacugaugcuuggaaguaauuuuucuuacugcuuuauugugcucuccagcaguuaguaggaccacaucuuccucuugggucuccauuagucugauuaauuccagucuuugugacuccauuaugaaauuagcaacuggagaauuccaguuucuauuggcguuaaggaauacagguaagauuuccuguguaaaagaaaaagacuuauucacguuuuuuuuuuuuuuugaacagugggauuaauuuaucuucuuauaauacaaagauuuccgguucccaauagaagagaauuuaaaagagauugucucuauuaucuccaugaacccauucaaaaugauacuaagggaauuuuauaaaguaggcuuggcacgguggcuuauaccuguaaucccagcacuuugggaggcugagguggguggaucaccucaggaguucaacaccagcuuggccaacauggugaaaccccaucucuacuaaaaauacaaaaaguagcugugccaguucugugcaccuguaauccuagcuacucaggaggcugaggcaugagaaucauuugagccuggaagguagaggaugcagugagcugagacugggccauugcacuccagccugggugacagagugagacucaaaaaaaaaaaaaaaaaaaagucauuucaacauaaugaaaaaaagggggaggggaugaagaauggagaauaauaucagcagaugagagauuucugcgaauuuuuggcagacugcaagugaacugaguaggaaugauuaaagaagcaaggugcaggaaggucuggcauaaagaacaauggaggcagccucagcacaagaaggaacugauuuuacccugcagaauucuggagaggcucaggacucuuaagccuugagugccuagagcagccuugcugcucaugcuaaacuaaaccuaaccauuuacaaagccucucucuugagcuuccaaccagcuuuuuuuuuuuuuuuuugagauggagucucgcucugucacccaugcuggagugcaguggccugaucuuggcucacugcagucugccucucggguucaagcaauucuccugccucagccucccuagucgcugggauuacagaugugugucaacaugccuggcuaauuuuuguauuuuuaguagagacgggguuucacuauguuggccaggcuggucucaaacuccugacuucaagcgaucugcccgccuuggccucccaaagugcugggauuacaggcgugagucacugcacccggccccaaccagcuuuuaaaaugccccuuucuugaauauguacagauaaccaacaaucacuguacauugaagaaacucugcagcauuaaaaaaaaaaaaaagaccaagauaaacccaaaaaauuagccccagagaaaacauaaguuauggaccaaaagagaacuugaauccucaaagguacucaaaaauauauuuuaugaauaaaaccagaauaagaugcagugaaaaaagcuacugggaaauaaaaaaaaauucaacagaagaguugaagaaauccccaggaaaauagaacaagacaaagaaaauggugaaaaaugacaugcaaaagaaaagagguuaaauugguuugacauacaacuaguagaaauuccaaagagagacuagaaaaaaugaugaggucaaaaucauuagauaauaaaauaauuuucuacacauaaaaagacauaaaccuucguauugaaagggcucuucaaguguguaacacauuaaaugaaaaaugaucaaaaggcaaacaaacucugaaauuucagaacauaaagaaucagaaggcaaaaagcuuccaaugagaaaaaaccagcucugcuauaauggaauaaauucacacaagcaucaaagcaucagacuucucaucaguaacaacagaugggagaagaaaguaaagcaaugccuuaaauguucuaaagcugugcugucuagcaaugcacuguugcuauuuacauuuaaauuaauuaaaaugaaauaaaguaaaaaguucagcccuuuaguuguacuauccuauuucaaguguucacuagcgacauuggcuagcaacaacuacaccgaacaaugcagacauaaaacguuuccaucauuacagaaaguuuuauuggacagcacucuucuaagaugauauggcugucaauucaaaauuuuguacuaagccaaauuauuauugaucaagugugagguuuuaaacauaaagacauuuuguaagaacucaguaaguugaucucucacaugcuuucuuaggaaguuacuugauuacauacuccaacacaaaaaagaaagaggaaaaccugggauccaggauggguggcuucaacucagaaaagaaugaagaaaagggccgggcacgguggcucacgccuguaaucccaccacuuugggaggccgaggugggcggaucacgaggucaggagauggagaccauccuggcuaacacagcgaaaccccaucucuaguaaaaauacaaaaaaauuagccgggcguggucgcgggcgccuguagucccagcuagucaggaggcugaggcagaagaacggcgugaaccugggaggcggagcuugcagugagccgagauggcaccacugcacuccagccugggcgacagagugagacucccgucucaaaaaaaaaaaaaaaaaaaaaaaaagguucagaaagacagcugugcagaagguacagaguaacuaggugaggucuguauaugugagccucaucucucaugacaggaaguuaacaagguuuaaaugaauuaaguaaaaagaaaaaaaaaguauguagagauauuuccaaaaacagagauacucuggcagaauacuaggauggauggggcaggcuagagcaaaugauuauugcauuucaucauuaaugguucuuuauuuuuugaaccauguguaugccauauguugcuaaaaacacauaagaucuucugaaagcaauuagaagccaaaucaaguuaaaacacucauaaaaaauaguaguaguaauacccauuucuuauauaaaaguucaggaaauuaggaaagaaaaagaaaacaggagaagagagagaagaaugaaagaagaaaauguaauaauagucccaucaacugaaagcugccaaaguuaaccuucaggcuuauuuccugguccuaugguucuuagaugcagauuuuauauacuaauaaaauaaaaauaaacaaaauuggaagauaaaggguugccaauuuuuaauuuuauaaagaaaagacauauuucauccccccgccauccccaccgccgacagagaaaaaaaggauaguucuuuaaauuuguuuaacuuuaugaaaagcuuguuauauugcccugacuuuucugauuuugucucaacccauuuugggaaccacuaaccugaucuuuuuuucuuauauaaaaaucuacuuauuguucguugugcuugagguaugaggcuugggaaauagugguaguagagguagguaguccauuuucaauauacaaauauaguguuuuuacaugguuauaaucaguauaaauauaguccuauagccuccuuuucuuacauaucauuauaagagcauuuuuccucuauuaagucuuagaaaacaagauuuuaaauaggaacuuuaauauuaauuccuuugauuauagcauaauuuaauuacuccuauaugguuucauuuuauuccuguuaucauaccuaagauucuuuccuuuuuuuuugagacagggucucacugugucacccaggcuggagugcgguggggugaacacagcucacugcagccucgaucuccugggcucaagugauccucccaccucagccucucaaguaguugggaugacaggugugugccaccaugcccagcuaauuuuuuuucuguuuuuuguagagacgaggucucacuauguugcccaggcuggucucaaacuucugggcuccagugauacucccaccuugggcucccaaagugcugggauuacagguaugcgcuuccgugccuggcuggauccuuuauuuuuuuuagagacagggucucacucugucacccaggcaagaaugcaguggcauaaucauagcucacugcagccuugaacuccugggcuugugauucuccugccucagucucccaagcagcugggacuacagacaugugccacuaugcccagcuaauauuuauuuauuuagagacugagucuugcucuguggcccaggcaguagugcaguggcgugaucucagcucacugcaaccuccaccuccuguguucaagcgauucuccugcaucagccucucaaaguagcugggauuacaagugagcaccaacacacccggcacauuuuugcauuuuuuuuuuuuuuugagacagagucuugcucugucguccaggcuggagugcaguggcacaaucucggcucacugcaagcuccgccuccugcguucacgccauucuccugccucagccuccagaguagcugggacuacaggcccgcgccaccacgcccagcuaauuuuuuuguauuuuuaguagagacgggguuucaccauguuagccaggauggucucaaucuccugacuucgugauccgccugucuugcccucccaaagugcugggauuacaggcgugagccaacgcgcccggccaauuuuuuuuauuuuuaguagagaugggguuucgccauauuggccagauuggucucaaacuccugaccucaagugauccgccugccuuggccuccuaaagugcugggauuacaggugugagccaccgugcccagcccaauuuuuuuucgagauggaaucuugcucugaugccuaggcuggagugcgguggugcgaucucagcucacuguagccucgacccccaggcucaggugauucucccaccucagccuccuaaguagcugggacuaggggugcaacugggcagcaugguggccugagccuguaguccuagcuacuugagagaaagaggcaggagcauugcuugagccuaagaaaucaaggcagcagugagcuguuauggcaacacugcacucuagccugggcgacagaauaagacuacaucuucaaaauaaauauauaaauaaaauaaaaaguaaauaaaagcagaagaaugaucugaaauaacaagaugcucaaaacuaaugauaaugauaguuuaguuaauaauaguuaaaaauauugaaucuguauaaggaaaaaaacugcucuaauuaacuccuuaccugauuaaaauggucagcugcaaaguuucuaauggauucaaugucuuuccuuuuuaaguauuucugaugaaagaaaaaucaaaguaaacuugucaguaugacacuuagcuucauaaacaugguuaugcgaucaaaugacaaauauauuuugugucuuucuauuacaauaguaagauuuaauaaaaauucaaugucugggcugggcgcgguggcucaugccuguaaucccagcacuuugggaggcugaggcggguggacugcuugaaaguugggaguucaaaaccagcccgaccaacauggugaaaccccgucucuacuaaaaauacaaaaauuagucugguaugguggcaggugccugaaaucccagcuacucgggagguugaggcaggagaaucacaugaaaccaggaggcagaggcuacagugagccgagauugugccacuguacuccagccuggguaacaaagugagauucugucucaaaaaaaaaaaaaaaaaaaaaaaaaaaaaaaaauccaauuucugcuaccaaaugacacauuuuuaaagcuuguuacagugcuuauuuuuuccaguuaugcagauuuuuuuuuuuuuuuuuuuuuuuuuuuuuuuuuuuuuuugcgauggagucuagcucugucacccaggcuggaguacaguggcgugaucucagcucacuaaaaccuccaccucccagguucaagugauucuccugcuucagccucccaaguagcugggauuacaggugcccaccaccacaccuggcuaauuuuuguauuuuuaguagggaugggguuucaccauauuggccaggcuggucuugaacuccugaccucaugugauuggccagccucggccucccaaagugcugggauuacaggugugagccaccacgcugggcaugcagcucuuauuggaaauagcugugaauguauuccacaggagacccucuauaucuaauaugcaggauaaauguucaacaugaaugucuacaacugaauugugaaagaaaacuuucagaucaauaaaaggauucagaauuugauuauuugagguuucuuaaaaucuuucuuuugaaauuaucucagugucuuucaagugagacauuaugguuaucauguuacauaacuuugaaaugauccaaacacuuaacaugguuugauguuuugggguguauucccccuccuuucgagagcaugauguuuuaucagauccccuaugugagaacuucgagugaacucccucuuccccccaggaauguuaccucaaaccuuaucauaacucccaugugugaauuacugaccucaacuacuggacuucaaaaauacauauaaacuuaagaguucgacagacacuuugauagcacaugcugugacuggcuauacucugucaacugcuucuccuacagccaagagaugggugauacccuguuagucuuggagcuaaucucugaagccucacccacccacacuggcacugcccucuagcaucgagggaccuuagauacaguguguacugugguggucaaaccagcuucucccaagaacagcucauauaagaguacaccucaaacuuuaauuagacuuuaccuuccccagaggacuacuuccauccuaauagagcaaguggacuuuaauaauuuuggaacucacucgcuaugugauuaaugcaccucagcuacugaguguuuucccugugaggauuguucauguuauucuuucuuuuuuuuugagagggagucucacucuguugcccaggcuggagugcagugaggcaaucucagaucacggcaaccuccgccuccgggguucaagcgauucuucugccucagccucccgaguagcugggacuacaggugcgcacaaccacaccuggcuaauuuuuuacauuuuuaguacagacgugguuucaccauauuggccaggcuggucuugaacuccugaccucgugauccgcccgccucagccucccaaagugcuaggauuacaggcaugagccaccacgcuuggcccuuauucucucucucuuuuaagcauugugaaccuaagaaaaaauuuucuuuguauggcaauaaaccaugugauuugugaaaucauacuuuaaccaucuuauuucucccauaugccacauaucauuaacuauauuaauguggcauuuaacuagguacggaagguauaaaaagaugaaaacaugauccacacuccugcaguucuuauaucuacuugagaaagaacaaacuugaaaugguguaaauaaugauaggcaaaauaucauacugagcuuaccugaacauauuucuuaugucuggacuagaguauggacaauaaauuacuuuuuuuuuuuuuuuuuuuaagauggaguguugcucuguugcucaggcuggagugcagugguaugaucucaugcucacugcaaccucugccuacugggcucaagugauucuccugccucagucucccagguagcugagauuacaggcacccaccacaaugcccagcuaauuuuuaaauuuuuaguagagacaggguuucgccauguuggccaggcuggucucaaacuccugaccgcaaguaauccacccgccuuggccucccaaagugcugggauuacaggcgugggcuaccgugccccgcaugacaauaaauuacuuuuuacugaauauaugaaguaaauaaaaaguaaugaggggccaggcaugguggcuuacgccuguaaucccagcacuuugggaggccgaggcggguggaucaccugaggucaggaguuugagaccauccuggcuaacauggugaaacuccaucucuacuaaaaauacaaaaaaaacuuagcugggcaugguggcauacgccuguagucccagcuacucaggaggcuaaggcaggaaaaucgcucgaaccugggaggcggagguugcaguaagccaagaucgcgccacugcacuccagccugggcgacagagcaagacucacucuaaaaaaaaaaaaaaaaaaaaaaaaaaaaaaaaagaaaguaaugagacugaguuccugaguucuuacuccauucugaauauaaugcuuauguauccaaaugaguauagacuuucaaaaucauaaucuuauuuaaaauauaacuggaauacuucuuaugaaauuauuuuuuaaagcagauguacuaccuacagaaaagagacguguaccguugcuuuagagucagcacuugcucagcccaaccauucucucucucucuucuacucccacuucuuccccuuccuuuuugcuuuuuuagcuccaucuccuuuuauuucccuguuauuagugcaacugagaugagaacucucagaagauaaagaaucaacaugcaauggccaugcuggugcugauacagggcuaagagauagacagacaacugaggcugcagacagaauacuacguauuauuuuaugcucacauauuauccacaaugaaguacaggaguacuucauagcaucauuuauuuauguauuuauuuuugagacacggucuugcuauguuauccagguuagaaugccguggcacaaucauggcuuacugcagccuugaacacuuugccucaagugauccuuggaccucaaccuccagaauagcugggacuacaggugugagccaccacgccagguaauuuuuguagagaugaggucuauguuccccaggcuggucucgaacuccugagcuuaagcaauucuccugccuugaccucccacaguguuggcauuauagguaugagcuacuaugccuggcugauagcauuguuuaaaaggggggaaaaaaaagaaaaaagaaaaacaccccggaucuggaauguaaacucacauucauaaaauuuuauuguucucuacuuaugguuuuagaaauacuuuagauucuguauaaaaauaccuacuuuuuuuuuuuucaaacacaguuuugcucuuauugcccaggcuggagugcaaugguaugaucucagcucacugcaaccucugccucccagguucaagcgauucuccugccccagccucccaaguaguugggauuacaggcacaugccaccacgccugacuaauuuuuuguauuuuuuaguagagaugggguuucaccauguuagccaggcuggucuugaacuccugaccucaagugauccacacgccucggccucccaaagugcuaggauuacaggugugagccaccaugcccagcaaaaaucccuauuuuuauuuaaaaagaauuguucuuucugaaguuuaaauaugacaguauuggacaaaguuacuuccaaagcauacauucuagagaaacauagaacuguacuucacuuacugcuccuucagggauacauauggcuuucacaguuccauggggcuuacuaagugcaucuugaagaaauccaaucucuguguuucuaaacacaucacugauaucuauaaucuggaaaauggguaacaaaaagagauaacuaaauaugaaguaauuuuuaucugaaaacauuuuacaaacaagauuuuaaagaagagaauagaucuugauaauuuaacauuuauagaauacauucaaagaguguuuaccauggguuaagcaauaugaccaguguuuuacauauacucauucauuucauaugagguuagcacucuuuauuaucccuauuucauagaugaaaccaagacacagaaauaaggaacuugcccaagauggcauagcuaguaaguggcagagccagaauuuaacacaagcagucugacuuaagaaccagauuaagauuccaggcucggcgcagaggcucaugccuauuaucucagaacuuugggaggcugaggugggcagaucaccugaggucaggaggucagccuggccaacauggcaaaauuccaucucuacuaaaaauacaaaaauuagccgguguggugguaugcgccuguaaucccagcuacucgggaggcugaggcaggagaaucgcuugaacccaggaggccgaaguugcagugagccaagaucuuaccacugcacuccagccugggcaacagggcgagacuacgucucaaaaaaauacaaaaaaagaaccacuauuccauauuacaaacgaagaaacaagaaguaguugaguuggcagcuguaaguugguaguuaugacuuuuuguguauuguauuuuuuucauucuaagaauugaccacugacuauucacagaccaggcaggaccaauuucuaaagaaugugcacugagaacugagauauagaaaugucacuagcauuacagggaucaagggauauugcucuuuaagagcaaacaaguagaggccugguaaugaaacuguucuauauaaauucuaccccugcuuuaaauacuuacagauaguaauaauuugaauaaacauugucauauguuugagcuuuuuauggaccaaggaaacuuaguaacuccuuggauuaaaaaaaaaacugaaaaggaaagaauaguuauuuuuucuuucaaguuaccauucauauccauauaaucaauaacuugcaaguaauaaaaacuuuauagcaagaaucucgcucuuggaaauggaucuuggaacaugaaagauagaaagcacuguauugcuaacaugcuauuauucucucuugcucuagcucuguaacaacgaagguaacaagguaacaacaaaaauaucaucuaacaguguguaacacuugucaauuucaaagugguuuaaaaagacugcaggauuauuuggggacagaguccuagaaaagugaagauaaguaccuucauuccaaagcgagugucagguuuaucaguuccauagguggccagcaccucagcaaaagucauaguaggaaaaggaacaaccacaggaucuuugucauugggccaggaauacuggagcaaacccucaauuaaacucuggaucccagucuggucuacaaaugacaucucuaugucaaucugaaaccaaaguaccauauggaaacuaauuuagccacaauauauacacauuuauauauuuuucugcuuucaaguuacuauagaauuuugcacauaauacaugcagaggguauaaauauuauuguacaucucuuuuaugucagacacugugcuaauggccuuacauacauuaacuugcuuaguucccacaaccauuucaugaaggcucagagaacuaaguuacuuauuugcguaugugcaauuaguaagcagcgaagcuacaucugaucccaggucuguccaacuccaaagcucauaauuuuuucacuucaacacaugauuaaaaugcuauuggccaggcgugguggcucacgccuguaaaccuagcacuuugggaggccgaggcggguggaucacgaggucaggagauccagaccauccuggccaacauggucaaaccccaucucuaauaaaaacacaaaaaaucagcugggcaugguggcacgcaucuguagucccaacuacuucggaggcugaggcagcugaauugcuugaaccugagaggcagaggcagcaaugagcugagaccgcgccacugcacuccagccugggagacagagcgagacucugucucaaaaaauaaaauaaauaaaauaauauaaaguaaaauaaaaugcuaucauacagaaagcaaaucguaacagcuuugguaaguccacauauuagauuaaaauaucaauauauaaaauuauucauaauauauaagagauuuguuuuaaggacuuuaucaugaacauuagaacacuuuaggaacuucuggcauuccuuaguugcugaccacauucuuuaugaaaaggacacaugcucguuuuggcagcacacauacuaaaauuugaaugacaguguggccccugugcuauccaaggaaagaaaaaaauuuaaaaaaggacacaugaaaugaauaaaaaaaaaagaauaauuaguuucucaacugcaggugaguuuaauuaaauaucugauggauaaaauguaaugagaaguaaaguauuaauacugcacuggucuugaaaauacuauuucaaaauaguaagccugaauuuuaagaaacaagugaauauaacuuuguaccugaguaaacucaggcugucugucuggucuugaaccuucaucucgauaacaucgggcaaccugaaaauaucuacaauugagaaauagcauuaauugaguuaugauucuaggaagacauacacacuuuuccccaaaaguuuaaagcaaugcaagcuauaaaacaaugauacuuaaaaaacguaagaagggccgggcauggcggcucauaccuauaaucccagcacuuugggaggccaaggcgggcagaucaugaggucaggcguucaagaccagccuggccaacauggugaaacccugucucuacuaaaaauacgaaaauuagcugggcguggguggcgugcgccuguaaucccagcuacucgggaggcaagggcaggagaaucacuucaaccagggaggcggagguugcagugagccgagauugcgccauugcacuccagcuugggugacagagcaaagacucugucucaaaaaaaaaaaaguaagaaauacuuuuauuuuuuaugaugcuuuaaucgaauuagacauacagcugaccuaugagaaguuaacuauucuauauauuguuuucaaaauaaacacuggcaccucuggauauucauguauuuagacuagcaugcaaaucaguccaugccagcucuuuuuauuaaaacauuuuuuuuagcccaugcuucuucauauauacucuuuugcuuuggccaaagugaaaucuuuacugugccauggauacacuugagacuuucugugcuaugccauuccaacucucaucuucaccugcugaaauguagcucuguccucaacgaucuagcucacaaaguuuucuauauuuccucaaaaaguauaauuuuaaagcucuuaacaccuaacuugcaaaucucaauacauuuacauuugguuuauaucacaguugguuuuauucauuauccuauucuggcuuacuagccuuaacaccuugagaguagaaccuauucuuuuuuuuuuuuuuuuaaauccccucucacaucuacuaccauagagcuuuguacauaguggccacccaauaaaccuuuaauaaaggaugacuauaaauuaugagggcauuuuauaaguauucuccaaacucucauaaauuuucuauccuucucuugagaacagagaggauuuuguguuuccuuuuuucccuuuguuuuucucuuuuccuuuucugacaacugcuagcauaaaaaaagcucaccugucuaaaccgccaaccaucagaaguugcuuaaacuguugaggacucugagggagagaauaaaacuuuccagguucccuggaugguacuaaaaacucuuuggcacccuuucaaagagagagaaagagagagaagacagauuauuaaaaaacaaaaacaaacccaaaguauaacuaacuaguagaaguuguuacuucaguuuaucaaugaaugacuaaagaacaaaguuccuacaaugacagagacaauuuccugcuuaucuuugagucccuaaaaagacuuggacauaguagacuuuaaacaccauuguauacgguagguguuaaguuuaugcuugcggaauugaauuuccaauuuuguuacuagaugaaugaauuuuguguaucauuuccuauccaaguaauucuuaauugcauuuccaaauuaaacuguaguuuuauaauuucauagacuguauaaaucgaguaacuauuaauguuuagaaaugucuuuuuuuuuuuuuugagacagaaucuugcucuugucacccaggcuggagugcgauggcacaaucucggcucacugcaaccuccuccucccagguugaagugauucuccugccucagccucccgaguagcugggauuacaggugccugccaccaccaugccccgcuaauuuuuguauuuuuaguagagacgggguuucgccauguuggccaggcuggucuugaacuccugaccucgugaucugcccgccuuggccucccaaagugcugggauuacaggugugagccacugcgcccggccagaaauguccauuuuuauuuauuaaaaaaaauuucuuuuugagacagagucuuggucugucacccagguuggagugcaaugguacaaucuggacucacugcaaacucugccuucuggauucaagcgguucuccugccucagccucucaaguagcugggauuauggguucccgccacugcaccuggcuaauauuuuuuuuuuuugagacggagucuugcucuguugcccaggcuggagugcaauggcgugaucuuggcucauuacaaccucugccuccuggguucaagcaauucuccugucucagccuccugaguagcugggacuacaggugccugccaccaugcccagcuaauuuuuuuuguauuuuuaguagagacgggguuucaccauauuggucaggcgggucuuaaacuccugaccucaggugauccaucugcuucggccucccaaaguacugggauuacaggcgugaaccaccgugccuggccuaauuuuuguacuuuuaguagagacaagguuucaccauguuggccaugguuggucaggcuggucucuaacuccugaccucaggugaucugcccaccuuggccucccagagugcugagauuacaggugugagccacugugccuggccgaaaaaugucaauuuuuaauauauaagagauuuguucuuuaaaauaauuuuuuuucuuuuccauuuuuuuuucuuuagggucuuuaagacaagagauacggucuuguugcccaagcuggucuugaacuccugggaucaagucauccuccuugcuucagccucccaaaguacuaagacuacaugugugagccaccgcgcccggccaauagauuuguucuuaaagaaccaauucauuggcugggcgcgguggcucacgccuguaaucccagcacuuugggaggcugaggcggguggaucaccugaggucaggauuucgagaccagcugggccaacaugcgaaaccccgucucuacuaaaaaaauacaaaaauuagccaggugugguggugcgcaccuguagucccagcuacuugggaggcugaggcagaagaaucacuugaauccaguaggcggauucaggugacagaacgagacugucuaaaaaaacaaaaacaaaaacaaaaaauaccaauuuauuaaugauuacaucuauaaaacucaaaugagacugaguaagguggcucacaccuguaaucccagcacuuugggaggccaaggugugcggaucauuucaggucagguguucgagaccagccuggccaaaacggugaaacuccgucucuacuaaaguaaauacaaaaguuagccgggcaugguggugcaugccuguaaucccagcuacucaggaggcugagccaugagaaucgcuuggauccaguaggcagagguugcaauuagcugagaucaugccacugcacuccagccugggugauggagugagacugucucaaaaaaaaaaaaaaaacaaaaaaaaaaacccaaaacaaaccaaaaaaaaaaaaaaaaaaaaaaaaacaaaaaaacucaaaggaaagaaaauuuauguggaauaaaaugauucugacucaaaauacccaaauaauuuucucaauucuucagaaaaaccuaguuaauaugaccauccugaggcaguaaauaaaaguggaccaagugaauauaaaagcaaaguagucuagcuuuauaacuaauaggacauuauuaauagacugauugaaggaauauacauaccccugggguccucuuaaacaauguggggguuucuauauccacaaacccuaaaaagagagaaacauuaucacuuaguagauaggaaugugaaauuugucauauaugauguccacaauauaguacaacaaaucugaggcuucccuuuaauuaagaauuuuagcugaaauaagcuaccaagccuacuggugcugguuucuacaaaucuaagaaggaagcugaagauuuucauaaauacuauucuguucauaaagcauacuguucacauaaaauaauucuaaauauuuaauggauucuugucuacugaacuauucugauuuuuuaaauguucuguuaguguagaaauaacacaaauauagcagaaaaaguccaggacugaaugagaugucuaguuuaauucacaugacauuuuugagcucccaauaagugauguaugcacaugauaaagaauuaagaaaacuggcuggguaucgugguucaugccuguaaucccagcacuuugggaugguuaggugggaggauugcuuaaacccagaaguuugagaccagccugggcaacauaaugagacccugucucuacaaaaaauuuuuaaaaauuggcugggugugguggugcaugucugugguccuagcuacuugggaagguguggugggaggaucgguuaagccuaaaagguugaggcugcagugaguugugguaaugccacugcauucuagccagagcaaaacuccgucucaaaaaaaaaaaagaaaagaaaucuuauagaaaaagccaaagggcuguccugccuuugaugaugaugggaaauacuauaauacauuaaucaauguaauagcgacuaucaucuuuaucaucuuuaaaauaauguuaacuuuucuucaaaaacuacauuacacauugagugaauuccagacuucuggcaacaucuugaccucaugcuaaggaaaggauacaauaaaacugcugaauaaaauagaagagaugcuacaaagcuccaaagagcauccaggcauuucucuuaccaugcagauuacagagauauucccgcauuuucaugaccaucugggaccucagucgcagguuauacugcauuuggaaacuacgcaagucuaaguagcgauacugcaaccgaagagccucuguuuucuaaagaaauugaaagauuuuuauauuuaaauauuuuucaauauuagaaagguauuaucuuuagaaagaguuugaauuuucaaaaauuuuagcucugucuuuaguuucuaucauuaaguagcccacuguaugcuguuaauuccuacaacuucuaaguuugucaucagugcagauuuuacauuuuuuuacuauucauuauuaauaauaucacucuucacugacugaaauuugccuacuuuacuaaacauuuauccauuaauuuaagcccauaguugaaucuugaaaaaaauuuaaagauuucaaaggucucuuagaaaaauacacagcaccauuaugcuguaucugggcaugguggcaugugccuauaaucccagcuacuugggaugcugaggugggaggaucacuugagcacaggaguuugaggccagccugggcaauauagcaagaccccaucuccuaaaaaaagauacaucagaguagaagauucaccugaaugggacgcugacuacaaguguaaagaaugcaaagggacaguggauggaaucuccauggcuguacuaguagaaauaguuugcuuauuuucucucucuuuuuuuuuuuuuuuuuugagauggagucuugcugugucacccaggcuggagugcaguggcaugaucucggcucacugcaaccucugccucccggguucaagcgauucuccugccucagccucccgagcggcugggacuacaagugccugccaccacgccuggcuaauuuuuguauuuuuaguagagacgggguuucaccacauuggccaggcuggucucgaacuccugaccuugugaucugucugccuuggccucccaaagugcugggauuacaggugugagccaccaugcccagccuaguuugcuuauuuucaaggcuacaaaucucugcaucccucuuugugcugaaaacuuaggaaaugucuauaacuucucuuuuugaaugcucaucuggggaaaacuauauauuuucuuuuucaaaauaaggucaacucuauaauuacauugcucuuucuaauuagauaauuaaguauugagaacuuaaauguaagaccaauuggccaugaacuuaaacguaaguauugagaacuuaaauguaagacuaauuggccaugaacuuaaauguaagacuaauuaauuaagacuaauuaaaaaucuguuaauagaucaguuuaaaaauuaggaauauauaagucuauaaacugugacaaagcugaaaaucauaugaguguacagcuccaucaagcccuuaaacuuuggcaaagaacauucuaaauuaugguaauccuauuuauauuuauaugcuugggaggucaagcguugcucuaagcacacauuuuaucacuuaauagauacaggauccccugucccaucuggccauuucuaagcuagacauaaauuuccuuucaaauguuaaacaauagcaacgaaaaacuugaauaauauaacaccucaaguuuuaaagagagaaucacauuuuaaucugucugaaaaaacagucuagguauuuagggacugcaacaguuuacugaacugucauuauuucaggacagugugccaagaaguuguagaacuaagagaacacuucaugaugugucuacaauaaaaugcuuaauuuuguagaaguuaaacuuuucuuuaaaaaacucugaaaauacuugacuagucaucaacauuuucuagauacucuauuuuauuaauaacagagguugguaccuucacgaaguucuuaauuucaaagggcagcuucuugcaggcauucagaagcucagcuguuuuaacuuugauuucaaucucaccuguuggcauuuucuuggagagugagaaggaaggguuuuaaaaauuacucaucaggauauacacaaaauacacauuuguagaaucuaugcauuuauuuacauauguaaaaugugcaaaguccuuauaguguauaguauaaaacauacaugucugugcaugauuuugacauucuuaugcauauguggcugauguguucagauaucaacaaaugucauggcauauccuugcagucugauacuugggaggcugagacaggaggaucacuuaagcccaggaguucaagaccagccuggguaauacugcaagacccguccugaaaaaaaaaaaaaaagggccaggcacgguggcucacgccuguaauccuggcacuuugggaggcugagaugggcagaucaugaggucaagagauggugaccauccuggccaacauggugaaacccucucucugcuaaaaauauaaaaauuagcugggcgugguggcaugcaccuguagucccagcuacucgggaggcugaggcaggagaaucacuugaacccaggaggcagagguugcagugagccaagaucacgccaccguacuccagccuggugacagagugagacuuagcaugcauauuuacauagauguguuuguuuauagucaagauuuugaaaucugucaguucauuuguagaauuuauucaacuuuagugccuaauguccagucauguguugccagaauguguacacagauggugcaaaugcauacaagcaaaaauuacacagauaucuucgaaacuaccuacuggauucucuuguccugcaggacgggaaaugacuguaccagacacuugcaccacagauuccacaggggcuucacauaaaaucuucuucacagaggcugccgacuacagaacaagggggaaaagaguucugagaaacaaaugaacuuacaggaaucuucaguaauuauaaguagaugguuuaaaaaacguuaauagucacagcuuaauuaccauaaaggcuggggcugcuccuuaaugacuuuauuaccaaauuuaguaaaaacugcauccccauuuugacucuauauaauacagcaaguaaaacuauuaguuaagagcuuuaaaaaaacuuuccuuaaaggaaaauaaggguaagaaugacuauuauuagugcaaacaagucccacauacuugaaaagcaauugucuccaggguuagucuuaggggcaguuaaaucccauagcaauaaugggucagagucaaaggaguucuccaggguuagcuauacucaucucuggauguugaucccuaaaagauaauucauugcucuuuauuuauuucaaaacuuaagagcugaauaaauaauauuuuucuuaggcauacaagcguuaguaaaaauugcaauagaaaccaacuuugcccaguaaguaugauggaaguucuuuauuuuaucuaauucuuuaauuuuaauuuuuuuuuuugacacaggguaucacucuggugugcacucuggagugcaguggugcaauuuuggcucacuucagccugaaccuccugggcucaggugauucucccaacucagccucccaaguagcugggacuacaggcacaugccaccacacccagcuaauuuuuuguauuauuauuauuuuuuugagauagagucuugcucuguugccuaggcuggaguacaguggcgugaucucggcccacugcaaccucugccucuggguucaagugauucuuuugccucagccuccugaguaguugggguuacaggagcccgccaccacacccggcuaaauuuuuguauuuuuaguagagacgggguuucaccauguuggucaggcuggucuuaaacuccugaccucgagauccaccugccucagccucccaaaagugcugggauuacaggagugagccaccgcaccuggccaauuuuuuguauuuuaguagagacgagguuucacuguugcccaggcuggucucaaacuccuguacucaaucugcuggccucggccucccagagugcugggauuacaggugugagccaccaugccuggccuugaauuuuuuaauuaaaaaaauuuuuuuuucagaauaucacucugucauauuuuaucuaauuucaaugguaauuaaauuaaauacuuuuuugagcaguaauaccgucacauggcuucaaauucaagggguacaaaaagauauaguaaaaagcuucccuccuauccuuguuuucaacgcccucaguuccuucccccagcagcaccuaauguuaccagauacuuagguauccuuccagagacauuuccuaacauauauacaagcaaauacacacacacacacacacacacacacugaauguauauucugcauccuucccccaguuuuuauacagaugacagcacuuagagugcuggaguuuaacagcugcucuuuuguauacucaagaauacaggguucuucacuuaacaguauuccuuggauuuuuuuuucccuauuagaauagaacuucuucauucuuuuuuguacggcugaguagaguauuguauuguaagaauauacauuauuuuuuaagccagucucuuauuggaggacaucugggugguucccaauuuuuuuccguuaaaaagaauccugaaaugaauauccuuguacauaugucauuuuauaucuguauaagucuagauauaagauaauuuaccagaagugaaauuaauggcucaaaggauauaugcauuuauaguuuugauauugccaaauugcucucccuucagcuagugccaauuuguacucccuccagguauugagcaccugcuuucccaaacacaguguguugucaaucuaauguguuaaaaaugacaauuacaugcaguuucaauucacauuucucuaccuaugagugaggcugggcauacuuucauuaugucuacaagccauuuauauauuuuuuuccucuaaauuuuuuguucguauccuggguuccuaauucuacugggucacuggucuuuuugcuaugucuuaacauugcuuauauuuuucaguuuucauuaacaauaaacuucugaauuuaaaaccucuaacauauucaucuaacuacuuagcuuaccccagcaauagcaucaaagaagcuuuuagauaauaacaggaaauuuucuauuaccucauccuggggaaugauaacuugaacaagcccaucgaaaucucuuaggaccaagaauguguuuugccugauuaauggggggggggaaaagaaacauuuuaagauaaaaucucuaaguccaaaguugaagcauacaaaauaaaaagcaaacaaaaauccaugcaauuuuucauguuucuuuuuuaugauaauuauaauuuuucauguuuuuuaugauaauuauguaccuucauuaguuacauucaugcaauuguuaucuauguagcucauugccaaaaaaaagauuguuuuuuauuucaguuucaauuuuuauugucuacuuaccugguauauuaaucuuauacagauggcuuauuaaugaaaaauuauuauagaugaacaauuaaaagaaauuucauuggcuuaaguccuuuuaagaaaauuuuauuaaauuuggaaacuuugcauauaguaaaauccaaagauaguauuuuagcauaauagaaacaucugauggaucauuuuugaaauauagcaauauagucuuuuucuaaaaaaagauacaaucuaacauuuucuggaagaguuccaacuacuaauuuaauaccucuaugaaucaucaaaaggucccagaaaugccaacauuuuaacauccaaccucuauuucucauacuauccucagcaucaggaacagguacagaaacccucuucagauuuggguucaggaaacagucacuaaacuuaugggaaaaauauccaccuacuugggacaaacuuuuuuuuuuuuccugagacggagucucguucuguugcccagaguggagugcaguggcgcaaucucagcucacugcaaccucugccuucuggguucaagcaauucuccuuccucagccuccugaguagcuagaauuacagacgagcaucaccccgccuggcgaacuuuuuuuguauuuuuaguagagacgggguuucaucauauuggcugggcuggucucgaacuccuaaccucgugauccgcccgccucggccucccaaagugcugggauuacaggcuuacacgccaggcugggacauauucuuuaagaaggucauauaaccuauguauuuugaaucucuuccaugugaauuaauguucuauucaggcauguucuggaauagagagaugaacaacaacaaaaaaugggcucugaucuuaaggaaucacuguuuauguuucuaggcuucuucucuaccuacauggaauaagaugagcuuuucccccaugcuauuggaguuuaacagcugguuuauaggaggcuggcccauuuuuaauuacugguuauaggaacucuucagucuuaguaagcccaguaucauuucaguccacugguggaucaagcuucguuguuauacccuucaacagauguuacugagauguaccuacugagaaugacauuugggucuuucaaaaugucuacugagaaugacacuugggucuuucaaaacuaaaacaaaguugaaaauucaguaaguucuuaauccugcaggaguugcaaaacguuuuauucuucggacugguuguaaauuaguaaagguuuggaauugcccugggaaaaccaccaccaugcauucuuagacugucuuucucaauuuaccuucgguacugaauccauccacacaaggugacuucuuggccuaagugagacgaacgcaacucuccacauguguugguccggacaacaaagcuacugaauucuuuaaaaaaaaaaaaaaaaagaaacuuuaaaaggcaagauuaaaaauacaucacuugcagguugcuuaaaaaugaaaauucucaaaauauaucuuagguaugucagggcuacaggggaaauuuauaaaauaaaauaagucagaguauguaauuuaauucauucacuauuaaauuuaccugcaaaugugucaaaagccaagugaauaacugaauguaaauuucugucuuguguuaggaaaucaaaauuuuuuugaucuucuagcauuugcauugaccuaaaauccuaauuacccaauucuuaauauugcacauuucuuccucaaaugaaauaggauuuuagaaacugcagaaauggacgguguaggaacuauuuagcuuuaguaugaaucuaguguuuaacagccacuuguacacuagaaaacacuauuauaauucugugaaaaaugauuuuuuuuuuuuuuugagauggagucucgcucugucgcccaggcuggagugcaguggcgcgaucucggcucacugcaagcuccgccuccgagguucacgccauucuccugccucggccuccccagcagcggggacuacaggcgcccgccaccacgcccggcuaauuuuuuuuuuauuuuuaguagagacgggguuucaccguguuagccaggauggucucgaucuccugaccucgugauccgcccuccucgaccucccaaagugcugggauuaacgacgugagccaccgcgcccggccgaagaaggauuuuuuuaaggcaucaaccaaaagcagaguauucuauauauuacgugguuaccuuuuuguggucuuucuaaaaacucagggaaaaaaaacugccguauaaugaauauaaugagagugaauuucgcuucuacacauaaggcuauccaguuaagaacaggggaaaagccgggcgcgguggcucacgccuguaaucccagcacuaugggaggcggaggcggguggaucacgaggucaggagaucgagaccauccuggcuaacacagugaaaccccggcucuaccaaaaauacagaaaaauuagccgggcguggucgcgggcgccuguagucccagcuacucgggaggcugaggcaggagaauggcgugaacccgggaggcggagcuugcagugagcggagaucgcgccacuucacucuagccugggcagcagagcgagacuccgucucaaauaauaauaauaauaauaauaauaauaauaauaaugggggaaaaaaugaaaaauggaauaaaagcucuccggccguagauaacaggcugaaguacuguucauaggauagaucucuucgcuauuuucaccuggaauucuccucugugaacucugcaacagacuucuguagagagaaccccagaucgguugggugguccuucugaugggucuggauaaaccccuguacagcugacuuaaccaagaagggaaguacauguuggagccacacgauggcgaaaaacaaucacgaaaucccacgcugccgguaguuaaaagucaguuuuggaaauacacagaaaucccuuaaaauuccaggaguucccacucucuucucgaauauuuaaggccuccuccgcacaacauuggaguacacgugucuagaaacaagacaaaucuccaaggucucuggggugcuugcugggguggagauaagggaaagaccucucccugagucuuaaagcaucagucugcacuucuacucaacaagucggcagccaaaagugacgacgagagagcgacuccacguagcggcgccaggcgcgagcccaagacaaccagaggcggucacaagguauacgcccuucuccucuuuccacgcuucucgagaggcucccgcggccagaaccggaaaacaaggaguaacagucgcguuucaaaucucgcagaccugcuggccgauuucgagucuucugaaagaggaaggcgagcaaagccaaaauucucccagagcgcgaacccaaacacagaucgccgcugggguccaagcgcccuucaacuccgcccgcua

SEQ ID NO: 191157 - RNA, 235418 nt, Homo sapiens
acagaauaauggcgucucguagccccaggcgacagcguggaggggcgggucugucgauuggaugaacgcagcugagauuacucccagccacuaaggacgaagagguggggcgguggcgucccacgccucgugcgacagugggcggggcuuuguugccugaguaaccguaugauggugguggugguggugucuuccugucucaacgauaccuauuuucuagugcugagauccugagacaauggugagugccaggggaugccagaagaacggcucugggguccuacuuacuuagcuuuccaagucuucgggcggaugggcacuuaaaguuguccgguccucccgaccuucuccccguuaucucuuucccccuucccacgggcuguuccugcagucuccucgcucuccguauuucuuacagcacccugaauuccacuaauguuacuaagucucuagaguaaugaaacagaaaauuuaggguaaggcaucgagucuaauaaccuguuuugaacaaacauuauguguuugcauuguucaucauggcauuuuucauguucacagauucacauuaacgcgcuuuauuaagaguauggggugguguguaugugacugucucaacacugaucugaaucucccuagaucuuggagucuuuuugcuuuucugaguggcagagcacugccccacgcccccacgagggccauuaacagguguauguuggaucagcgcucuucuauccaguugguuaccuucuaggucugugcuugcuuuucuuuucucuuuucuuuucuuucuucuucuuuuuuuuuuaaacagaaauuucuccugggauugcuuggagagcuucuggaauucacuguuugggcuucaccccuggaaauucugaaugaaaggaauggagcucgguauuugcauuuuaaauaagccuauagguuauuuuaauucaccccuauguuugagaggguucuaguuaauucacuuaacuaccauaucuuuuaagcacuuauggauaacggacuggaggauagaaagaucuuuagauaguuauagcuaugaauuuagaaacagagcccucacccaccaccccuuguuucuucauacuacucagcaauccuuuugguuaccccaguuuuccccugacccauucucugugaagacauuuucaaaccuucccuuuacaaacccugucuuuugcccucuucauuucuccuuucuaaacaugauggaguauaacaggccauuucuucaaccucaugcccccaaccuacacauugcucuauauuuuugccgagccuuuagucuuguauuucuaguguagagaaagggauauuaaaggauaauccauccaucuuugcucuugaucucauuugcuuccaucuguuacauuucgcuuccaguuguuuuuuucuuuccugugcguucagccuuuuccucuccaguuucuucucuucagugcucaagucacacaucuuaugaaaauuaaauaaagcaaaaccauguccuccauccuguguuuauccaguuauuuccuaguccuccuaucuaucaguaaacuucuugaaaggauauuauuuuuacuuauaucaaacagacaaaagucuucugucuggcuucuuuaauggcuucaagaaaguuguucuugcuuaaguuucuaauggccuuuuaaauaccaaauacaguaauuacuucucaaaauuuacauuacuuagucucuuugugacaacugagguucauagucauuaauuccuuuuacuggcugugccugguuuuugaaugucauucuuuggaauuaacuccuugauuacuuucauuucuuagucuagacauuuuccuugggugauuuuguccacucacauggauucuacuaacaccuuugauuuugcuucuaaauuucaauuuuccucucagaucuacuaaugccuaacucaguugcuucccggacacaucugucucaaauguccuucaaacuuaauaugaccaaaacugaacuugcuaucuuuccuccugguuucuccuauuuucaccaaguuaaauaaugcuacuacuauauuauaaccuaaacuagaaaucagaguuauccuacauuccucccucuucuauuucucccauauucaguuguucacuagaucaaauuuuaguuugucaucuccucauuucgugauuauuuuaauagugacuuuuacagucuggucuggaaauucuccaauccauuauuuucucugccacaagaaggaauuuuuaaaaacccaaccuguugauuuacucaccuccuuaaaacucuagauucccuauuuccuacaguaaaaugucuagaauggcacacaaguuccuccaugaacaagcacuuuucugucuagcuuuugccuuucccuuuccauacuuaaaaaaaaaaaauucucuugccuuuuagcuacuugcuuuucauugaacauaccaagcaacuucaaacugguaguaugccuccucuuucuacuuugcacuugcaauuccuucuacacagaauacuugcacccucuuguugcuugccaaacuuauuuauucuccuauuacaggccaacguguucuucuugcccacuucccagaaaggccaaacauugagaaugcaggaguugcagcagagaaagaguuuaauggaggcaaggcaguugaguggaaggaugggaaauauuucuaaaauccgccucccugacagcuuggaaguugugguuuucaaggauaauuuugugggcagguugguagggaaugggcgcugcugauugguuggggaugaauuuauagguguuuccaaacugucuuccugugcugagucaguugucuaggugagagucauaggacuaguagagucaguuucuugguaugaggcauguaucuggguggcaucaggagguuugccagaaugcagaagccuggaaaauaucucaagaccaaucuuagguuuuacaauagugauguuaucuaaaggagcaauuggugaaguuacaaaucuugugaccucuggcuacaugacuucugaauaguaagaaauuauagaaaagcaaggaacaguagcugguuauugcuuaccuaugccuauauuuuagcagauuuuaggucccucccauaguccuaaccuugcggccuucuauuagucuuacaaggcuguuuuagucccuagagggggucaguuuuggaagggacuauuaccauccuugcuucaaaguuaaacuauaaauuucucccauaguuagcuugccuaugcccagguaugagcaagggcaguuagcuuugugagguuagaagcaauauggagucaguuagguuagauuucucucacuguuauaauuuuugcaaagguggauucacuuccagacccaguguaggugucuuuucugugaugccuuccuucccuacucaaagaggguugagucgagucaggugcgguggcauauguguguagucccagcuauugaagaggcugaggucagaggauugcuugaggccaagaguucaaggccagccugagcaacauagcgagaccuugucucuaaaaaaguauaaauaaauacaaauuuaaaaucuaugcagauauucagagcuuuccccuccacacugugaaaucaagaaaaaaagaaaaagagguugauuguucauucuuuuugucaccauuuuauguaguauacaucucuccuauuguacuugccucauucgguugaaauuauuuguuuauagaucugucacucuuacuaaaaugugaacuguuggaggaauucaugcuuauguuguucacaguauugccuagaucauauuaggcacucaaauguuugcggaaugaauacaaaauaagaaagaaugcgcuaaguggucugagagaauacaaaguaauagggggcaaauuguacaauugagucccugcuucucagucagagucagaaaaguugucaugaagaaaauggaauagaauuucaauaguuagaauucuaugaccugugcaauggcauagggagguagaaagugacauuugcucaauacuguuuuugguuuuugccugucuuacauuauguuaucaaacuucccaggaaugcuaagggcaaugaaugaacuccuguucccacuccuccugccgggauugcaggcuggggcucuuucaaauuagguggucaaugaaggccucucuguggaaagaacuuuuauauugagaccugcauaauauaauacaaagugcagugaucuggaggaguccaggccacgcuaacaacaagaucaaauacccugaggcagaaaagagauugguauauuuuaggaacuuaugguucaauguaauaaaauaauagaaacuggguggugggauggugcagggguggcugcaguagggaaaauauggugcaaaauaccaugaaaugugguuagggagguaggcagaggccagaccacacguauacguacagcaguguuucucaaacuguaccugaugacucauuacucaaauuugugguauguagccagcauuaaaaagaugacauaaaauagcaacuuaacauauucacuacauguuguaaggguaacguucaugaacuuuuguuuaauuguauauguauuggauguguacuggauucugauguaaaauauauuucuuacugugaguccugauccacaaaguucaagacacaggguacuuugaauaauauauacuuuauuuguuuuaucuuauuauuuuauuuuuauuuauuuauuuuuuuugagacaggauauugcccugucacccagcaggaauguaguggugagaucauggcucacugcagccucaaccucccaaguucaagugauccuccagccucagccuuccgagcagcuaggauaauaggugugugccaugaugcccagcuaauuuuuuuuuuuuuucagagacagggucucacuaugcugcccagccuggucuuggaccccugggcucaagugauccucccaccuuggccucucaaaguguugggauuauguuuauguuagccaccacguucagcuaauauauaguuuaaaaggcaaaauaguugaaaucucaaggccugcagauauucuuauuccucuuuugaucuagugaaaauguucuuguuguauggcagauacagcuuugaauuaacgaaagccuaaaauuggcuagaguaaaauuuucaaguuucuuugugcauccagaucacucuccuccauauuugccaucaaucauuuaugagaaagaacaggccuaagaaacagaugucccuucucuguguucagucuagccacuguuguauguauugcagcaaaggauuauggccucucaauaagcagcugaagauggagguuguuugcucuguuggugaggcuuccugaccacugcaguuuaucuaaucagcuucugucuucaucuaguuuguuauaguugaggcuuccaaauucuggaaucaccuuuauauugugaagcagagauagggaaccauaguuuagcauguuucucauacaccucauuuaagaugaagcguaugcuggacucaucaauuucuuuuacauauuauaaagaggacagagaagguaauucuaagauauauuugacaaagauauuaauauuauguaucuucuaaaauauagcauuuauuagaauaucauuacuccagaugaacuguuaguguaauaaaggacuuuaaagauuauuagcuauguuccauaagaacuaaucuaaaccuuugaaguaaaaugucucaaaguuguuuguuuguuuauguauuuauuuauuuuugagacacagucucacucuaucacccuggcuggagugcaguggugugaucucgggucacugcaaccucugccuccuggguucaagcgauucuccugccuccaccuugugaguaacuuggauuacaggcaugugccaccaugccuggcuaauuuuuguguuuuuaguggagacaggguuucaccauguuggccaggcuggucucgagcuccugaccucaagugauccacuugccucggcuuccccaagugcugggauuacaggcaugagucaaaguuguuuuuaacagaguuuucaaagacaguuucauaauuacugaagaacaaaauuuuauuccaugaaaugaaaugcuuuucaguuuccaacuuuaugacguuucuccuaauagcuuuucugguuuuguuuuuagcaccugccuuuuuuuuuuuuuagacagaguuuuguucugucgacccggcuguggagugcaguggcgcgauuuccacucacugcaaccucugccuccuggguucaagcaauucuugugccccagccucccgaguagcugggacuacuggcgcaugccaccacgccuggcuaacuuuuguauuuuuaguagagacgggguuucgccauuuuggccaggcuagucucaaacuccugaucucaggucauccgccugccucggccuuccaaacugcugggauuauaggcaugaagcuuggcacccagacagcaucugcuuuuuagucauccagaauuccuuuuguuacuugaauugcugauuuggaagaauugcaguuccaaagauccacaggauuuuauuuacaaaaagugaaucagaaagcacagggcauaaauugcagauaugaaacucuuaaaaguuuauuuuccuauauauuguauuacaaaugcaguuuagagccuguuauauucuuguuuaguaggaaacagugguauuuggagaacggaauaguaagugguuaauauaaugccauaauuuuuuucauguagcuuuuuauuuauuuuugcuuuccuuuuucugccuuuuuauucccaauucuuucucauucaccaguuauucuucuauucgagaaaguauuuauugaguacuuuccauauacugguaacugguggguauacauugauuaauaagauagcacacaguggccccuaacucauggaauuuauggagaaaaacagauauuggaaaauaaauuacaaguauaaguuggauuacaaaagaaaaaugacaaggugagguggaaguuaguaauaaaauagagugaucugaacuagccugggguggugagggaaagucucuuugaugauaaaacucuuuaauuguuuuuuuccuuaguuugagagaaaaacaguuuacaugaauaaauaaacgaaugaugaccucauaugaugauaaguacuaugaggaaaauuaaacuaaguaaugcaauauugguugguuccaagagcaaguagccuugaguaggacaaucagggacgguccucaugaggaugugacuuuuaagcugagaugucaaugauagaaagcagcuugccaggugaaaccuaggagaagagcauuccaggcagagucaauagugagcacagaggugcauuagaggaacaggagggagauaguguggcuggggccuagggaaugagaggacagcuggaggagaagagaucugagaggcaggaaggagccaggaauacugagacuuauggaacuugggagggauuuuggauuuuauucuaaaugcaguaguauuauacaucuuauauauuuuaccuauuccaucaaaauauuuuauuuuccuuggauuugccuuaaacuuuugccauauuaauuuggucucuuggugcuuauuuuuaucuuaucuguaaaauuuaugaucuuauaagcuuugggaaauauuuuucugagcuucuuuugucuuugaacuucagagacuccuaauuucaucccuuauaguugccauuucauaauuuauuuucccauuucuggacuuauuuuuuguuucuauaauaucuacucuaagguguggcgagcagagcuacauauuccagauggguaugcauuauaguuucaacaugggaguuauguuugcugcugugaucuucaccuaguaccuuucuugaugcugcuauagcauaugauugaaguaucuuacuuuccagaaguaucuccagcauucccaaugaacuuuguauucacauuuuuuucaaaaacugccuaaacuucuucacuuccaaaguugucaauauuuaaaacuuucuguuaauuagaugugagaaacuguagcuauuaaaauguacugcuuaauucacauuuauuuucugauacuggacacuuugccuuaauaaguugcuguuguucucucuccugacucaucuuaugugcugugccuucuucauauuucuauacucuuuaaaauguaucuucauaugcacacauaauggcucuagagcucucugauagauguaaauucaacuuuuauccuuuguuuuccauaguuucaauauuuacaugauacauauauaugcuauauauguuuuauauauguuuauaaagauauuuaacuuauucuguuguagaaauauaggaaaauuacuuagucauuuuuagaaaugagaaaauauaaaaguaaaaguaauaaaauuacauuuaucuauaauaacacugccuguauacaaucgcuauuaauauuuuuguguaauauccuggucacauauauacucauacauauauacacacacacacagagauacauauccuuuaaaauaugauucuauuauauucauuguuuagaaaucuguuuuaucccacuuaauauaucuuuugcauuuuuccagaucaguuuuaagaacuacagccagcccuggguagccauggguucugcauccagauucaaccaauugaggauugaaaauauuugaaaaaaaaaaauaacaauacaaugauaaaaaauacaaauaaaaacaaagcacuauaacaaguauuuacauagcauuugcauuguauuacguguuguaaguaauuuagagaugaauuaaaauauacuggaggauaugcauagguuauaugcaaaugcuauaucauuguauguaagggacuugagcgucuaaggauucugguaucuguaggaguccuggaaccaauccccugcaaauacugagggacagcucuacguuuuauucuuucauuuacucugauuuaaccaauccauuuauuaauuuguucuguuaacacaauacuaacauauuuuugcgaacacauuuuuauagacauccauaauuauuuccuuacaauaaauuaaaaaggaaauaacuaggugcgagaggucaugugcauuuuuaggcuuucaauauacauugccagacuacucccaaaauaguuuugccagugaauacucugcuagcaguauaccauggugccuguuucuucuaaacucuaaacugguauuucuauacauuacauacauaugucuaacaauagauuugaacuuuuaauaaaacugucaccugcuuugcucagaauauugagagaaauauaaauuacuguauguucuauagaugaaaggcacuguuaauacuuaccuacaauauuucuuuguaauuauuguuuuacaucuauuauaaauuguuaaaauucaagguuuauugucugacuguagugaagaauauuaaguuggccuuuuuuuaacuauuauuuguagacagauuuuccaguccucucuuguguacuuauuuucaagauguagcuuguugaaguacaaacaaacugauguagagcuagaaaucuaaaauuucagucuuuauuccaguccuggcuuaagcacuuaugagcuguguguuauguaaucuuuuuggauaguuauuuucucauccauaaaaucaaaauaauacuuucuguuuagauuaccuuaaagcauuuuuugugaagaucaaauaaguuaauaugaaaguaauuuauaaacuguaauauacauaugaaauguguuauuuucauauuaaccagauugcugccuaaugagaagauaguugaggaaaauggaagagauuaaaauaucaaccuucaaaaauaaauauuugagguuaaugguguuaugcaauuuuguggcuauugaaaaauuuacuuuuauauauuaaauucccucuuccuaaauuucucuuauagauucauuuuccuaauggaaauaagaaaaagcugguaaaagggagggaaauggcagagauuggucuugagaccaguuucaauaauggucauauacuuuuguggauaggggcagcuaaacaugugugauauguauuuagcagguauuaggugugagaucccugaauaucuacucaauuuaaauggauuagcugggaacauuuacuuuuauugcuggucaugugagauuuuauuauucaguaauuugacugugaaaguacaaugagaccguucagacccagucuguuucuugccacuuagacucagaaauucggcucuggaaaaacugaaaaucccuucaucuaguggcaaguacaguuuuaucauuuauguuaaaccauauugccuuuuagguaccuuauuggauuuuacugcaugcacugagaucucuaaaaggugaauaucugucuaucuuagauaucugaauauuuuucauaauuaaaaauguucaaguuuuuaugcaaagaaugaauggcuucuauaauauuaugaucacuuuuucuagcauuuccacauaaaaauuaguauuggccugaugauuuuaucuugucucccaauacccuuaacaccuagguuguggcaugcauuauuagaacacuucuagaaucaaacuugacauaauaagcauuuauauucagauauagagcagaggcucuugaacucaucuuucugcccacuuuuggguucuugcaacaugcuauauauaugagauacaaagaugaacaagacuagauuucuuuuuuaaaaagcucacagucuuggaggaagaaaaaagagaagaagagaaauacaugauacacuguaacauuguaauacuaacuuagagaaauucaauuucuucauuuguaaaaugaggauaauaauaauaauaauaauacuaguucccuuauagggauauuauuauaauuaaaugauaaacuguuuagcccaaugcuuuauacacuguaagcauccaaaaaauguuugcuguuauuacuguuacuacugcuguuguuauuuccaaguguuaagauagagaccuacugaaugugggaacacagaagagaggcuaaugacugaaagaacgcuaauuaaaaacaagauuaguugacuuuacugcuuuuucucugcaauuuuucauucacugagcuucagguuuucuuuaacaugugaauauguauaaauccaaaauuaaacuuaugcauauuaaugucaacauugauucccuaaaguuacuggaacgcauuuggaaaugaaguaggaaacuccgucauugugguucauucuucaggguucagccuaguguccuguacaauuaagugcuucacagaugcugcccccuaccccacuuucuuuuaaacauuuuuguucauugacccagaugucccuuugggugaguuuugagaggacacaagauacacagaguuggugacuauucagaauuauuugagguaguucuuauucauauaauuuuuaagcaauucuuuuugguuuagccuucugagauauacauuuucaaaguuuacaucuuuuuuuuuccaguuuuacauacacuucagcugcacuuacuauuccauuugccugaaaugcuccuacacguuuuuucagauguauguucaaaugacaccucaucagagaggacuuccuuguccaccuuucuaaaguaacaacuccaguugcucucugucccccuaccagcuucaccuucuuuuuucacuuuagcaccugacaaaagcuuugcaaaucugccauuuuaacgauagugccugacacuuagagaauguuuucuauuuuuaaaggcauuuaagauucuuaacuaauugauaguguccuuggaaguagguauuguauuuacagagaaaagauaucaauaucaucagggagcagaaaggcacaaacauccaaggaagaaagauaauccucugaaaagacaguugagaagaaaggaagguaacuuuccacugaauuucccugcuaguuacuugguagagaccaggaguggacaaacaguuuugaucaagggcuguucaccucuagagaaaaaucuagaauuaugggucaaaaacaguggacucuuuuauucugagagagagcucuagcuucauucauucaacaauuauuuuuaaguuucucuugagugccaggcacuguucugagcaaucagugacaaagucccacccuuauggagcuaaaauuucuggggagaugcagaauaaacaaauauguaguauaauuugagguuuugauaaguguuauggaaaaaaaaucaaacaagacagagagugaagaaguugguauuuaguuagcuggucagagaagccuccuuacauugcugacauaugaguggagaccugaaugaagugaugauguggagagcccugggaauccuagcccuagagcugucuagguagaggaaauaguacauccaaagacccugaggugggagccugcuugguuuauuuaguaaccagcaagaaggccaguguaacuggagcagagaaggugagggagaggguggcagaggcaggugaggcagaugagauaaagagguagccugagaccagaucauacaaggcuuauguggcaugaaaucagucuuuuuuaaacaaaauuaaaauuuuuauggguacauagcagguauauguguguguguguguguguguguguguauaauauauauuuaauauauauaauauaauauacaauauauuauauauaauauacaauauauuauauauaauauacaauauauuauauauaauauacaauauauuauauauagauauaauauauaauauauuauauauuauaucuauaauauauaauauauauuauauauuauaucuauaauauauaguauauuauauauuauaucuauaauauauaguauauuauauauuauaucuauaauauauaguauauuauauauuauaucuauaauauauaguauauuauauauuauaucuauaauauauaguauauuauauauuauaucuauaauauauaauauauaauuauauuauauauaaacauauauaauuauauuauauauaaacauauauaauuauauuauauauaaacauauauaauauauaauacauaauagauauauuauauauuuuauuauauuuauuuuauauuauauucauuauauauuauuauguuuauaauuauauaucuauuauauaauauaauauaucuauuauguauuauauauauuauaucuauuauauauaauagauaugugcacacacauauauauauauaaaacauauauacacacccauaguauacuagguguguguauguguguauauauauauguauacauuuauauauacccacuauauauaauauuuauaaauauauaaguauauauuuaauacuuuaauauauaaauauguacaccagauauuuugguacaggcaugcaaugcauaauaaacauauuguggaaaauuugguauccauuuccucaaguauuuauucuuuguguuaacaaacaaucaaguuacacucuucuaguuauuuuaaaauguauaauuaaauuauuauugacuauagucacccuguuaugcuauugaauacuaggucuuacucacucuuucaauuuuuuuuguacccauuaaccauccucaacuccacaacccccuacuaccuuucccagccuucuacucucuaucuccaugaguucaauuguuuugauuuucacaucucacaaguaagggagaacgugcaauguuuuugugccuggcuuauuucacuuaacauaaugaccuuuaauuccauuauguuuuugcaaaugacagaaucacauuuuuuuauggcuggauaguacuucauuugguauauguaccauauuuuccuuuuccauucuuuagauggacacuuagguugcuuccaaauuuugacuguugucaauagugcugcaauaaacaugggagugcagauaacucuuuguuguacugauuucuuuuggguauagacccgguggugggauuguuggauuauaaaguagcucuauuuuuaguuuuuugaagaagcucuaaacuguucucaauagugguuguacuaauuuacauucccaacaacaguguaugaguguucccuuuucuccacauccuugccagcauuuguuacugccuguccuuuggauaaaacuuuuuuaaaauggggugaggugauaccucauuguaguuuugauuugcauuuuucucaugaucaaugauauugagcaacuuuucauaucccuguuugccacugguugucuucuuuugagaaacguauauugagauuuuuugcccaauuuuuagucagauuauuagauuuuuuuuccuguagaguuguuugagcuccuuguguauucugauuauuaaugucuuguuagaugguuaguuugcaaauauuuuguccuauucuguggguugucucuugacuuuguugauuguuuccugugcuaugcagaagcuuuuuaacuugaugugccccaauuuauccaugauugcuuugguugccugugccuguguggugguggucaagaaauuuuugcccagaccaauaccuugggaauuuuccucaauguuuucuuguaguaguuucauaguuagagguauuaaauuuaagucuuuaauccaaauccauuuugauuuuauuuuuguauaugaccagagaaaggggucuuguuccauucuucuguguauaaauacccaguuuuuccaguaccauuuauugaagaggcugucuucuccaauauauguucuuggaaacuuuguugaaaaugaguucauuguagauguauggauuuguuucaggguucucuauucuguuccauugaucuaugugucuguuuuuaugccaguaccacgcuguuuugguuacuauagcucuguaguauaauuugaagucagauagugugauuuuuuucaguuuucaucuuuuuacuuaggaugguuuuggcuauucugagucuuuuauaaauuuuaggauuguuuuuucuauuucuacucuuugaagaauaucauugauauuuugauagugauugcauugaaucuguagauugcuuuagguaguauggacauuuuaacaauauugauucuuuccauaaacauggaaucuuucaauuuuuuaguggcuuuuucaauuucuuuuaucuguguuuuaaaguuuucauuguauaaaucuuucacuucuuuuguuaauuccuauguauuuuauuuuguucaugacuauuguaaauaggauaacuuaaaaaauuuuuuuucagauuguucacuguuggcauauagaaaugcuacugauauuuguaugauuuuguauccugcaacuuuacuggauuuaucaguucuaagagucuuuugguggagucuuuagguuuuuccaaagguaagcucauaucaucugcaaacaaagauucuuugacuucuuccuuuccaauuuggaugcccuuucucucaucugauugccauagcuaggaccuccuauguugaauaacaguggugaaaguguauaaccuugucauguuccagaucugagaggaaaugcuuucaguuuuuccccuuucauugugauacuagcuguggggcugucauauauggcuuuuauuauguugaaguauauguuccuucuauauccaauuuuuugauguuuuuaacaagaagggauguugaauuuuaucaaaugcuuuuucggcaucaauggaaaugauuguaugguuucuguucuacauucuguugauaugauguaucacauugauugauuugcauguguuguaccaucccugcaucucagggauaaaucccacuuggucaugaugaaugauauuuuuaacguguuacugaauucaguuuucuagcauuuuugaagauuucugcaucaauauuagagauauuguucuguaguuuucuuuuucauucuuuuuuuuuugauguguuguugucugguuuugguaucaggguaauacugagcucauagaaugagcuuggaaauauuaccucuuccucuauuuuuuggaauaguuugaauaggauugguauuaguucuuuauauguuugguagaauucagcagugaagccaucagguccugggcuuuucuuuacucagagacuuuuuauuauggcuuugaucuuguuacucauuauugguguuuucauguuuuggauuucuucccaguucaaucuugguagguuuuauguguguaggaaguuuuugauuuuuuacagauuuuuaaauuuauuggcauauaguugcucauaguagccaucaaugaucuuuugaauuucugcaguaucauuuguaauguuuccuuuuucaucucugauuuuauuuguuugggccuucugucuauuuuucuuacucugacuaaaggauuaucaauuguguuuaucuuuucaaggaaccaacuuuuuguuucauugaucuuuuguauuuuuuuuucauuucaaauucauuuauuucugccaugaucuuauuauuucuuuuccucuaauuuugguuucaguuugcuccagguuuuguaauuuucuaagguucaucauuaggcuauuuauuugaaguuuuucucucuuuuuuuuuaauguaggcacuuagagcuauaaauuucccucuuaauacugcuuucacugaauucccuagcuaguagcauuccauaacuaauaguauauuguguuuccuuuaucguuuguaucaagaaaauuugcaauuuucuuuuuaauuucuucauugacccacuggucauucaagucauaaagucuuagaucugaaagagaccuuugauuuugguuaacaucagugauuaugaaauugagguuaugauguaucacuggauuguaggcgcuaaauuguaaguaauagacagcuuuuaaaaaaagguauaaaaauaucaguacauuucacauauugagaauaagaauuguuuuugagaauuuuauuccaguuguagggcaugugugugugugguuguggguggauguggguguggguguguauuggucccaauggaaacugugguucuuacuauagguuaagaaauaggggaaaaagaaaaaagaaaaaaaagaaagaaaaaaggaaacaggaaaauguuuuugaacuauugaucuagucuuauucccaaauuuuauagcuaaagaaacuaguugggacauacugaaaggcccacaugucuucuaccucagugugaugaucccauuuacaugugaugugcaugucuguauguguauaugacuauuccacauugaaguaauucuaauuuccaaacgaaggaaagaaauuacaaaguuuauuuaguuaauaccauaucaguaagugcucacaucacuucucuauuuuuaaucucuuuuauguuugccuuauuuuucuuuuuuucccucuuuucuugaauauccuucuauuucucuaggaaagaaagauauacaacgugaagcuagagagagggagagaaagaaauccaggaccaauaaagagggagagggacagacauccaaaaucuaggagacaaaagagagaaacauccagggccaagcagaaguagaggcaucucugccccaucacuccugcuuucuucaagauccccucugcguuuugcacaggcuguagucuucugggaaggcagugcugguggagaauggauccaucuacuuucaaagacaugcauugggaauuuauuaauaccucucuauccugcugucuggcucucugaguugggacucaguaauguacuaaggagagugagcuccuugagagcagggcucuuuccuuccuuccuuccuuccuuccuuccuuccuuccuuccuucuuucuuucuuucuuucuuucuuuucucccuuucuuuccuuucuuuccuuccuuuccuuccuuuccuuccuuucuuucuucuuucuuucuuucuuggcacgaucuugggucacugcaaccuccaccuuccagguucaagugauucuccugccucagccuccugaguagcugggauuacaggcacccaccaccacacuccgcuauguuuuuguaguuuuaguagaggcagggugucacuauguuggccaggcuggucucgaacuccuguccucaggcaauccaucugccucggccucccaaagugcugggauuacaggcaugagacaccauggagguagggcuuauuucuuacucacucuuguagucccucaguaauagcuugcuuagaaaacuauucuaauuaauacacugagcuuuugagauacuguuccuuuuauacaguuacauucuuacuaauacaaaugagaaaucuauagccuuaaagaaaggauuaggcuaaaaagggacuuaauuuuggaaaauuuguaaggagcuugauaaaaugaauccaggguuuuaaaaaaagagguucuguuacacacacaacacacacacacuaaauagacauacauuguggauuaaaccuuuuuuaaaaaugucaugagaaagauauucuugaaaugauuuaauagcauuuuuuaaauuauuguuuuuaauuguuuaagauacuguuauguaauuuguuagauguuagaaagcaagcgaaaggaauuuauuagauguuagaaagcaauggaagagaauucacugaaugucacgcauauuccauaagaguggcuguuugauaauuucaucaauaaauuuaaaaacuuuaaacuuauuuggggcugacugggcaaaggauaacccccccaccccagauuggguccucuuuuaugcaaggaauuagagagaaaugaaauuguugaccuggcacaagcuauccuuucauuaaaauguuuccuaaagucccgaugacuggaggggauauauuaaaaacaaaaggaggcugcucuuccuauggaguaggcauucuuuuauuccuuuacuuucuuaauaaacuugcucucacuuuucuuuaaaaaaagaaacuuauuaacuuauucuuuaaaaaagaaugggaaaucucuuuuucuuaauaguuaauaucuaucacuuauugaaugccuacuguauauucuuuucacauaaggaaaccucaguuuuuuaaaauacccaagauuauacgcuagaaagcgguagggcccaaauuugaaccuauuuagccuagaaccucauguucuuucuagccuacuacuuagggucacgauguuuaaaauuuuuuuuuuuuuugaguuaacucuuucuuuugcuuuuauguagcuauagaaauuuaacuuccuuuucaaaaacucaguuucuaguggauauaggugauauacauuuuuuucaggaauucauaauucauauuuugauacuugacuagggcucugcaaaauuacuaugguuuaaugaauaacuacagggcuaaaauugaggguauuugugaaauggcuuugugaaauggcuuugugaaauggcuuuuugggcaggauauguuaaauccacauugaacacuagguggcacucuuccaucauuggacacuuucaggaaaagcuauccuuuauggauuuuauuaguugcuuauuaauuuuaaucauauugaaguggcauucgaaugcuauucaucuagaaaucacagauguacacaguaucacagauuauuucucauaaagucaaagacacacguuuuucuuuccuaaauuagaaaacuuuagccuaaaugaugaaacaaauggucaucuuugggauuaagcuugaaaauguggguuuuuuuuuuuuuuugcuuuuuuuuggaaucuguuacuuuaccaaaauauccuuugacuuauuuuuaaaaacuuaaucaggaaacuacaaaauaaaaauaauguuugaauuacaugagguaauauaggcaaaugcauuccaaagaaaacacugucuuaauaucuucuucagauagacugucugaugaucacuacuucuaacacuuguggauguauuuaagacuuuuaccacuuuuauaaagguacauuagugguuacagccacuuaagucuguaucacuuuauuguaaacacaguauuuucuccauugacuaauauucaaaaagacucauucuuuuucucaugaugaaaaugcuaucagaaucaguagccaacuguagcuaaugcagaauaguaguaauuugcaaugcauguaaaucuauauguauauuuagcaucugcagcauuugguauaugacauacaggaaaaaauggaaccauuuugguuugcauauuuugcauagagcuacuuuucucuaucucugcaaccagggcugcuacauacuacauauaggacauugcacaauuaugagugaguugcugauauucuuauuuauuacguauuuuucuaacacguggcaguaaaguguucucaggaaggcacaacuuuuucuguuugcacaggaguacuagauggacuaaagaauagucuuuucagauuucuuagcaaugauacugcucgucuaugccauuggcucuuauucuugaaagaaaaaagaauacgagaggagggagcacaggagagagaaggugauauaaaaguaccauuccaggaugcaucuaauuuacuacaaaugucaggguggguuuagggccucuacaauggacagaugccacaggaugccaucccacuguaucuucuccucauacucuaccuucaaaucauacuggcuuuguuuguuaaacuugccaacguccaucuuccucccaaagcuuuauacuuuuugucuaccuggaauguauuuuuaccccagguuucugcaugacuggcuuuuccucaucccguuuugacaucucagaucaaguguaguuguuauucuaguugaagggguacucccuagcucacuaccccaauaauuggcauguuuaccuauuuauccuauuguuuuuguaacacaauuuauuuauuuacuuacauuuuuagagauggcgucucacugugucggucaggcuggagcgcagggguauggucauaacuccaacuccugggcucaagugaucuucgugccucagccuccugaguagcugcaauuacaggcacgagcuaugaugucuggcuauaacacauauuauuacaagaauuauauauauuuuuuauuuuuacauucuauaaggagagacagaaaauuaguaaguaagcuccaugucaacagggccuugucugucuucugucuugaauauccccagugucuguugcagugccuggcaaagagaagccauucaguauuuguugaaugaaugaaggcaugaauaaauucaacuuuuaaggcauaacuaauauuucaauugaugauagcuagcagaguucugcuuucuaaauuuauucauucaacaaauacuuaauagauaucugauauaugcaaugcauauaccuagucccuugggaugcauccauaaauaaaacagacaaaagucucugcccuaaaagggcuugcauucuuuuggggcagauaugcaauaagcaauaaacauaugaaguauaguauacauuauauuugaagguaaauaagugcuacgggaaaaaaaugagcaggguaaugaauguuggggguacugauagugguguugaauguaauuuaaagggaaguggccagaguuagucuuguggagaagaugaugauaccugagcaaagucuugagggugagaaaagauaagccauguaaauauuggggaaaaaguauuccaggaaauaagacagucagcggacagacuuuuuuaggugggagcaugccguauguucaagaaacaguguggcuaaggcaaaguaagcaagagugacaguugugggagaugaagucagacggaucacuggaggccagaucuuggagggcuuugugggcuauugaaaguggguugacauuauucucauaggcugaguuggcaaauuuuaagcagaggaaugaggugauacaauuuauauuuuuacagaauccucucuggcuguauuuuuuugagagaagcuguagggggcaaagauggaaguagagagguuaguuaugaggcuauaaucuaggugagggaguaugguggcuuggaguaggggguuugcaguggagguaguaaaguggcuagaauguguauauguuuugcagguagaucuaauaggauuuccugaugaauuagaucuauggucugagagaaaaugagucaaggauagaguuaaaagaugacccuaggauuuuguccugagcaaugguaaggauagcguugcuguuaacuaagaugcggaagacuggugaagaagccaauuuguguuagggggcugggagcaggauuucaacuuggggcuuguuaaacuagagcugucuaacaucuaagauaaaaggcaguuggauagauauaugcaacuaaaauuuagagggaguggucuggccugagcacugucaauauguagauuauauuuaaagccaugagacuagauaagaugauaacagagugaguguagcuaaagauuaaggguccaaagaccaaguuguagaguaugcugacacucuaacaucaagaaaccaaggagaaaugccuguacuggaauagaagagagguuucaaaucagcaacuuaagguucuaccuuaaaacaaaaaacaaaaaaaggcagagugugaugguucacucauguaaucccagcacuuagggaggcaaaguuagagaaucacuugaggccaggaguuugaaacuagccuagacaacauagugagacccccccaucucuacuagaaaauaaaaagagaacagaaaaagaaaaauaagaacaaauuaaaccuaaaggaaauagaaaagaaaggagauaaguauuggaguagaaaacaguaaaauagaaaauggagaaaaucaaugaaacuaaaaauuaguuauuggaaacaauuaacauaggcaaaacuuugguuagacugaccaagaaaaaagacugaagauacaaauuaucaaaaucaggaaugaaagaggagacaucgcuccuaucccugcagaaauuaaaaggauuauaagggaauacuaugaacaacuuuaucccauuaaauuagacaacuuagaggaaaugggcaaaaucauugaaagacauaacuacuaaaacucaagaagaaauagagaaucugaauagaguuauacuaaauaaagcaauugaauuaguaacuaaaaaucauucuacaaagcucauacccagaugacuacucucaugaauucuauucaacauuuaaauaauaaauaauagcaaucuuucacaaacuuuucuggaaaacagaggaggaaguacaacucacucagcgaagccaguauuguccuauaccaagccagaugaagacauugcaagaaaagaaaacugcagaccaacaucaugaauagaggugaaaaaaucuucaguaaaauaucagcaauauuagcaauacauagaauggauuauauaccaugauccagugggauuuaugccaaaaagauuuaacaucaaaaaucaaugaauauaacacaaaaaauagugaaauaaaggauaaaacacacauaauuaucguuagacacagaaaaacacuuuacaaaaucaaauaccauucauaauaaaaauucucaacaaauuagaaguagaagugaacuuugaacuaaggggauucaugaaaaagcugcagcuagcaacauauuuaaauggcaagugugaaugcuuucuuccugagauugggaacaaggcuaggaugugugcucucacaauuuuauacaacacuggaauggaaguucuagcugguacagucaggcaagaaauaaaugaaagacaucuagaccggagaggauaaaacugccuuuauucacagaggaugugacccuguauauagaaaauccuaaggauuccacaaaaaaguuacuacaacuaauguguucaucaaaguugcagaauacaagaccaauugauuucacaaaaauuaauuauauuuccauauacuauaaugaacacucugaaaaagagauuaagaaauuaacuccacuuacaaugacaccaaaagaauacucaggaauaacugaaagaauuguacacugaaaacuacaaaacauugcugaguaaaauuaaagaccuaaauaaauggaaacauucaaacuucauggauuagaagacuuaaugugguuaagguggugauucucucuaaauuaguagauagauuuagugcaauuccuaucaaaaucccagugggcauuuuugcagaaauugacgagcugauccuaaauuugauauggaaaugugaagggcccagauuagccaagguguuuuaaacaagaacaacaaaacuggaagacuuauacuuucugguuucaaaacuuacuacaaagcuacaguaaucaauucaaugugggccaagugcaguggcucaugccuauaaucccagcacuuugggaggccgaggcaggaggaucacuugaggucaggaguuugagaccagcccggccaacauggugaagcccugucugcuauaaaaauacaaaaaaaauuagccaggcaugguggcaugugccuguagucccagcuacucgggaagcugaggcaggagaauugcuugaacuggggaggcagagguugcagugaaccaagaucaugccauugcacuccagccugggcaacaagagugaaacucuaucucaaaaaaaaaaaaaaagagacaauguaauggcauagcauagggauagacauauagauuaguggaacagaauugagagucuagaaauaaacccuucaugguaaauugauuuuugacaaaaaugucaauaccauucaaugaggaguagucuuuucaacagauggugcuagggcaauuauauaucuacauguagaaagagcaauuucgacuaaucucacaccaugcaugaaaaggaguucaaaauggaucauagaccuaaauguaagggcuauaacuauaaagcucugagaagaaacuauagaaauauauauaucucuguauccuugggucaggcaaagccuucuuagauaugacaccaaaacacaagugaccaaagguugccauucccuccccaacaaaaaaucguguggaacuggcaaugugagacaggaaggaccucuaucccaaaggaucauucugaguccuagcuggacacagguauguauauauauauaugcauauauauauauauauacuaauacaaguauauauauguacuuguauauauauauauauauacuaauacaaguauauauauguacuuguauauauauauauacacuauauauauguacuuguauauauguauauauacuauauauauguacuuguauauauauauacuauauauauauguacuuguauauauauauacuauauauauauguacuuguauauauauauacuauauauauauguacuuguauauauauauacuauauauauguacuuguauauauauauacuauauauauauguacuuguauauauauauacuauauauauguacuuguauauauauauacuauauauauauguacuuguauauauauauacuauauauauguacuuguauauauauauacuauauauauguacuuguauauauauauauacuauauauauguacuuguauauauauauauacuauauauauguacuuguauauauauacuauauauauauguacuuguauauauauauauacuaauacaaguauauauauguacuuguauuaguccauguucacacugcuauaaagguacuacgugagacuggguaauuuauaaagaaaagaaguuuaauugacucacaguuccacauggcugcggaggccucaggaaacuuacaaucaugccagaaggcaaaggggaagcaggcaucuuuuucacaagguggcaggagagagagaaugugcaggggaagcuuccacuuuuaaaaccauuagaucucaugaggacucccucacuaucaugagaacagcaugggggaaacugcccccaugauccagucaccucccacuaggucccugccucaacauguggggauuacaauucgaaaugagauuuggguggggauacagagccaaaccauauuauuccaccccuggccccucccaaaucucauguccuuuucaaauuucaaaaccaaucaugccuuuccaauagucccccaaagccuuaacucauuccagcauuagcucaagaguccaaguccaaagucucaucugagacaaggcaagucuuuucuaccugugagccuauaaaaucaaaagcaaguuaguuaguucuaagauacagugggggcacaggcauuggguaaauguucccauucgaaaugggagaaauuggccaaaccaaagaggccacaggcccuauacaaguccaaaaccuggcaggguacuuguuaaaaaaauuuuuuuuuaauucauuaaagcuccagaauggucuccucugauuccaugucucacacccagggcaugcugauggaagaggugagcucccagggcauuggcagcuccuucccuguggaucuguaggggacaguccccauggcugcuuucaaaggcuggcaucgagugccccuggcuuuuccaggcacauggugcaagcugugaguggaucuaccauucuggggucuggaggacauuggcccucuucucacagccccaccaggcagugccccaguggggacucugugugggcacccugaccccacauuuucccucugcauugcccuaguagaggcucuccaugagggcucugccccagcagcagacuuuugccuggacauccagguguuuucauacauccucugaaaucuagguggaggcucccaaagcucagcucuugucuucugcguaccugcaaucccaacaccaugugucggcugccaaggcuuggggcuugcacccuuuaaagcaaugccccaagcuguaucuuggccccuuuuagccucggcuugagcuggagugacugagacuuagggugucacgccccagggccacacagagcaguggggccccaggccuagcccacaaaaccauuuuucucuccuagccuuccaggucugugauaggaggggcugccacgaagaucucugacacggccuggaggcauuuuccccauugucuugguauuaacauuccguuccucauuuuuuaugcaaauuucuucagccagcuugaauuccucccuagaaaauggguuuuucuuuucuaccacagggccaggcugcaaguuuuccaaaccuuuacauaaguuccaaucucaaaccaucucugugaauacaucugacugaaugcuuucagaaaaugccaggucaccucuugaaugcuuuucugcuuagaaauuucuucugccagauacccuaaaucaucuuuugaguucaaagcuccacagaucucuaaggcagaggcaaaaugccgccagucucuuugcuaaagcauagcaugagugaccuucacuccaguucccacuaaguuucucaucuucaucugagaccaccucagccuggacuucauuguccauaucacugucagcauuuuggucaaaaccauucaacaauucuuuaggaaguccacaacuuucccacaucuucuuuucuucugagccuuccaaacuuuuccaaccccugccuguuacccaguuccaaagaugcuuccacauugucagguuaucuuuauagcaguaccccacucugcugguaccaauucucugaauuaguccauuuucacacugcuguaaagaauaccugaaacuggguaauuuuugaagguaagagguuuaacugacucacaguucugcauggcuguggaggccucaggaaaguuaacaaucauggcaguaggcaaaagggaagcaggcaucuuccucacaaggcggcaggagagagaacgugcaggggaaacugccacuuuuaaaaccaucagaucucgugagaacccgcuaucacaagaacagcaugggggaaacugccccuguaauccaaucaccuuccaccaggccccugucuugacacauggggauuauaauucaagaggagauuuggcuggggacccagagccaaaccaugucaauacucaaauggaauaacugaagaguuuacugaagggacuaguuacaaagguaugggcagaguaagagaaacuaacaagggaugguacaggaagcagaagucagggagccuuuacuacuucuugaccuaucagggaaaauggagagaacuaccagagagcagcuguaauggaaaggcugucugacaugagcuguggucuucauugcagaggagaaacuuaaccaaugugaucuggcaaggaggaggaaguagaauaaauaucuuggccucucuguucuuccuuugauuuguagccacuggcuucuacuggccaaacccauguaaaaguccaagggcaaggggguccuuugaugaaguucauggaggucagcugaccaggcuuagaacaggauggagaagagcagagugaaggucuggagagacaaauggaaaaugacaaauggaaaaugucuagcacauccacuuucagaccaaguaguacaauagcuaugggauaaaggaauaacaagacuuggcucaguguguuugugaccuugacaacaguugcuuuuuuggaaaaacucaagguuagcauuuauauuguuauuuucuguguuaucauuugauuucuagcucaauaauaaagucaauuuucuaucugaacauugaguaguuuauaauugcuuaaauauuuucaugccauuauaauuagacccagaauuuauuuauugauuaagagccaucucucuuuuuggaauauugugguucaguuaauuguuggcaagugaucucucauggguaacucauguccuggaguuacuuaauacuuuaucaaguauauucuuuuaagaugguagucagagaagcccauacuuaccaaaaaaguaagaaaagauguccucuuugagaaucuuucuggaaauauaaguaaacagacuuacaaacaaauauuagaguuugggggggaguuuuuugaauauggaagaguggauuuuugccauuuugucaagaucuauugcugugcacauuuauuuacuccuuuagaucuuuauuuugguaaauauuuauuugaguauuuuauggucccagaacuaggagagccaccuugaaguuucaagagaaauaaauguuacagcuucuuugagaauuucauaauuuuauuagagagacaauuuguauuguauaauacaaaauuagacgacaacccaguguucuacugugggaacaucagucugcccgugaagaaacaaggguccuuguuaaacuaugccacuuaacaagucaacaucauuuuugccaagucauuuaacuuaucugaccuucuguuuccucauuguuaauguuccuuugaucucugaaauucugugaaaaucaaauuccaaguaacagaaauauacauuggcugggguuggucugggaagacuucauaauaacuguguuuucuuugagaugucuaaaggaaaguucaaccuuuuuagagagguuucccuugauagaugguguguggcauuguuuuuucacugggcagugaucugcagaagucagagagcaaaaauuuucaagauuauggggcccaaggugaagaaguuuaaaaagcuguuucuccccugaaacuggaugugugccuuuuuaaacgauuccaucuuguuugaccagcuuccugcuauauauucauacuguggaaaugguucuuuucuggcauuuuucacuaacaaaauuuagcaggaguuaaguugaaagugcaucuuaaacaucacaguuggggaaauacagguguuuguguucuguucauugcaucacugacuuuuuucuguaaacacaaaaacaaugcauucuauuucugagauauugucuugaaguaacauuaaaaaacacaaucuuggaaauauguggaauucuguugaaaauauuuuuucaaaagaaauuuuaaacuguaauuuuuuaaaagcaaaaagugauugcaaugguauacuuaguguuuaaagaauuuaagugaaauaggauagcuaacuaaauuuaaugauucaccuaacuuuuccuucuguuauaauuuguuuuccuuuauuaaugagaaaugcuaaguuggaguugacaaauuagauucuucacacgugaagacccuuuuuacuugaguuugccuucugucugucuuuacaagauagauuuaugaagaaggaauaggucucugugaacaaccuggacaggcucaaaacugguuauggucacacuaaaguaagguuaauauuugacacuauucaauguaagaaaauuucuuggucuuugaaggaagcccuggaggaagacuauuugauaaaggauagguacaaaacaaguuagugcuuaaaaucuagccucugacaaugggauaauauaaaccuuuuccuuguguuuuuauuucuauuguacuuaucacugugacaucuaaguaaagcaaugugaauuacuaugcuuguuugccuacuguguagauaauacauuuuuaaugaucugcuauugagaggugacagcaugcuggcaguccucacaguccucagucgcucuuggcaccuccucugcaugggcucccacuuuggcggcacuugaggagcccuucagcccaccgcugcgcugugggagcuccuuucugggcuggccaaggccagagcccacucccucagcuugcagggagguguggagggagaggcgugagcgggaaccagggcugugugcggcgcuugcgggccagcuggaguuccgggugggcgugggcuuggcgggcccugcacugggagcagucggccagcccugcuggcccugggcaaugagggacuuagcacccgggccagcagcugcggaggguguacugggucccccagcagugccagcccaccggcgcugcgcucgauuucucaccgcgugccuuagcugccuucccacggggcacggcucgggaccugcagcccgccaugccugagccucccacccacuccguggguuccugugcagcccgagccuccccuacaagcgccgcccccugcuccauggcgcccagucccaucgaccacccaagggcugaggagugcgggcacacggcacugggacuggcaggcagcuccaccugcagccccggugcgggauccacugggugaagccagcuggguuccugagucugguggggccuuggaggaccuuuaugucuagcucagggauuguaaauacaccaaucggcacucuguaucuagcucaagguuuguaaacacaccaaucagcacccugugucuagcucaagguuugugagugcaccaaucgacacucuguaucuagcugcucugguggggccuuggagaaucuuuaugucuagcucagggauuuaaauacaccaaucagcacccaguguuuagcuuaagguuugcgauugcaccaauggacacucuguaucuagcugcucuuguggggccuuggagaaccuuuaugucuagcuaagggauuguaaauacaccagucggcacucuguaucuagcucaagguuuguaaacacaccaaucagcacccuguguuuagcucaagguuugugaaugcaccaaucgacacucuguaucuagcugcucugguggggacuuggagaaccuguguguccaaacucuguaucuaacuaaucugauggggacgugaagaaccuuuguaucuagcucagggauuguaaacacaccaaucagugcccugacaaaacaggccacucggcucuaccaaucagcaggauguggguggggccagauaagagaauaaaagcaggcugccugagcuagcuguggaagggaagguccccuuccacacuguggaagcuuuguucuuucgcucuuugcaauaaaucuugcuacugcucacucuuuggguccaugcugcuuuuaugagcuguaacacucaccgugaagaucugcagcuucacuccugagcccagcgagaccacgagcccaccgggaggaacgaacaacuccggacgcgcugucuuaagagcuguaacacucaccgcaaaggucugcagcuucacuccugagccagcgagaccacgaacccaccagaaggaagaaacuccgaacacaucugaacaucagaagggacagacuccggaugcgccaccuuaagagcuguaacacucacugcgaggguccacggcuucauucuugaagucggugagaccaagaacccaccaauuccggacacacuauguucucagaauguucaaggcaaagugaaaauuuccuuguuuagaagccacuuuucacucacccuuacuggaagcagcuggcuugagggagcagguucuuagaugguguugauuucuuucuauauauauguauauauauauaucucuucugaaacauauauauaaauauauauuuaauauauaaaaguauauauuaaauauauauuauuuauuuaauauauauaaaauauauaaacauauauauuauauauauuucuucuaaaaaaaucaggauacaugugcagaacgugcagguuuguuacauagguacacaugugccauggugauuugcugcaccuauugacucguccccuaaguucccuucccucaucccccaccccacaacaggcccugguauguguuguuccccucucuauguguucucauuguucaccucccacuuaugagugagaauguguaguauuugguuuucuguucgugugcuaguuugcugaagaugauggcuuccagcuucauccaugucccugcaaaggacaugaucucauuccuuguuauggcugcauaguauuccaugguguauauguaccacauuuucuuuauccagucuaucauugaugggcauuuggguugguuccaugucuuugcuauuguaaauagugcugcagaaaacauaugugugcaugugucuuuauaguagaauaauuuauauuccuuuggguauauacccaguaaugggauuacugggucaaaugguauuucugguucuaaauccuugaggaaucaccauacugucuuccacaauggcugaacuaauuuacauucccaccaacaacguaaaagcauuccuauuucuccacagccucgccagcaccuuguuuccuacuuuuuaaucgucauucuaacuggugugagaugguaucucauugugguuuggauuugcauuucucugaugauuagugauguugagcuuuuuuucauguuuguuggccacauaaaugucuucuuuugagaagugucuguucauauccuuugcccacuuuuggaugggguuguuuguuuuuuucuuauaaauauguuuaaguuccuuguaaauucuggauauuagaccuuuucagauggguagauugcaaaaauuuucucccauucuauagguugccuguucacucugaugauaguuucuuuugcugugcagaagcucuuuaguuuaauuaauuagauccuauugucaauuuuugcuuuuguugcaaucgcauucggccuuuuugucaugaagucuuugcccauuccuauguccugaaugguauuguguagguuuuccuccaggguuuuuaugguuuuggguuuuacauuuaagucuuuaauccaucuugaguuaauuuuucuauaaaguguaaggaagcguuccaguuucauuuuucugcauauggcuagucaguuugcccagcaccauuuacugaauaggagauccuuuccccauugcuuguuuuugucagguuugucaaagaugagaugguuguagaugugugguauuauuugugaggucucuauucugcuccauugguguaugugucuguuuugcuacccauaccaugcuguuuugauuacucaugcuguugauuucuauuauaaugucauucaaggugaauguggguucauggagacucagacuaaacuuuagaagcuuguugaacuguaaccuuuaucaucuacauaauuuacuccagaaugucuuugaagucaaacagaagcagauacuuggcuugaaauagauugacuaguuacugacccuucaacaugcaaaucaugaaaauaagacuucuaguuaguuuaagauauuucuccaucaugcauuauggaauccauuuaguaugauuuaaagaagggagcacuuuuguaugaacaaaaauauuuugcugccuauugugaaguaauuuuuccuaaaauacagcauuacaaaaaugcaauguacauuuuuuucagugcacuguuagaauuacaagucugauaaguauguccugauuuuuauuguugugguuguguugguuuuuaaaaccugauuugucuuaauaggggguuaaauugaaagaauauaguugcuauuucuagaaaucgagcaaacacugcagcuuauauaggcugcuuaguccagugucucucagaagggaguuuccaucccuucuugccacaguuaaggagagugucuaagagcagaucuggagucaagcugccuggguucaccucuguuuauaagcugugugaucuuggcaaauuucuuuuuuuuuaaaauauuaaauguuuauggguacauaguagauauauauauuuaugggguucaugagauaguuugauacaggcaugcaaugugaaauaagcauaucauggugaaugugcucuguccccucaagcauuuauccuuuugauacauuuauccuuuugauauccuuuuguuacaaacaaugcaguuacacucuuuaaguuauuuuaaaauguacaauuaaguuauuauuggcuacagucacccuacucugcuaucaaauauuaggucuuagucauucuuuuuaauuuuauuuuuuuuguaccuguuauucacccccaccuucccuacagccucccacuacucuucccaacuucugauaaccaucuuucuacucuccauguccaugaguucaauuuuuuuucauuuuuuagaacccacagauaagugagaacaugugauguuugucuuucuuugccuagcuuauuucacuuaacauaaugaucuccaguuccaucccuguuguugcaaaugacuggaucucauucuuuuuuauggcuuaaugguacuucauuguguauauguaccacauuuucuuuauucaucuguugauggacauuuagguugcuuucaaaucuuagcuauuguaaacagugcugcaacaaacauaggagugcagauaucucuucaauauacugauucccuuuuauuuggguauauacccugcagugggauugcuggaucauuuuuaguucugugagaaaccuucaaacuguucuccauagugguuguuuuaauuuacauuccuaacaacaguguacaaggguccccuguucuccacauccucaccagcauuuuuuauugccugucuuuuggauaagagccauuuuaacugggauaagaugauaucucauuguaguuuugaugacauuucucugaugaucagugauguugaacaccuuuucauaugcuuauuuuccauuuguaugucuucuuuuaagaaauaucuauucagaucuuuugcccauuuuguagcuggauuauuagauuucuuccuguagaguuguuugaguuccuuagguguucugguuauuaaucccuugucagauugguaguuugcaaauauuuucucccauucuguggguugucucuucacuuuguugauuguuuuauuugcugugcagaagguuuuuaacuugauaugauccuguuuguccguuuuugcuuugauugccuauguuuguggggcauugcucaagaaauuuuugcccagaccaauguccuagagauuuucucccauguuuucuuguaguaguuucauaguuugaggucuuagauuuaagacuuuaauccauuuuuauuuuauuuuuguauauggcuggagauagggggucuaguuucauucuucugcauauagacaucuaguuuucccagcaccauuuauuaaagaggcugucuuuuccccaguguaucuuguuugcacuuuuguugaaaauggguucgcuguagguguguggauuuuuucuggguucucuauucuguuccauuggucuaugugucuguuuuuaugucaguaccaugauguuuggguuacuauagcucuguaguauaauuugaagucaguuaaugugauuuuuucaguuuuguucuuuuugcuuaggaugguuuuggcuauucugaguuuuuugugguuccauauaaauucuagaauuguuuuuucuauuucuauucuuugaagaacgacauugguauuuugauagggauugcauugaaucuguagauugcuuuagguaguguggacauuuuaacaauguuaauucuuccaauuccaugaacauggaauagcuucccauuuuuuuuuuggucuuuuucaaauuauuucaucaguguuucauaguuuucauuguagagaucuucauuucuuuuguuaauucuuagguauuuuauuuuauuuguggcuauuguaaaugggauaacuuuuuaaaauuucuuuuuaagauuguucacuguuggcauauagaaauaccacugauauuuguaugauuucguauccugcaacuuuacugaauuuaucaguucuaagagucuuucaguggagucuuuagguuuuuccaaauauaaaaucauaucaucuguaaacaaggauaauuugacuucuuccuuuucaauuuggaugcccuuuauaucuuucucuugucugauuguucuagcuaggacuuccauuauuauguugaacaacaguagugauaaugggcacccucgucauguuucagaucucagaggaaaggcuuuuaguuuuuccccauucaguaugauacuagcugugggucugucauauuugucaaauaugcuuuuauuauguugagguauguuacuucuauauucaguuuuuugagaguuuucaucaugaagguauguugaguuuuaucaaaugcuuuuacaacaucaauggacaugauuguaugguuuuuaucuuucauucuuuugauaucacauaucacauugauugauuugcuuauguugaaccauccuugcaucccagggauauaucccacucggucauaaugaaugaucuuucuaauguauugcugaauucaguuugcuaguauuuuguugacaaguuuugcaucaauauuuaucagagauauugaccuguaguuuuauuuauuuauuuauuuugaugugucauugucugguuuugguaucaggguaauacuggccucguagaaugaguuuggaaguagucccuccuccucuauuuuuuggacuuuucuuuacugggagucuuuauuauggcuuugaucucauuacuuguuauuggucucuuuagguuuugaauuucuuccugguucaaucuugguagauuguauauaucugguuauuuuucuguuucuucuagaguuuucaguuuauuggcauauaguugcuuguaguagccacuaaagauuuuuuuaauuucuccaguaacauuuguaauggauuuuauuuauuuauuuauuuagagacagagucuugcucugucaccagacuggagugcaguggugcgaucucggcucccugcaaucuccuccucccggguucaagcaauucuccugccucagacucucaaauagcugggacuacaggcgccugccaccaugccuggcuaauuuuuguauuuuuaguagagauggggguuucacuauguuggccaggcuggucuugaacuccugaccucgugauccuuuugccucaaccucccaaagugcugggauuacaggugugauccaccacgcccagccauuuugacuucuuaguagccauucugacuggugugagaugguaccacauugugguuuugauuugcauuucucuauacgccacaguuacaguguuauaauauccuguguuuuucuguguacuuacuauuaccagugaguuuuuuaccuucaggugauuauuuguugcucauuaaugucuuuuucuuucugauugaaguacucccuuuaacauuucucauagaacaggucugguguugaugaaauuucucagcuucuguuugucugggaaagucuuuauuucuccuugauguuugaaggauauuuuaacuaaauauacuauuauaggguaacagucuuuuuuuccuucaccacuuuaaauauguaaugacacucucuccuggccuguaaaguucccauugaaaagucuguugcuagauguauuggagcuccauuguuuauuugcuucuuuacucuugcugcuuuuagaauucuuucuuuauccuugaccuuugagaguuagauuauuaaaugccuugagguggucuucuuuggauuaaaucuguuuaauguuuucuauaaucgucuuguauuuggauauugauaucuuucucuagguuugggaaggucucuguuauuagcccuuugaauaaacuuucuaccccuaucucuuucucuacuucuucuuuaagaccaauaacuuagauuugcccuuuccagccuauuuccuagauccuauaggugugcuucauguuuuuuauucuuuuuuugucuccucuguguauuuucaaauaaccugucuucaaucucacuaauucuucugcuugaucaauucugccauuaaaggacucugaugccuucuucaguacgcuuuuugcauuuuucagcuccagaauuucugcuugauucuuuuuaauuauuucaaucucauuguuaaauuuauuugauggaauucugaauuucuucucuguguuaucuugaauuucuuggguuuccuuagcagagguuuuuuuuuuuuuuuuuuucaggaaacacaaauuuucaugaaauuugaaaauucaaaccacagcaugacauuaagaaaacacaaauauuacuuauccagaagaaaaaguguuuugaacuuuuucauaaaauauuuaggaacaaggaaguugaagcuuggagcgguagagugagaaauaaggaauaugugggagagaaaguaaagugaaaaaaauuagaucagauuuuuuuuuuguuguuguuagcacuaaacugguuugcuucaggccccuagccaggguugauuuugaaaccuauagcagagcuauuuugaauacucugucugaaaggucacauaucucuguuucuucaggauuggucccuugugccuuauuugguuuauuugguaaguucauauuuuccuggaugaucuugauacuuguggauguucaucugugucugggcacugaaaaguuagguauuuacuguagucugcaaucuuggcauguuuguacccauccuucuuaggaaggcuuuacauguauuugaaaagucuuggguauuaugaucuaagcuauaucugcuuuaaggggcacccuaaguccauuauaaaacuaaugaugaaugugcaacagauaguguuauaaaauuuaaaaagaaaauuguuacuaaaauuuuuauugacaaaaacagaucuauaacuguuugaacuccccaaaagguaagaauuguacuuuggcucugauuuauuaauaugauauauccuuuacaaaaaaauuuaccuaguauuauauguucaauaguuuuuauuuucauuuauaaauauaauuuuagucauuuuuuuguccaucauaaaucccuuuuuccuucauacugauuuuuuucugcaaagaccuuuaaaaaacuauuuaccuaggguuaguugcagcugaggcugcaucaucacaaauccagaguugcucuucuuguaugucagaaaaagaucagugagggagaugaguguguacaaugcaguucuaaagucacagguggaccuauaagccaccaucaucgcuuugggagacauaggcaacagaaauccuaagugcuucauguaaacuaagucauuuaauccccaaaacuaccuuaugaagaaaguacuguuuccauuuuucaaauggggaaaaugagaguuagagacauuaagucuugcccaggucuuuuggacucucacaaauauuccuccauaaucccccccuccaaaaaaccccuuuauaguuuccuggaucuucucuuuaagcaacacauuucagggccaugucucuugcuguaggcugccagcaaaugauagcagcaguagcaccagcagcagcagacuuaucagauuggugugcucguugcacucagcaugcuaguaguaccaggcccaguugguauuuguugauugaugaucauaguaucaucaggaauggaauagcuuucugaucaguauuauugaaaugaggccaagguacaauuuugcuugguaacauacgcuuaaacuuacucuugaacugagaguuuggauuuuuuaaaguauaucuguauggaaaagauuguuaauuucauaugauccacuguaaagcuggaccuuccuuuaaacaguagcagagagaggugguggugugauuuauuucuccaaagacuuguuuaaucuucaaauauaauuucacuugcaauuccaauauuggucaauauuuccauaaaaucaccuauuuuuuguuauaaaacuuauaugaauuuuacauuccacucaauaacauauauuuauauacacauauaugcauguugcaguguaaaaauuguuuacguuacuuaccaucgaguaagacuggugcucuaggaaaguucucucuguauagacagagaccuuaagacuuuaagauacuaaggcuucuggguauaauaauaccacauuguccaguucaagucacuucaagacuucugguauaauaauacacauuuuccuuuaagacuuuaagauuucuggaacaaagugugauuaugugugagggaucaacucuuuuauuauguauaacuuauauuuaaaauguucaaaagaggaaaaaugauuuggcuucuuuaagaaagucucuuuuugaugcaguguaaucuuuaaauguuccucauaaaguacuuuugauagaaguuggaaucuucagggaagaaggagcuaaugauugucuguguaaucauuagguuguggcauucucaucagagcaucugugacagacaacucaagguguaucuaugugcuacuaaaguguuaguuucucucucuugaguuggcccuggaaggcuagugauauggaaauaucugagucauaggaaauguaguuuccaguuuuggcucaguuauuaaccagcucugugaccuuaugcuagucauuuauauuaucuggaguucaguuucuuuauccauaaagugaagaguuaaaacaaaaugauauauagcuuuaauagcauuugaggaaggaaaccaaguuccuccuuuuuucuagauuuggcucaacaaagcugaaaaguaaauuuucuuuaaauuuuaaggguggcuuuggucuggaugguguguguaugugcaugugugucaggcagguaguugaaaggccaaccucacugugauguuuuaucccaaguccagauguaccacuguuauaucuccagguacaucuuuuaacucuaggaaguaaacacaguuuuuacuguaaagguaaaccagaaaguuaaguuuaaaucaaguuugaauauaauuuguacuuggaguaauaaaccuuuucccacagaggaaacagcacuagcuugggaguucguuuccaaaagcucuacugaacaagcacagguuucagcucacuuuuguaccuguuucucugucccuuggugggcucccucuaccagcuucuuaggcuucucagucacuugucugcuugacuugagacucagcacaugucuuacgaguaaagacaacgcaaugaauguugguuucacuucaaugggcuuccugucuuucuggaucuuggauccucagauccuggcugccuuaaaagcucuccaaaucuuugauauccuacuuuucuaguuguucuuagaaguagcauugguuugcugugagcuacuuugucauagccagaagcaacaguuccucaguuuauuuucuuuguauuaaaacucuuuucuggauagaguauagugcaaaauucugcugcccaauucagaauuaaagagugugguuggcagguuugguggauaggcuacauggauaaauggaaguaccagguuucguggauuuuucauuugcuuuaguuagaugugucauuucuucuauuuuauauuuauuuuagugaaggcaacauuucaauuauguauuuaaauaaauauuuuauuauggauaguaaaaauuuuaauaaucuacuaauauuuaaauuuuuauuuguaggugaguacaauacuagaaugcacagugaaaccuaaacucaaaaaagcuguauuguuauaaucaauaugaaaaauauauaugaugaaaggcuuuuacaaaugucauaguaugucucuuauuuuacauuuauuuucucuugaguaaucagcaugguuuaaauaugucuuuggaugauugugggaaaaauaaaagugucuuaaaaauaaaagugucaucuacguuauaguuuauggauauauuauaaacaucauuagacacacaacuucuaccauuagaauuuauaagucaauuauuaacuuaaaaagaacccccaaauuuucccuaaccagagcaucagauggcaaauccagaauuagcaauaaaacuccuagauucccuucuucccuaugcuuuuauuugcuuauuauaaugaagaucuuuggggcgaggguauuuuuacuaacauauaugaugggaaguccugcucaauagucaagggaaaaggacccaucuuugacuuauuuuuuucauuuuuugcucucugugguagcccuaagaguguacuucacagaccuccaacuacaggcaaccuaagugaccaagggucccagcugcuguucucugaaauccacugcugcuuuugugcugagcacuugcuucccaaaggcugcucccagccacugauugagaggagcagggauacuaaagcuggccccucccuguccuugggagucaccuggcucuagcacuuccugaugggcuuacagaaccuuucuuagaggguguagcaaugugggaugauuccacuuaaccuuccuugcaucucuccaccacucugugucaaacuucuauuguuuuuaucggcuuuucuagucuuccuuggcucccucaucauuuuauauuacgggaauuuuccuuaaugaaauucuuguauguucaaucuugucuucacauucauuuucagagguccuagacuaacacauucucuauuucuauaaaaagauacuaucauaugaaauuacuaaggaaaaaaaaauguuugcuauaauuuuaaugguaauauucugauacuacuagauucucaaauuuagggaagucaaaacuucauauaauugagagcucuccucagaaauuuauucuuauauuaguuuauugauagucuguauguaaacuugcuuucagaaggacugaauuguuacaauaguaaaaucaggagcucauguucucagaaaacguuaauuuacucaggaugauuagauggcuguaaaguaaaaagcaauccauaagucaucuuugagauaucuaaggguauuuagugagaaauugaaaggaaauauugcugaggguguguugauaacugauacuuuguugaaaagcagaaacauucaauauaauagguagaaguaauuuuguuucuugcauauugguaauuucauuuugugugacuuacagaagagugcuuguucuuuauauguuaguguuaaaauucuucugucuuucuuugcagaaucauagugaaagauucguuuucauugcagagugguaugauccaaaugcuucacuucuucgacguuaugagcuuuuauuuuacccaggggauggaucuguugaaaugguaaauaagccuuucuuugcuugaauguuggcaaagggggugaacaugggaaccauugccuuuuauauaauugcuuuuuaaaaacacauuuauauguauguguguguguauauauacauauggaaauucuuuuuaaacuuauucauuauaauuccaauauaagaaguuaacuugugccuuuauuuuuaaugucaaaaauaggaauuuuuuguuguuguuguuagaagacugaagugggggcugggcgcggugccucaugccuguaaucccagcacuuugggaggccgacccaggcagauuacuugaagucaggaguucgagacuagccuggccaacauggugaaaacccaucucuacuaaagauacaaaaaauuagccgggugugguggcacaugccuguaaucccagcuacucgggaggcugaggcaggagaauagcuugaacucaggagguggagguggcagugagcugagaucacgccacugcacuccugccuguccugccugggcgacugcaugagacucuugucucaaaaaaaaaaaaaaaaaaaaaaaaaagacugaaaugggauuauucauguuuuggauaagaaauaaacaagugauuauagauaaggauuauuauggucauaaauacguccucauuauugaaagcuguuauugcuacaaaaagucaaauugaagaggcucaagcuaagagacuucuguuucuuuguguucuuucacuggcaacacaauuuuaacaaguagaucuuuuugguauugggauuuuguguacacaagaaagcagaaauuuggguguaugacucuuucuuuagcauuuuguaaggacuacuuugcugaaaugauuugguaauaaacaaaucuuucuauucagguuuuuaagaguauuaaauuuguaauaagaagcuuuuauguuauuaccagauuggauuaggaaauauggaaguuauuaaaaauuaugauuuauauuuguaacaaaaaagaaacagaauauaaccuaucuuugauaagacagaauuaagaauuauuucuaccuuaugaugagauuaacuuuccuuauucauaacuuuuuuuguuuguuuguuauauuguugugucugguucuagcaugauguaaagaaucaucgcaccuuuuuaaagcggaccaaauaugauaaccugcacuuggaagauuuauuuauaggcaacaaagugaaugucuuuucucgacaacugguauuaauugacuauggggaucaauauacagcucgccagcugggcaguaggaaagaaaaguaagaaaacaauuauauaaucuuuuuacaugcucuaacuuuggguucaaagucaaucugaaucaagacugggaguauguaaccauaugaggauggauaggaccuggaaaaugguugucuucauucuuuuucuuuuuuucaauuuaaaaaaaaauugauaauaccauaguugugcaugucucaucugacuuaauucauguuuaugucuccuguggcacuuagcacaucuccauccacauugcaagcaccuugucuguauuagcugaacgaauuaaugaaucacaauuuaaaaucuaugaucuauucuuuccuuuuuccacuuucucccuguuuucaaaugaugaucuuugaucuaguugaccaggagguuuuugccuagauuguuuguaacuaaugcugccuauugucaaguuuuguuaacagauauauauauauauauuuauaucuaauagauguugaccaacggaucaauugaaaaaugacaaugugaguguuguaaaaaggaaaaaaaaaagaaaccauauaaagaaauuaugauacagggagacugauguaucuuauucauaacuguaucccuaaaaacuguuguagugauaccucaaacaguaaauuauucacagagugugacccacaaaaguuuguuaaauauaugaaugaauaaauuuaugucaucgaaaugucuggagguacgguaugucuaaaggaagaguuucccacuggcuggcauccccgccucccuaucuuccucccacugcauguggcucuuucugugagagaaacugugacauggugccuccacaugugucccuguucuucucucuauuguuugucaaagcugcauucaucauucuuuuucucaguuuugauuuagaagagauacagucaucuguaaaaggggcuaagaaaaaaaauggaagagaaagaacaacuuguagauacagcugaaaauuagacuuauagaaaacaagaaaacaaggauuuuugauguuuuccuucugaauacugauuuucaguauuagcaagaugacauuuuaauuuucagucucuacauuuaugaauuucaacuuucugagacuagaauuaauuauauuugaagugaaauuuuaauuccuuugucaucuuucuuggcuuuaauuucuguagcuuauacuuuguaugguuuggggaguuuuuuuuuccuguagagugauuggugcuguaauuaaaauagggauuauuuguagaaguuaaggcuauauguauaaaaggcuccaaaaaugauuuaauucaauagggaaaacaaaucaaucaaacuauuuuuugagaucuacuacucaaaugacuagcugauugccuaacgucugagucacucuuauaguaauaugauaucucuuucugugacuuccauagucuuucuguauaagcacuuuauagcucuugaggugauuggauucuuaguguggguguuaguacacaaauggugauggaucagagggguggugcaugccucauuaaaaaggaagaccaaagacucucuuugaaauaggacagaaauuucagguauuagauaaauaaauaggaaucuuuuaauguuaugagaucuuauguaaaagucuuugggauuaaagaaaugccaaccauaauuccuuuauuuaaaacucauaaauauguguagcauucauuuauggagcacauacuaugugccagacacuaugauaugcacuuuacauacaccucaguucaagacuacuuuauuuuauuuaauuauuguuauuuuugagguggggucuggcucugucacccaggcugaagugaaguggcaugaucauagcccacugcacccuugacuucccaugcucaagugauccucccaucuaagccucccagguagcuggaacuacagccaugcaccacuauuccuggcuaauuuuuugguauuuugcuagagauggaguuuggccuucuugcccaggcuggaagacugcuuuaaauuuuuauuuaaacuagcaaaauaagugaguuagggagucaggguuaacagucugaccuaagaaaaauaaaauaacaaccauaaaaauuauaauuuauguauuuuaacuaugauuugacugaagugaauguuguuaaaucuauuuuauagaauggguaaguaacuuguccacaguaacacagcuagaaaguaaagggaaaccagaaaaccguguuuuguuuuucccuaaaauucauucucuuucuacuaaaccucuaauuaauaugcuggcaaauacuguugaaugggacugauuuuaaaacaggaugaacagaagaauucuauuuuaauguaaaaacaaauuugaaguauuugggcuuuauauaguuaaugaaaaugaaaauauauguaguauauauuuuacugacucaaauugauucaccauuuucucuucuuauucuuucuuaauugcauauggguuaguaaauccaacaaccauuugggugauuuaaauaaacuucuuccaaaccgaagaguuucaaaaauuuauuguuuuauuuaaauggcaaaaaguaagcauauggaaauauguguguaugucuaucagcguuccacagaaacaccuucuauguaacaaccgauuuagucuaguucucaguuuuguauaguguugagaaaaauuuuugaaccaauuacauuuucaacucuuuucuuucuauaguaaagccuguagugaggaggaugagugaaauugauccccauggagccuaucagcuaauuggggagcaguuauccagauaauuuaauauaauucagcuuaacucaugaacuagcuucagcuuuccaauucccuuugacuguagaaaucugacauuugauucacauuuuuauccucucuuuauaaagauccucuaaucaaauggauaaagguuacaaguugucaaugagucagucuuugauuuuaauuuuagcuaguaauuaauuggugcuuuaugauuguuguuuagauuuggagacacgauacaauuugugucuuucuaaaaauuuauuaccucaaaccagaaauaauuaaaguuuucauaugaugagucaauauguauauguaugcauguguaugaaugauagaggaauuuuauaugaauagacagcuauuccccaugugauaagugagguauuaaauguuuacuuugauagcuuauaucuuuaguaagaaguuuauaaaaaucaaugaaaaauaaugcuaguauccuauuuaaaaauccauuaauuuuaaguacugagccacauauuuacauugagcaauccucauuccuuuugagucucagccagaaagcaagccaucuaaucaaauuaaagggagaaaggcaucaguagguugggugaacaacauuauaguagauguuaaauacaugaaauucuugugcccaucuauuaacuuucagugaaaggaagaccccccuguuuuucagaagaaaaauuaugaagucaacuguguguauaaucuuugaucccaaggucuaagcccaaguuauuugaggcuccaucacagcaggaacucagucacaguaugcauuuuccuguccucuuggagauguacugaaaugguauauggauaaaaaaacaagccguauuuuagaugagaccugugcuuggaaggggcuuaagaauacuucucccuggagguagggagauugaccuaaauaaccuuuugaacuaaaucaccuuuugaauuuuuaaauacagcccaaaaauuccaagcauuugcuuaauugauaauuuuuuaaaagguacugaaauaauacuuuauauguuuucuagacuuauguaguuuaacaauucuuauggaugaacauacauuuucuaauauuagaauuugacucauaugaacuauacguuuuuucuaugugaagauuuggcaguaucaucagauauauguuugaagaaauuucauuggaaggaaaugucauaaaaucuuggcuauaucaaguuugaaacaacuucaguguucagguauuauauaguuuagcaggauuacaguauugggauaucauaauguaugaaugacuuaaaagacauuuuaauuuuaauuaaaauuaaauuuaaaaauuaaauuaaaauuaaaauuaaaauuaaaauuaaauuaaauuuaauuuuaauaaauacaaaaaauguaccucuucuguucuuccaucccaacuggaauaaauuaaguuuagaauacuuuaaaaauuauuauucugucuuccccugguuguuauggcacuucaccaccgcuacccccaccgcugcuuccaucucuaucucucuggcuauuuuuucucagagucauuccuucucagaggcaaaaaagacuccugguauuccccaggguucuguucauggcccuuuuuuucucauucuauauacucucccaggggauucuauguacuccaugacuucaacaauguguugcuuuccaaauuuaugucaucaccccagcuguaaaaccauauguuuaagcuuuuuccugaacguuuccauguagauuuuucacaggaacuuaaaaauccaaaauugaauuaauugacaaauucaaaauuaaauuaauucucuuucauugaaaaaccuacuucuguaugcacuaacacaauauucaccuaauuacauacuuacaaaauugguggcuguccuugaguuccauauguauuuuaucccuaaauccacauggggaccuaaucuuaccaauuuacuugucuccuucauagaucucucuuauuucucuucucuuuuuuaucuuuuacauuccuccuuaaaacagcuucuugucaucucuugagcucaguuagucuccauucuucccuccaaauuacuaacugaugaagaacuaacacaggagauagauguagaucaaaauauuaaguauuaauuuuacuuaggcugucuugugaaagcguguuugagaaugguugaggcuuucuuucuauuccuauuuccucuaucccuuacacugaucuggaacuugaggccugccugaggaaaaguuggaucuacagaacaaacuaagggcauacuugcccaggguucucauccugccucccagcccauggagcacaggagagagagcacuagagagaaacaggcuuccacugcaggugccggacucugauuccaaugugcuuaacaugugaaagcaggagaacaauacgcuaucccuuacuuguacacuauccccuacuugagggucugcaggucugagaaaaaagaggucgggccacaaauaaccagaaacccuuaaauauggccggacauggagaagcaaauggaagaaguagagagagagagcacuuucuuaugggaacagggauagaaguuacuuuacucaugaggagcaagaguacacauuccuaguuguuuucuggguuuuauaccuuuaagccaauuggcugccaugcucuaguagacuauggcuacuucucggggaacagaccagaugaauauuaguuuagucuugcucucaccuuugggaaaccuuucccucaauaccaauuacuguugcuuuguauauuguccuaggaccaguggugagcaguugaguuuuggcugcagaagggcacccuaaugccuuagaggaauaccuuaguucaguaacagaggccuugcuaaaaacucacccccaaucuuuuucucaucuuuacuuaucuauaguaucguugucuaagauggcaugcuauugauuauacgauagacccaacaacaguguaacugccucccaaauaauacaaugaagaaugccuucucauuauuaaauucccagggagaaauugauauuuuuuucuguaaaauaagaauucugccuuuccauucuacaauucucagucauaugguccuuggucaguuaacagauuagaguugaauuuccuuuucagcuccagcuugagccaucuuuccuuagaaaggguuugauugauagcguauuuggguuaauuaauaucuuuuugccaucucuuuuauacuugcccuguuaugcuuuagauaugucucuuguaaauaacauauagguuuuuuuucaauuuaaucuggaaugguuauauuuucauugguaaaguuaauacauguacauugaaauaugcugugauuauuguuauuuuuguauauguuucuauuuuacuguuuuccuguuuuucuauuuuuuucuucuugccuuuucuuuggauuaguugaagaaauuuuucuuccucucuucaguuuuuuuuuucuauuauaugguuuucuauugaaguuauaacaaauuacuaccaaguuagucacuuaaacaauacaaauuuaugaucuuacaguucugucagaaguccaaucagaucucaucagguaaagaucagguguugauaagacugcauuucucuugaggcucuaggaaagaaucaauuuccuugcacauuccaacaucuugaagccauccacauuccuugguuuggggccaccuuucuccaucuucaaagccaccaauagcaggcuugaguccuccucacacugacaucucucugguucucuaaagcuaggaaagauucucugacuuuagggacucaugugaugagauugggcccaggggaauaauccagaauaaucucuacuaucucaaggccuguaaucuuaaucacaucugcaaaguccuuuuuggcaggugagguaauauauuuauacguucuggagauuauaauguggacauuuuugagggguaguguuauucugccuacuauauucucuguugcuuuagagguuaugugauuuuuauacuuguucuuuauugguuaggcuugaaauuuuuucauauauuuaacuuacaguucuauaauaauauggcucucucccaacucauacaacaagauuaggacacuuuagcucuaaucuucucucuuaaaucuuacauaguuuuguuauuauuguuguuuuuggacauucaguuuuuuugccugcauguuagacauucuuuuauuuauuuauuuauuuauuuugauagaaacaacauuugcuuagauuuaccuaaacauuuguucaccaauuuuucuugcauaucaaccuguccuuuuagaauauuuucucuucuuguuauucuucauuucuucauuguaaacuacccguuucuuuuuaaucugcacguuuuuuauuuuacccucuuucuuuaaugauacuauugcuagacacacaauucuaaguugaugguuauugaccaauuuucuuuauuccccuuuucugcuauuaguaguuacagaauuauauauucuaucaauuuuuaauauuuuuaauauaugcaauuaaggguauaaauuuccuucuaacugcuuauaacuauauccuauuauuuuugauauguaauuuuuauucaguuugaaacauuuuuuacuuucuuuguguugucuucuuugguuuauuauuuauuuagaauuauguuuauuuccaaacauacggagauuuguuuuucucuuuuuguauuggaaucuagcugaauugcaugugucuagaggacauauucuucaugauuuuugccuuucaaacugguuaagauuugccucuggcuuagaauagucaauuauuaaugaucuauguguguuagaaaagaauguuuaggccaggugugguggcucacgcuuguaaucccagcacuuugggaggcugaggcggguggaucaguugaggucaggaguuggagaccagccuggccaauguggugaaaccuugucucuacuaaaaaauuacaaaaauuagccggccguggaggcgugugccuauagucccagcugcuugggaggcugagugggagaauugcuugaacccgggagguggagguuguagugagcugagauggcaccacugcacuccagccugggugacacagcgagacuccaucucaaaaaaaaagaaaaaaaaaaaagaaagaaagaaaagaaaggaauguuuagucugcaguuguuuuguauaguuuuauauauuuauucauuaggugaagucugugaauugugauguucaaaucuuucacauauuuacuaauuuuugggcagcuuauucuaucaauugccaagguuuuauuaaaauuuucuaauguaauuaucauuugucuauuucuucuuguaguuauguuagucuuuauauuauaauuuuaaggguauguuacuaggugauuuaaauuguuauaucuucuugguaaauugaaucuuuuauuacuaugaagagaccaucuucaucucuagcaaugccuuuuacuuuaaacuguacuuucucugauauuacuauagcugcacuggcuuucuuuuaguuaacauucgcaugguauaccuuuuccauucuuuuuacuuuagauuuucaguauucucuucuaugugugccuuucauuaguuuuuguuuuuguuuguuuguuuuuuauaucuuuuuuuuucuuuaaguuccgggauacgugugcagaauguacagguuuauuacauagguauacaugugccauggugguuugcugcaccuuucaaccuaucaucuaggcuuuaaaauccaaucagauuaucuuuuuaaaaaaauuuuuuuauaaauacaguuuuauaaucugcaucuacuguagagcacuuauuuguaacguaacuacuaauauacuuggcuuuaacucugacaucuuauccugagcuuucuucuccugccuguuuuauuaucuuauuuuugauuguucggauugcuugaggauuuuuuucaucuauuuuuuuucuauauacaguuaguauuuacacuagaaacuacaacauauguacuuaacuugauaaagcuuaaaucuaauuaauauuuuaaccuccuucuuuaaaaucuaagaaucucagaagacuuuagcucaauuuuuguugggauuuuugcugaauuauaugcuguuuuuguuguguauuuuuuuuuguuuuuuuuccaugaaccuaaugauuuacuauuauuguuuuauguaaugaguauucauuuagguuucuucacuuuuugcuuuuuauccuuucuuuuaucucaaacauucuguuugggauuauuuuaccuuugcuuaaauuacauuuuuaaaaaauauuuuccuuuugaguguguuuacuaauagaaaacucaguuugcacucaucugaaaaugucuuuauuucacuuacauucaugaaacuauuuucuuaucucuguuguaucuuuuuguuucucugugcuucauucugaaucugcuuucuucugucaaacccuuuaucuaguucucauuuucauuauuguauuuucaucacaagauauucuaauauauucuuuuucagaucugcuuauuccauuuuguagcuuacaguuuucuauuaccugauaauguuuuguagcuugucuuuuaguccuuuaaccauaguuugcacagauacuuuacaguuuuucucugauuauccuaguaucugaaguauuugugggucucucucuuuucuguuguuucuccugguuuucccucauguuggccuuuucccuguauguguguaugugucugugugauuaucuuucuauaugauugccauguguguauguguggguguauugcauauauguaaauaauauaugugagauaugcauuuucauaugaauuauuugagguacaggaugacauuacuuuccuacuaggagggaauuaauugucuuugcuucugucuuuuucccauaggcauuagcagucuguaugauugguaguucaaaaauucuaaguuuugagacugcuuagaugaugugaacuuguauugccauucaagaccugguuguuucugauucaccuuaagcgggggugguauagccuuuggguccaaauuauuuuaggaaggaucaucucuuggguucuguuacccuuucccaaugauguacugcaaaucaaaguucagauuuuccagauaggcaaugcugucaagucaaaaacaacuuucauucuuacuuuucauucuuugguuguuuuuuuuuuuuuuucacuuuugucccaguaauuauuuaugaucuagucaauuuaucuuuaauuuuuaaaagauuuuuuaaaaauaucaacuuuuuuaguuuuugguggaagaauuguucugaauaauuuugcuauuguugccaagcaaaagucuugaucacugaauuuuccaccaaauuacaggugccucauuugagacaguuuuccuuuauccauggggcagauauacacuuuaugcuuguaaacaaaguaugagaaaaaccaaaaauuuagccuugauguuuagaauagguuuacuuuuagaauagguuuagaauagaauauuuacuuaagacaaauaugaaucccauauagauuaaaguuuacauauuuauucuuuuuggucaauggcauuuaaagaguccauagcacugcacuaucuaagauguuuaauagcacuguacuaucuaagacuuuauuacauagcaauagcacuauacugucugggacauuuauuguacugcaaucagucaucuuucucagaaauauauuugcugcaauuuuugcucagaaccugaugguauaugaagacauuuauugcauagcucugugagaauuguuauuuucuggaaaucuauauucuggguucgugaaggcuggccauacuguuuuuucacaagaaguaguuaccguguauugcuaagaaguuuuaaucuuaaauagugguuuuuauaauguuuuguuuucuuuugagaauaucucacgcugcaucuuacagugcuugccucagugcaggcaagaggauuacuaagugguagauuguuacacugauggcucucaaugaaucauaccuugugguuuucucucacagugacucugagcuugaccacgugacuugcauuggccaaagauaugucagcaaaaaugacucaaggggacacuugauaauugccuguacauugguugauguguggugguauuugaagaggccugcucuagccuccuuaaggaccacaggaaagaaaagccuaguugucucagcugagcacagcccccagcuggcccacuagcugaauacagcugugugaaugauccuaggugaaaccauugcacagccuaccuacagaaccuugagaaauuguuguuuuacgccacuacauauguggaugguuuguuaugcaguuacagauaacagagauacuacugauauaucuuugucacccuauuguuucuucaugugcugucuuuauuuuuaaauuaacacauaugaugcugaucucucucuuauuuucccuccaaaauacaauuuacuauuacuuacugaaaaauuaagcagcaaagacaugacagaggaauuuauuuagaguuauuuaucacauagucaauccuuugucucuuguaggcauuuaagagaaaaucagauuacauuuuaagcuguuugucaauuuuagacuuuucacauugcuucuuguuuauagacauugaugacuacugccauguuuuauuuuuucuuuaagagccauggucagugaaauguucuuccagaguuuagcauaaacaguuuauagguuagucuggauuaaaauauuuaaauaauaugaauuaaaaagugaagaguuuuaaguguguuuucaaugaagccagacaauauaaaguaauauaacugacucaucugcuuuaaaauaaagaaaaacauuaucugguauaauuuguaauaaacacacuaagaugaacaauuucuuuuguuauuacaguuuuaaaacucagccauaagcuauauccaauuuaaguaaggauauuugauuuuuuuuuuuuuuuuuuuuuuugagauggagucucgcugucgcccaggcuggagugcaguggugcuaucuuggcucacugcaggcuccgacccccggguucacaucauucuccugccucaaccuccuuaguagcugggacuaguaguagcccgccaccuugccuggcuaauuuuuuguauuuuuaguagagacgggguuucaccguguuagccaggauggucucgaucuccugaccucuugauccgccugccucggccucccaaagugcugggauuacaggcgugagccaccgcgcccggccaggauauuugaauuuuauccugagcuaaguuugucuuauuggugaaaaaaauccaaaaugaaaagaccaaccuuucuccuuuuauggauuccuugaauuaaugccaguguuauaagaacaacuggaaaugcagagggaaaaguagcagcaauucuuuaucacaaaagcagaauuacuccagcuaauauaguuuuuauguugcauuugcaaauaguauucuugaggauuuggugaugaugccccuuuuuaauaauauuaauaguaacauuauuugugauguggaaggacagaccuaggagucugguaaacuggguguuuuguccugaaaauguugcugaccagcuguguaaccuuugucauguuaccuugguaggccuaguuucaucauuaguaaaaugaggacacucaggugaucuucaucuccaaauuucucuuaauucugaaucuucagagggggagaguggagaaugcauuguucugauguauccuccuggagaaaaacaugauuuuaaaaguuagcauguuguuacguauucauauacauuguuguauaagaagacauuugauucuucaugcagucacccauguuaugaauaaagagucaauagaagaauuuauaauuauuuccaaaucaauguugaacugacuauauagcauacauauguugaagucuaagagaccaaaaaccaagcucauaauauauuuaaugcaauguuuuagagauuaguccuuuguauaaaauguauucuaagaaauggagauucuaaaugccuguguuuucucauuuggauauauuaaaaauaauuaaauuuuagugcuuuuuuuccuaagcuucucccucccccaaguuuaguaucuaauuuugauguucaugggaaaaauacuaagcuuacuuuguguaaguuuuuaagggaugucuuuaauacacuuuucuauacaauuaauuucaaauuuugaugaucuaggaugauuguugagaauacugcugcuugggaauuauaaauaaaaacuguugaacuauuuuuauuugcaaacuuauuuuuuguuuccuuauagaacgcuagcccuaauuaaaccagaugcaauaucaaaggcuggagaaauaauugaaauaauaaacaaagcuggauuuacuauaaccaaacucaaaaugaugaugcuuucaagguaauuuuuuuaucauuuucaguuauguaaugucugauuccuuuuuaaaaaaucauuuucugucuuucuugucauuguuuaaaauuaaaaaaccucguauugaaugacaaagaauagaauaguaacuuaaccaaaaugggaacugacaggaguucaucuagaauguuacugacaaagccggcccccuaaaagauuugaucuuuuccuauucagugucaugaagcccauauacaaaaccgaaagugaguaucaagcagugcaggcuuuauucagugucuguggaauugagaaacaggaguguggcucacaaaucaacuucucaacuagugaggggugaggggguuaaaauaaaggauuucucuaauaaaggacaugaaaagcaagaggagcaauaugcaugucuuuucuggaaauugguggugaacuuccaccaguuucacaauugauggugaaucgcagugcugcuuuccuuuuugucuuuuuauggccucuuccggucauugucauggugauuuucagcugucauggugcuggugggagugccauauaguaugaaaaugagauuauaaugaagcccgaggucuuuuugaugucauuugguugcauaucuugguucuaaccagucuuaacuggucugguuguaaagggaaccuuuuauugcagaaguccuguuucuuaaagauaagcaaaguuaggacaggguagaaauucagcugucauguaggcauuacaccaggcaacaaaaagaaaaagaagaaagaaaagaacaauaagacaccaaguaaucagaugcauaaauaaccacugaagucuaaguaauuaggaguugucaaauuaugcaugccucauuuaauuauuauugucuuucaaaaccccaucugcuuuuauaacaccagugcuugauaauuauaaucauuucuuaauauauaaggauaacacacuguauaaaauuaauagaggaaaugaugucugauuauuuuuauuugacaagaggauuuacuguugagauuuccaaagaugaugcauuuggaaauguuuacauuuagcucuucuuauuauaaauaauaggcaaauauaccuauuuauuuuuuaccuagauagguaaauauaccuaucuaacaagcaguacaaccuguuugaccagauauuuucuaaguuauuuagugaaaauaagacuuauacauuuacuuaucccuuucuaucaugaaguaaguaacucuaaccccguaagaauggcaaggagaauauuaacaacguacaaacaaaggauagggaaaaccuucucuucaguuuuuuuuagagauccuuuagaaaaaaaacuagugauuuuuccaugauauuggacauuuguuuuuaaaaaauuuccuaccaaauggacaaagcaaagacugaaacauucuggaagaugaagaagggagaugaguauaggacagaggccuuuguuuccugggaucacccucugguuggcugaguguaacacagagugucucuagggacaggaauguagcaguuaggcagaucuggcuccaauaguguucuuauguuucuccacuaguuuuuguuuguuuuuggucagauaucuucuuaaugcuucaauaaaucauucauuucuggauuuauuccaugggucaguugcauuuuuguuucugugagagcagggacaauggggagcaguagacauucaagucagcuucaauacaucugauuccgagaaacuuuaacacaaaacccuccauuuuacccugacaaugacauguuuaauuggaauuuuucccuuauguaugaucuccuaguuuacauauuuucuagagagacaggaggcuuacauuucagagcacaguauuuagaccagauugcuuguaacugugcuacuuacuaggugugugacugaacaguugaccacuguguuuauuucuucauuugcaaaaugggauuuuuuuuuuuuuuuuugagauggagucuugcucuguugcccaggcuggaguguaguggcacgauuucggcucacugcaaccuccaccucccagguucaagcaauucuccugccuuggccucccaaguagcuggaacuacaggagcacaccaccacgcccggguaauuuuuguauuuuuaguagagacggaguuucgccauguuggccaagcuagucuugaacuccugaccucaaaugauucacccgccucagccucccaaauugcugggauuacaggcaugagccaccgcgccuggcuuaaaaugggauuuauaauaguaccuaucucauaaaguaguugugaggguuacaugaguuuagugucucuauacuucuagugucugaugacuugguaucuaacuuccugugguaaagaugcuacuuguuuaucauaauggcccuauagcacaugaagaaaaaugcuaaaaccagcaaacacuucaagagcaccauagggcauacauuugcuaguuucuuugaaaccuuaagucuuguuaauuccacccaugccuuuugaaauacuucauucuuuggaguaccacagaugcaagcccuucuaauuacuuguugacacaccuguucauuuguaguuaugcacuuccuuuucccauagucuucugaacacaaaucucuuaccaaaccauuuucacuggccccucuggaaaucaaguuucauugugaacaaauaucccuauguccauagugucuuaacagaguguaucuuugcccgcacauuuuuaguuuaguugaaaucugacccuucuccagggacauuccuuuccuuuuagcccuguaggcugcucacucacaaauguuucuuaugucacagggucacgauauagcguauuuuagcucucuccuaaaaaucuauacucuucuucauccuuggaaauucauguuauuuaguuguuuuaccauccacugagccucauuuccauucuacaguucacaaacuccacauuuguuaaagauuugggcacuuuguuuauagucuccuucuauuccagugucuccugacaguugggaugacuucaacaucucugucagugaucauccagggcucugcucuauuugcuuucccaucucagugacggucacuaugauuucaauuagguauuccuccagauccuugcuuuuuguuuuuuuaaaaaacguggucucgcuuuguugcccaggcuagucucgaacuggccucaagugagucuccugccuuguacucccaaagugcuagaauuacaggcaugagccacugcauccagcuuguuguauguuauuuucuuuacaacuuuacuugaguagucccaugcauguccauaugaucaccuaccacuuacuuauagaugaauuccaaauacaucuucagccuugacuucucucugcaacugucaaucugaaagugauccuagauucaucuugcugcucccccauuccucauaccuaccugauauauaaauauuuuuacuucugcuuucuguauaucucugggagcaauucucuccuuauaauuccuauugcagccccuuaguuuaggcauuuuauaggcucauauucaggcuuucaacguaucaacauaggcuacugacugauuugucuacuucuugacuuacuaccuucuauuccuugauggcucauuuccuaccucaagauugcuccaugccauuuucuuauugccauuagaaugaaccucauaaaaugaaaauuugaacauguuaccauucccuuccuuaaauccgucagugguuucccauaugcaggaaaauauggucaagcagacaagcucuuugauagaguauacaagacucuuagucaucuguacucaccuacuguaauagcucuaagaggauacuuagguuucaguucccugaacauguugugcuuuaucacaucucaguuuucuuguacauaauauuguacugucuugaaugcucugccuugucuucugucucauccauuccuauucaucguucagaaccaacucaaaugucucauggaaacuaauucccaagaaaacuuaacugcuuaucuaaucauucauaucacuucauauauuuuuauuaguauguugagcuugagauuucauccaauuuauaagcuaggaaguuaccuguaacucuuccauggauguuagcagaugacaugagacuucugggucagagacaaaagacuuuauaaugguagagcaagcagcaugagcauuguguuuauauugguucuccuugccuccauauccuacaggaauaaaaugaccaaugcccagguguauacuguguaucuagaggguggcaucacaacugaggaggagugagcuuggguuaccagcuguuccauuagcaagcaauaaacaagccuacucuuuauacugaagagaggcuuuaccuuaucccucaagguuucuuguugcaaacacaauccugagaaacgacaccgaugaagaucagucagguccuugcauucuuggcauacccgauaagacaaguuagaagagagaaacucaccuggaggaauuucucacaauguaugcaucuuuucuaaaauuguuuguucaaaugucgguuccgccaugaugacaauauccagaagauagcugcugaguucuguaugacuuuguauuucuaguucuuggaucagugccucaaucaagguuggcauuaaguaaauauuucuugaaaggguuaauggauagaucuuugugaaagaaugguuaguuucuucauaaaaacacaacaaaacauaacaaaacaacaaaaaacuucucuagauagugauucacuuguuaauaccuauuuccuucuaaaccuuuaaagcaaagaauuagauaagaaugaugggaaaaaauuuaugaacucucaucgugguuucaauuuuagauuuugaauggagauaacuauggaaucagggacauguuggaugaaaacaaugaaacauuuuuaguaauggauugagguuuuucuuuucaaugacguuaaagauuaugauugcuuuuuccuuucuuguaguucaguuuuuugcguuugaaaagcuuagaauugguuguuuuaguauucuucugcuaacucuucuaauuuacucuccauguaaguuuuucaguuauucaguuuuaccccauuuuaggcuguaaugcaguauauacguaucucuuuuuuugugaguuuuucucuuuacccucuagaauguuguucuacaguuaguaguagcaagagcauaagcagucagaaauuugcaaucagagagcuuuggguucaaaucuucuugucuuguccuuacuagcuuugugaacuggacaacuuauguaaccaugcugaacuuuauucuuuuccgauguaaaauaaaggugaucacaccuauuucaauauauuguuguaaggaauaaauauaauaauuuaaucauggcuauaauuggcucuagaaaauuuugauuuuuuucuccuuuccaugucucgggaugaauuuuauucucuauauuggcauuacauauuucauaaucucuucauagccaaaugaauguuuaaguacauuugguuagaaugagaguaugcgugauauaacuuguuauguaaauucauuuuguaauauccugauaaaaucuuaaaagcauugcauaucaaaugaauucucaagccugaaagguugauucuuugcuagggaacaguuuccaguuuuaaaaguaguuaauguuuacauauauuugucacauacugugaacccaguucaaagccuuuaagaaaacuacacaguguuaggagagucaucugguuugcuuuuaaaaaaaguuuuuuagacuuuuuagcuaaucaguuuaaaaugcauucuuuuauugccgcuguagauauucuuuagugguaauauaaauguaaaaauaaaucccuguuacaauuaauaaacucugaauucuaaauguuuccauauucuccccuuuuuuagugaugucaguuaaagcauuaguaaccaauaaaauaaaaacauauuaagauacauaauuucucaggcagcuuuuaaaaacacgacuguagucuuuccuuuggagagaccuagcuaagaaaaaaagcuauaaacauuaaauuaaaauucuagccuaagcucuuaaguuuaaagccuguggaaaaaaaugacaaauuuuuaauuagaagauggcuuugcauuuuuuugaugcaacuuauuuagacuuuaaagaacaaauauucucacuggucaaauauuaaccuuuguuucuagaacguucaggaugcuguguaaaaagauggauaaggccaggugcgguggcucaugccuguaaucccagcacuuugagaggccgagguggguggaucaccugaggucaggaguuugagaccagccuggccagcauggugaaaccccaucucuaguaaaaguacaaaaauuagcugggcauuguggcacacgccuguaauuccagcgacuugggaggcuaaaacaggagaacugcuugaacccaggagguggagguuguagcgagcgccaagaucgugccacugcacucuggccuggguaacucaaucuaaaaaaaaaaaaaaaaaaaaaaagaagaagauagacaauauauaacauaaguagaaaaguaaacauugccuccuacauuaauuuuuauuuacauugauauuacucauacuuaaaaaauauuuuaaaagaguggcuuugacagaauauuuggugaaaaauuauuaauuaaaauauaaauuaguauaaauugagaggauuuuaucuuaauuuuauuaauguaagcuaaaauaauaaguguuuaauuuuauaauucuuaacuauugccuuuuugauuauuuuauaggaaagaagcauuggauuuucauguagaucaccagucaagacccuuuuucaaguagguccuuaauuuggggauuagugguauguaaaggaggauauccuagaaaacuauggaguuacauuuguaaaauuuauuacuugagaauaaucugucaaaagggccauagcaacaucuugcaacugcacagaauucuaagaauuauauucucugucuuuuuauuaaguaagaauuccuauauuuuaucauuaaaaaucuuaaaguuuaaucaguugcaaauagaaagauuuguuuacauuacaagaaggauaacuuuuaaaauuuuugguugauuaaaaauggagugauaauuauauuugauguucaauauuuuuauuaugcuuuuguguuuguggggcuuuuaauuuuuuuaauuuuuauuuuuuaugucaacuuuuacuuuagauucaggggguacaugugcagguuuguuaccuggguauauugugugaugcugagguuugggguacaauugaucccauuacccagguacugagcguaauacccaauaguuaguuuuucaacccuugcucccuucccuuucucccacucuaguaguccccagugucuguuguugccaucaauagauauuauuguccaugaguagccauuauuuaguucccacuuauaaguaagaacaugugguauuugguuuucuguucugcguuaauuugcuuaggauaauggccuccaucuccauucauguuguugcagagaccaugauuucauucuuuuuuauugcagcaugguauuccaugguguauauguaccacauuuuuuuuauccaguucaccacugaugggcgccuggguugauuccaugucuuugcuauuuuguauagugcugcaaugaacaggcaagugcauguaucuuuuugguagaaagguuuguuuucuuuuggauauauagcaguaaugggauuuaagguucaaaugguaguucuguuuuaaguccuuugaaaaaacuccaaacuauuuucuacagugguugagguacuaauuugcauuuccaucaacaguguauaaguguguucccuuucucuacagacuugccagcauaucugucguuuuuugacuuuuuuuuuaaaaaaaaaucaacuucuauuuuagauacaggggguacacaugcagauuuguuacgugggaauauugugugaugcugagguuuggaguauggaucccaucauccagguagugaguauaguacccaauagguaguuuuucaaaccaccugccuucucuccucuaguaguccacagugucuauuacccccaaauuugugucuauguguguuuaauguuuagcuccuacuuguaagugcgaacaugcagcauuugguuuucuguuuguggauuaauuuguuuaggauuauggccuccaauuguguccauauuauugccaaggacauaauuuuauuuuuuuauggcuguguagaauucuguguuauauauauauaccacauuuucuuuauccaaucugccacugaugggcacuugaguuauuuccauguauuugcuauugugaauagcacagcaaugaguguaugagggcaugugucuuuuuggcagaauuucuuuucuuuuggguauauacccaguaauggaauugcuagguuaaaugguagcucuguuuuaaguucuuugagaaauauccacacugcuuuccacaauggcuggaguaauuaauauucccaccaaccguguauaagcauucucuuuccucuauagucuugccagcauguuauuuuuugacuuuuuaauaauaaccauucugacuggugugaaaugguaucucauugugguuuugauuugcauuucuccgaugauuagugauauugagcguuuuuucguaugcuuauuggcugcuuguauguucuuuugagaaguguguauuuaugucuuuugcucuuuuuuuagugggguuguuucaugcuuguuugauuauuuaaggucguuacagauucugcauauuaguccuuuguugaaugcauaguuugugaauauuuucucucauucuguggauugucuuuuuacucuguugcuagugcagaagcuuucugugcagaagcucuuuagucccacucgucaauuuuuguuuucguugccauuacuuuugaggacuuagucauaaauucuuuccccaggccaauguccagaaugguguuuccuagguuuucuucuaggauucuuauaguuugaggucuuacuuuuaaaucuuuaauccaucuugaguaaaguuuuguauaugguuaauguuaaggggccaguuucuuucuucugcuuauggcuagacagguaucccagcaccauuuauugaauagagaauccuuucuccauugcuuauuuuuguugacuuugucaaaguucagauggcuguagauguguggcuuuauuucuggguucucuauuauguuccagugaucuaugugucuguuuuuguaccaguaccaugauguuuugguuacuguagccuguuguacuuuuaaacuauuuugguagucuuguauacauaaagcaauguucauggaaccuuucuauuuuaacuaguuugauauauauuuuguuccuugacauagaacagauaauauauguuacacuuuauguauucuaaauauuugacauguaauuaaauuuaagugaauauuuugcaugcucauauuauuauuacuguugccaaagacuguuuacacuucuaauaagaaagaauguuacaucagccaaacuaaauggccacaguagacauguuauuugauauccugcacugaguaguggguuuuuaaaaaaauuuguauguaagaaaauuauuaugcuauagauuauuucaaaucaaguguuauaaaauauuccuaagccuucuuagaauagcuauauacacuuuucuagaaaauugguggaaauuaucuuuugguauaaacuuuguauauguuuauagcauuaacuuacaacuccuagucuaaugauuuaugugugauuugcaugcaguaaauuuuauuaaaggaaugaauuaacuaguugccuguuaaugagaaugauguaacaaaagacuaggugaaguaauuaaauuuucaugaagcaguaucuaugaucaggcacauccuucccuauauuguuacaugccauauucauaggcuuauucaauuguguguuuugagaauuuuguauuaauagggcguuagauuguaagugucuugaagggggaucuuuuuuguggcacagacgcugauauguuauaggcaauuauuaaaugcuuauugagugaauaaacaugguuugcuccuuugauuuggguuuuuuuaaaucuagugguuggucuuggggguuuuguuuguuuuggcagcaaaggucuggcagaaaauguaugaggagguauuauagaacucuuaggauagaagacaagaauacuuuuuuguacaugcuguuuuuuagaaauauucuucaaaaugaaugggaguguuuuaaaaaggaaguacugaggggagcugacauauaacaugcaggguggaaggaaguguguaaaaaauagucauaaguuagugggcacaaaagagccugucacaccaugcuccuuucuccaggaggaucucuucucucuacuuuggaugagagaaaaccaugggcuuacucuaaaaaguacugugucccugcuuaauauagucagagggaggaugucacuuauuucauaguuaaacuugucauugcauccuguacacauauaaaaguagaaaauaaaaugaaguauugucuuuuauaccuugggggacugugacucagugcuggauuuuuagucaagaaccgaugcguacacuuuaauaauuuaauacagaaauaacccagaguaguuuuuacgcuaauaaaaggauauuucuugaagccugcuggggauuuuuuuuuuuaucaccaaaccagcucaguguuuauugauuaagagaguucuuugucagucuuugaauucuaauaguuuuacacaaaaauaaauaaauucuuacuaaaaauauguuacaaggcauccaucccuauauauugugaaauuguacuugacugcagugguaaacacauguaaauaaaaaggaaaauccucuguaccuguuagagcacugggaaaagcauaggucaacaguaugcauuuuaagucaugaaauagucuuaauucaacagaacagugauuuuucugguaacaguaauuugacauuacuagugauuugaagugaauugagccacugcaagacacucaauuuaugaaaaauuucuccugcccauguaaaauuaacuaugcuuaaugguucuaagauuauaauauucaugucuauguugaaauaauccaauuuaaauauauccugucguuaagacaaauaccuaguugacagaaaaaagaagcaaacuaaucuucuaucuguuuuguagugagcugauccaguuuauuacaacugguccuauuauugccauggagauuuuaagagaugaugcuauaugugaauggaaaagacugcugggaccugcaaacucuggaguggcacgcacagaugcuucugaaagcauuagagcccucuuuggaacagauggcauaagaaaugcagcgcauggcccugauucuuuugcuucugcggccagaguaagguguuuuaaaaauauuuuaaugcucuucuaguucuguuaaauguuuuauaucaaaggaaagcauuucuaucacuggugacuuaggguggauuuaugcugcugcucuaguaguagagaaaaccuuugacaucuugccuacuaucaaacagugauucagugugucuccuuugugaacugguaaccugaucaugaucaacguaaguuuucuccaauuaaaacacuucucauccuguuucuuguucccaagacuuaaauuacugaggcuccuaaauguuugaauuauugaauucauguaagaauaccaguuuauggcuaguagauauuaaaaagaagauauaauuugagauauuuccuuuugauucagacguaacacugugcuuucaagcuuaacauccuauuauuuuccuauauauagcuaguguuuaugaaaguuucucuacuccuuauuuuuaaauccauauaaauaaagcauuuauuggauuuauacugagguugaauuaaagaaguguaaguuuauuuuuagcaucgugagaagugucucacuuaagguaguuuuuaaucugguuguguuugcaaugaaacaauauuagacaguuuuauaauugauuucuuucuuuuuccuaccauuucaucagcaagucccuucagcucuuucaaaauaaacccugaaucugaucauuguggucugaaucacuauuauauuuugccagaacugcuacaauagccuccaaauucuuuuuuccucuuuucuuacacucaauuaaugaaaauuuuaccuuacccaaguaaaaucagcuaugcccagugaucuuuuaaagacaaaucagauuaacauucaccugcugaaaacccuucagugaauuucugucucuucuagaauaaaaucuaaagucuuuauuguggccuccaaugcucuaucuagucuggcccauaucuaucucuaacuguaucuuugaucaaucucuaucuuaaucauuguguuccaggcacacuaaccaucucgcuauuccuugaauagcauauuucugucuggaauggucaacuaacagcaaagaggacagugugguuggauaggaaugagagagggaggaagagggugaugagguuacagagguaauuaggggaaagauuauauggucuuauaggccguaguaguacuuuuagauuuuucucugaaaaaauagagagccauuuuaggguuuugaacaaaggacugauaucuuccacuugccauuuaaaaggaucauucuggcuguugcauuaagaaugacuauagaggcugggagugguggcucacaccuguaaucccagcacuuugggaggccaaggcgggcagaucauuugaggccaggaguucgagaccagccuggccaauaugguaaaacccuguuucuacuaaaaauacaaaaauuagcugggugugguggcgcccaccuguaaucccagcuacuccagaggcuaaggugggagaauugcuugaaccagggagguggagguugcagugaacugagaucaugccacugugcucuagccugggugacagagugagacuccaucucgggggaaaaaaaaaagaaugacuauagagggcaaaaacagcaacagggagccuaaucaggagucuguuggaauaacccagugagaugauggcuuggaccugggugguaauaaugaaagaaguauacaaauauauuuuaaaauauauauuaacgguugaaggucaaauaaacaagauuuucugcuagauugaauguagaguaugagaaaaagauaccaaguauuacuccaaaguucuuagccugauuaucagaaggauagaauuuacguaaacugaaaugaggaaaacuguggcuagagucagaaugaauggacaaucaggaguuaacguuuuggacauuuauaaacuuaaccuguuuguuaguuuuccaauuagacugaugaaaaaaauuagugugacagcuuagaguuaucagcacauaaaugguauuuaaagccgggagacugguugagauuaccaaggagaagguauagauagagaaguaaagaggaccaaagaugaagcuacaucuugauaaaagguaaggagaagaaggcagcaaaggagguugaagaggagccaccagagagguaagaggaaaaacugagagauaauuauguccuggaggccaagugaaucaaauauucuaaaaugagagaaugaccaguggugucaaauaaggcaaguaagaagaggacuaagaauggauuguuaaauuuugcaauguggauaucauuggugaacuuuguaaggugaauguugauggggagguggaggcaaaacccuguguggaguagacuuaaaagaaaauugugggacgggaauuguaguuagugaauauagacaacuuuuuuuuugaggaguuuuuuugaggaguuuuccugcaaagagaugaggugguagcugucaagaaaaguaguaucaauuuuuuuuaagaggagagguauuggguaaaaaauugaugauguaggaaaaagaggaagacuuguuggagcaauuucauuaauuaggcaaaaggaaauggaaauuagaacccagguggagagauuaggcaggugugccucucagguacucgucuauagcaacagaugggaagggagaauaugugaacacagaugcugauucuuaaguaggaagcaagaucaaaacagcugaaagugaggaugagguauaagguauugguuggucugaagggagagaagaauaugugaaauggugaucuggaaaaggaauagaucagggaaauguggugugugauugcuauacugaauuaauggcccauguaguguucauggccaugaacuaugagugugguucuccagccuguucaacugcauggcugaagguaaggaguagguggagagcuggcuuuuaaccauggcugugguuuugugaaacaaaugugacggaaguguuaaggaaguuaaagauacaugcaagagagcaauuauagucuuugaccauaucuuaguaguagacauuuauuguaaaugugguauuguuuuguauaguuaaauuuccaaucauauuuuaaagcauuauaaaaauaauaaacauaucuaauuaaugaaggaaauaauugaggcugaacugaaagucacuaccauguuuacugauauuuccugccuauuucacccuauuaccaccuuaugccauccauuucuuuuuuauuucuacuagauuauuuaauaaauuugagcauaaauauacuuguuagauuuuagcauaucuuguaguggagcaacuuuuguuaaguuagcuacugucucaguccauuuuguguugcugugaaggaauaccugaggcugggucauuuauaaaggaaaaagguuuauuuggcucauaguccugauggcugggacaucaagauugggcaucugcaucucgugagggucucaggcagcuuccacugccugagguggaagguaaaagggagccugcgugugcacagaucacaugguaagagaagaagcaagccaccgggagaggugucaggcuguuuuuaacaaccagcuuucagaggaacuaauagagggaaaauucgcucaccuuggagggagggcauuaaucuauucaugggauuuaccccuacuauccaaaccucccauuaggcccuaucuccaacauuggggaucaaauuucaacgugagauuuggaaggaacaaacauccaauccagagcagcuaccauugccauuucaccuaaagaaaugucuuaaacauauucguuuauauuuugugcauuuaauuuuuuuaaccucuuucugccauuaguuccugaaauauccuauuauuuguaugaacccuuuaggauauauauuuuuuuacccuugucuggggaagagugaguguuguugacauuauguuagguggcucuaggaauuaaggaaaaauauuguagcuggaaaaugagcuuaugugaagaagcaaagaccacaggucuuaaaaaauugaaaaacaucacagccccaaacuuaugcagccccaaacagccucuucuuuaccuugaauuccuauuaguuauugucuaauuuuucauuccaucuuuccagauuuuaccaaaacauagacuuauacucacuauuuucauuccucagcuaucuuugacuacucauuugugagcaauuguuaaaauuuagcauuauuuucaucauuccugaaaauacugucuuuggagaccaugacuugugucuuacuaauugguuuuucuuccuucacuuguccuuucagaugcugguauugugcaggcuucuuuucuugguuuacugcuuuucuugcucuaauuuucaguuuccuagucuguaaaauaagauaaugauugaaccugcauuauagaggucuuugaggauuaaaugaaauuauuucagugcuuaguauaguaccuagaacauaguauuuaaugaauggauguuaucuuuuauuauuaauauuuuacuugcauggugcuucccaaaccuguaucuguaauuuguacuggauguaauauuaguauacaaaaaucaauaguaaucuugauauacuugaaauaaccaguuagaaaauguaauuuuagaagagauuuccauucauacgguuaaaaaaaagucuaugacaccuagaauaaauugaacaaaagaugugggagaucuguauggagaaaauuauaaauauuuauuuuagagaauaaggaaagacauaaauaaaugaagauauaugccauguuuaugaaugggaagagucaguauccugaagauaucaguucuuuccaaguugaucuauaaauuggguaauuucauucaaaaucuuagcacagauuuucaugaaguuuaacaaacuuaugaaacagccaaggguccaaaacaguuaagacaguuuugaagagggagaaaaagauguggugaugauaaggugagacuuauuuuaaggauaucaugacuuuuuauaaagcuuuaguaggaaaaacugugguauuagcaugggaguagguaaguauaucaguguaacagucuagagugcucaagagaugacccaaauauaaugagaaguuggugccauuauaaaucaguggacaagggauagauugauuagucaauaaauugugugagauaauuuuauauggaaaaguguaaauuaacuucuuaaguuucuaucuaggauucuccuuagaguuucagacuuauauagaaauaauacauuugaaacugaacugacuacaauuuuuuuuuuuuuuuuuuggagacaagagucucacucugcugcccaagcuggaguucagugguuggugugauaauaguucucuauaacuuugaacccaugggcucaagccauccacuugccucagccucccaaguagcuaggacuacaggccuguaccaccauguccagcuauuuuuuuuuauuuuuucuaaagacagggucuugugauauugcccagucuggucucaaacuccuggucuccagugagccuccuucuuggccucccaaaaugcugggauuacaggcauaagccaucaugcccagccugcacugauuauaauuuaccaaaguauuccuuuuguauucuguacaucucuaggaaagaaauuugggagccaguauucuuucuucugcccuguuuauccccuuaauagaaucagcaaaagaucuuguagguuuuuccuucugaacauuuucuugaauuauucccuuucucuguauuccuaccaucacucuucuaguucugaccugggcugcugcaagaguccuggaauauacuuuucuaccucaaauauaucuuccacauaggcuucagaacaaguugucuaaaaauauuaauccgucaaucucaugacuauuaaaaauuuuuaaaguacuccauuauucccagaaucaaguucaagcuccuugacaugguuuccaaggcguuccagugaucugucucccagccccuccuccagccuuauauccugccucaccuucuguauacugugggauucuuacucuguugcuuuuacucauucuaccccucugccuuggaauuccaauucugccuuugcccagguaauuuuuauuugccuuuuaacacucagcucagaguucuuuauauuaugcauacaaauucuuuauccagagauaugauuugcaaguauuuucucaugguaugugguuugcauuuucauccucuuuaacaauaucuuuggaugagcaauuuuuacuucugaugaaguccaguaucaguuguucuuuaauguauugugcuuuaggugucaagucuaacaaacuguucccacaccuaaggucaccaauauuucauuauuugcuucuagaaguuuuauaguuuuaguuuuuauacuuaacucuaugaugcauuuugaguuaauuuuuauguaaggugcaagguaugaucacaauuuguuauucuuuagacauauauucuuccagcauuaugcugaaaagaccuuauuucuuuaauuaauugcuuuugcaccuuuguugaaaauguauugaauauauauaucugggucaauuucagcgauuuguuguguucuauucaucuacaagcauaccucagagauaauguagauuugguucagaccaccacaguggagugaauauggcuauauagggagucccaugaauuuuuuaguuuccugguauauaaaaguuauguuuauacuguaggcuacuaaaugcaauagcauugugucuaaaaaaaacuaugaauauaucaauuaaaaauacuucauugcuaaaaaaugcaugcuaacaaucaucugagccuucagcgagucauaaucuuuuugcugaucuuacuuugauguugaugucugcugauugaucaggguuguuuuugccaaagguugaaguggcugugucuauuucuuuuuauuauuauuauuauuauuauuauacuuuaaguucugggauacaugugcguaacgugcagguuuauuauguagguauacacgugccauggugguuugcugcacccaucaccccaucaucuacauuagguauuucucccaaugcuauccuuccccuagccccccaccccgcaacaugccacggugugugauguuccccuccuuguguucucauuguucaacucccacauaugagugagaacauacaguguuugguuuucucuuccuguguuaguuugcugagaaugaugguuuccagcuucauccauguccaugcaaaggacaugaacucauccauuuuuaugguugcauaguauucuaugcuguauaugugccccauuuucuuuauccagucuaucacugaugggcauuuggguugguuccaagucuuugcuauugugaauagugcugcaauaaacauacgugugcaugugucuuuacaacagaaugguuuauaauccuuuggguguauauccagaaaugggauugcugggucaaaugcuauuucugguucuagauccuugaggaauuaccacacugucuuccacaaagguugaacuaauuuacacucucaccaacaguguaaaagcguuucuauuucuccacauccucuccagcaucuguuguuuccugauuuuuuaaugaucaucauucuaacuggcaugagaugguaucucauugugguuuugauuugcauuucucuaaugaccagugaugagcuuuuuuucauauguuggcugcauaaaugucuucauuugagaagugucuguucauauacuuugcccacuuuuugauggggcuguuuguuuuuuucuuguaaauguguuuaaguuccuuguagauucuggacaguagcccuuugucagaugaacagauugcaaaaauuuucucccauucuauagguugccuguucacucugaugauaauuucucuuuugcuaugcagaagcuuuuuaguuuaauuagaucgcauuugucaauuuuggcuuuuguugccauugcuuuuggucuuuuagucaugaagucuuugccuaugccuauauccugaaugauauugcugagguuuucuucuagaguuuuuaugguuuuaggucuuacauuuaugucuuuauccaucuugaguuaauuuuuguauaagaugaaaggaagggguccaguuucuguuuucugcauauggcuagccaguuuucccaauaccauuuauuaaauagggaauccuuucaccauugcuuguuuuugucagguuugucaaagaucagaugguuggagaugugugccuuuacuugugaggccucuguucuguuccauugaucuauacuguuuuaauuugggacauuuacagaaaugauauucauuuuaaauuacuauuacaaguacaaaguuuuggagaaacuuuuaacuggccaccauuuagccauacuuuuauuaucauaauaaaauuauuaguauagauuaauuacaaaugcuuuagugaaauuaccaggaaauccuaucagcgugaaaauuuaugaaguaguacaacuauauacuuuauaauuuguuuaaaaauuuaaaaauuauauaccuaaagcuuucgaauucagucugaauuuuuaauuuuuuguaaagcuauaaauauuuauucuuuccuacuagggaauuuaggaaaauguaaaaggccaagaguaauagcaggaaucuuuggaagaacaggaucuuuauacaaaauauuuuagccccucaaaucccaaagaagccuggauauuauuuuugugacuuuguuuuauaaagacuuugaauuaauugccauaacaaugaccuaguaaaagcgcucuuauucacguuucacuaagaagauauauuuauguaaaaucuuuaugcuuuauaaauaaauauuuauucagcauagguaaauaugguacuugaaaaucuggguaguuggaaagcuggcauuuuuauuuuuaaaaauugagcgagaaaagaaaucaaaggaaaguugagacaaaaauaauuggucaauuaauuguuaaauaauuuguuaaacuagagacagaacaauuuaucacugcuuuuuacuuuggaaagacagauaauagaaaaaguacaugguuuuuggagcuacagucacuuggauuugaauccuggcuuugccacuugcuaacuuguaagggcuuguuacuuaagcuuucugagucucauuuuucucauuuguacacuguggauauauuuauuuuguuuagcacaugcagaauuuauuaggugcugaauuucagucauucccaaauauucauugagaaacugcuagugaacaaguaauaaagauggacuaagcccuggugcucuccaacacauagaggucagcuagauaggagaaaaccaucgaaggagacugagagggaguagccagugagguaggaagaaaggcaaguaaugaaagcauuccagaguguaggaugugacaaacugugucaaauacuguuggucagguaaggugagggcugagaauaauuaaccaguggacuuagcaacauggagguaguaagggauuuuaaugagcagcuuugguggaaugaaaaccuaauugguuguggauuuaaaagagacuguaggagaggaaguaaaaauggaaauggaaaagaaagacauuucuuuugaauuuuguugugaagggaacagaccaaugggaacucucgaaagagcaugcccuuucuaguuugcuacucuaucauauucucuugucacaccacuucuacuucauuccuucauugaucaucugccaggucccuguagguauuugaauuuucaucuguaccauaaagguucucucggaccaugcaaucaaagcaucugguauaggacuaaaagggguaguugcuguuguuauugauuaaaaagaauaauaaauaauggcagcaauaugauagaaaggcaguugguaucuuaggaauagaacacuuuuuauucuagugucuuaccacuggaaaugcucagguguauacacuacuauuugaauaauuccucaucauccuuguguuuaaaaaaaugcucaucaguguggcacauuaacacauucuauaaucuuuucauuuuaaauuuaaugaaaaauaaauacaguugauccauaaacaacacagguuugaacugcacgagucuacuuauauguggauuuuuuucaacagaaggauugaaaaugcaguauuugcaagaggugaaacucacaucuacagagauuugacuuuuccuauaagcagguuccacagggcugacugcaggacuugagcaugcauggauuugaguacacacagggauuugaguaccaaucccuuguguauaccaagggcuauuugcauugagccagacauuguuuuaggugcuagggguccuacagagcuauacaacuuaguucccucuuuuucaaauuuaugauuugauggaagauaaguacccaaauaaccauaacuuugggggaacaaagguugccggaaggaggcaucaggaaaugccuccuaguggaaagugguauuugagguggcucuuuacacauugguaagauucuuuggagcuugagucagaggguuuuauaggaaauaguagaaauaauagcagugaaagcuuagagacaggaaagcaucuaaauaauuaaaagaacugauuagugugaacaucuuuguggcuaguucaaauuguuguguugucauuuuagugaaccacaugcaaagugaauaacacagccugaaucuguuuauaaaacaugguucauuugauuuuauuuuauacuaggccuauaguuaguuuuaaguagcuguaguucucagauuccugauauuaaucucuguuccuauaaaauuuccuaguuuuaaauuuuauuuuacauauuuuaaugaaaaauuuaaaauuaaauuugugucuaauuaacuaaugcuuuggggagaauaagaacuuuauauugguauuuccaauauucaaaauuuauuaaaucuuuguccacuauauuccuggaacaaaaugacacauauucucauugcuuugauugauacuucuuuauaugcucuucugguucuaagucuugaaacaggguuaauuuaaucagugugucuuuguaaaacucauuuuuagaaaaucugaaacaaaaaauuuauaugaugaaacucuaaaaguaauugcaugauucuccucccccacagaaauaucuuguaaguucaagauaagagaucacauuugucaaaaucauuucucucugucuuuaggaaauggaguuguuuuuuccuucaaguggagguugugggccggcaaacacugcuaaauuuacuaauuguaccuguugcauuguuaaaccccaugcugucagugaagguauguugaauacacuauauucaguacauuuuguuaauaggagagcaauguuuauuuucuugauguacuuuauguauagaaaauaaaguauacuuuuaguauuuccauuuuuuuucuuugaaggcacuugaguaaaggugacaaaauauaagggaaaaucugucuaaaucucuauuugucuuuucuuuguggauuuuuaggagguguucuuugaguugcugaucaugcucaggcucagucauacuguuacagaucuuggcuaauugacuuuuagucugccuucucucuuucuaaucacaaauugugauucacuuaauuuacuucaauagcacuuuuuuuuuuuuuuuuugagacagagucuaguucuguuguccaagcuggagugcaguggcaugaucucgaguuacugcaaccucagccucccgaguagcugggacuacaggcacaugccaccaugcccagcuaauuuuuguauuuuuaguagagacaggguuucaccauauuggucaggcuggucucaaacuccugaccucagaugaucuacccaccucggccucccaaagugcugggauuauaggcaugagccacugugcccagccaauagcacuccuguuguacaaauuaaaacaaugucugccauaccucuaguauacccuuucugagaaggcuggagaaauuuccuucaguucuuuguaucugaaacaguucuuugacauauguauguauauacauguuugcauauauauacauauauaaagagaaagaguuugcaaguucuuuucuuauuuuugucucaauuucuuuauuuuauuuauuuuagucugguauauauauuuuuguuagguaucucaaaucuuuuuggaaguaagaugggguaugguuaaaaagaucacccuuaaaaaacuagaauauacuaaauaauauacagaagugauuggauuuuaaaauuuuaugucuccuaaguauccaaguaauccauguauauaguagaaaauuggaaauaaaaaaccauuaaaaaugaaguaaaaaaauacugaauucccaucaccugaagauagucauuguuaauguuuugaugcauuuccuccaaaucauuuuuuucugcauuuguaugugcauguguguacacugcuacacaugaauguaaugguugagauguaggucuauaggcuguuguuuaaauauaauuuuugugagcauuucuggcugcuguuaaguccucauuaauauuuuaauagauucuuuaauauuuaacagcaauuguauagauguaguaugguauuuggauacuuagguuguuuucaguguuuugauauuaaaauuaaaacuuugaagaauaucuuuauacguaaauauuugaugauaucucuaaucuuuuccucuggcuaguuuccuagaaauagaauuacuuguuggaaggauaugagccuuaaagaucuugcugcauaauuaauacuucuuuaauuuuuuaggaaguauuuuaguauauuguaaauccuuaggaccaugauuauaaguaacuaacaugcagcauggauaacaaacacuuauggagaauauaccauuaugugccagguggcagacugguuccuuauacauuauuuuuaaucuucacagcaaguaugucaaguagguaaauuuguugcucuuuuccagauaggcaagcuaagguuccaugagauuaaguuguuucuccuaauuuggaauggaaauugaggaugcaaacccuguuuguuuguuuguuuguuuuuaaucuccauucuguucccucuauacucuauugcccuaauagcaauagccacaaaaaagucacauggcacaugauuaguaacaauuccauaggaagugauaguaauauuugaaauggcugguguugaaaauuuauggaaaaaaaccugggauuuuauguuucacucauuuuucuuagcuggagagauuguguauguguaugugagugucuacacaggugugguaucccuaauccaaaaaucugaaacccaaauuacuccaaacuccaaaacuuuuugagcacagacaugaagcucaaaggaaauggucguuguagcauuuucaaccacugguuuauguuuauuggauuuuugaauuggguaugcuccacaaauacguaucuacagauauuucaaaaucaaaaaaaaaauugaaauccaaaacacugcuugucacaagcauuucuguaaggaauauucaaccuguacacacacacaugcacauacauacacccguguauauuuguguacauauacauauauacauaaacacacauaguacacucacauuuugaaaaaguucuuguuuauaggcaucaacuuuuuaaaaagcuuauccuugacacccuaaaauguuuuauucaauuuaccugaucuaauccuuuucaaggaaaaauauguugcaaggagagugaaauaaaauaaagugguacuagaauaaauacuaguuguauaccuuaauaauugcacauauagcugggagaacugauagccacauggagaaaauugacacgggaccccuuccuuauaccguauacaaaaauuaacuuaagaugaauuaaagacuuaaauguaaaacccaaaacuauaaaaacccuaguagaaaaucuagucaauagcauucaggacauaggcaugggcaacaauuuugugaacaaaaugugaaaagcaauuacaacaaaaacaaaaauugccagauuggaucuaauuaaacuaaagagcuucuguacagcaaaaugaacuaucaucagagugaacagacaaccuacagaaugagagaaaauuuuugcaaucuauccauuucacaaagguuuaauaucuggaaucuacaagggacuuaaauuuacaagaaaaaacaaccucauuaaaaaguggucaaaggacauggacagacccuucucaaaagaagacauucaugcacccaacaaacacaugaaaaaaagcugaagucaaauugcuaacuagaauaaccaaugcagagaagaacaugaaugaccugauggagcugaaaagcauagcacaagaacuuugugaagaauacacaacuaucaauagucaaaucaaucaaguagaagaaaggaugucagugacugaagaucaacuuaaugaaauaaaaagagaagaccagauuagagaaaaaagaauaaaaagaaaugaacaaagccuccaagaaauaugggauuaugugaaaagacaaaucugcguuugauugguguaccugaaagugacggggagaaugggaccaagucggaaaacacucuucaggauauuauccaggagaacuuccccaaacuagcaaaacagaccaacauucaaauucaggaaauacagagaacaccacaaagaugcuccucgagaagagcaaccccaagacacauaaucauuagauucaccaagguugaaaugaacaaaaaaauguuaagggcagccagagagaaagguuggguuacccacaaagagaagcccauucagacuaacagcagauaucuuugcagaaacccuacaagccagaagagagugggggccaauauucaacauucuuaaagaaaagaauuuucaacccagaauuucauauccagccaaacuaagcuucauaagugaaggagaaauaaaauccuuuacagacaagcaaaugcugagggaauuugucaccaccagaccugccuuacgagagcucuugaaagaagcacuaaauaugaaaaggaacaaccaguaccagccacugcaaaaacauaccaaauuguaaagaacaucgacacuaugaagaaacugcauuaacuaaugggcaaaacaaccagcuaacaucauaaugacaggaucaaauucacaacuaacaguauuaaccuuaaauguaaacaagcuaaaugccccaguuaaaagacauagacuggcaaauuggguaaagagucaagacccaucagugugcuguauucaggagacccaucucacuugcaaagacacauauaggcucaaaguaaagggauggaggaauauuuaccaagcaaauggaaagcaaaaaaagcaggaguuguaauccgaaucucugauaaaacagacuuuaaaccaacaaagauaaaaagagacaaagaagggcauuacauuaaugguaaagggaacaaugcacaagaaguacugacuauccuaaauauguaugcacccaauacaagcgcacccagauucauaaaguacaugcuuagaggccuacaaagugacuuagacucccacacaauaaaagugggagaauuuaacaccccagugucaauauuagacagaucaacgagauagaaaaauaacaaggauauucaggacuugaacucagcucuaaaccaagcagaccuaauagaccuccacagaacucuccaccucaaaucaacagaauauacauucuucucagcaccucaucacacuuauucuaaaauugaccacauaauuggaaguaaaacacuccugaccaagugcaaaagaauggaaauuauaacagucucucagaccacagugcaaucaaauuagaacucaggauuaauaaacucacucaaaacugcacaaaauacauggaaacugaacaaccugcuccugaaugacuacuggauaaauaacaaaauaaaggcagaaauaaagauguucuuugaaaccaaugagaacgaagauacaucauaccagaaucucagggacacauuuaaaguagucuuuagauggaaaauuauagcucuaaaugcccacaagagaaagcaggaaagaucuaaaauugauacccuaacaucaaaauugaaagaacuagagaagcaacagcaaacaaauucaaaagcuagcagaagacaugaaauaacuaacaucagagcagaacugaaggagauagagacacaaaaaacccuucaaaaaaucaaugaauccgugaacugguuuuuugaaaaaaucaucaaaauagauagacugcuagccagacuaauaaagaagaaaagagagaagaaucaaauagauucaauaaaaaaugauauagaggauaucaccacugauccuguagaaacacaaacuaccgucagagaauauuuuaaacaccucuacgcaaauaaacuagaaaaucuagaagaaauggauaaauuccuggacacauacauccucccaagucuaagccaggaagaaguagaaccccugaacagaccaauaacagguucugaaauugaggcaauaauuaauagcuuaccaaccaaaaaaaguccaggaccagacagauucacagccaaauucuaccagagguacaaagaggagcugguaccauuccuucugaaacuguuccaaacaauagaaaaagagggaauccuuccuaacucauaaaaugaggccagcaucauccugauaccaaaaccuggaagagacacaacaaaaaaagaaaauuucaggccaauaucccugaugaacaucuaugagaaaauccacaauaaaauacuggcaaaccgaauccagcagcacaucaaaaagcuuauccaucacaaucaaguggcuucauugcuggaaugcaaggcugguucaacauacacaaaucgauaaacguaauucaucacauaaacaaaaccaaugacaaaaaacacauaccucaauagaugcagaaaaggccuucaauaaaauucagcaccccuucaugcuaaaaacucucaauaaacuagguauugauggaacauaucucaaaauaauaagagcgauuuaugacaaacccacagccaauaucauacugaaugggcaaaagcuugaagcauucccuuugaaaaccggcacaagacaaggaugcccucucucaccacuccuguucaacauaguauuggauguucuggccagggcaauaaggcaagagaaagcaauaaaggguauucagauaggaagagaagaagucaaauugucucuguuuacagaugacauuauuguauauuuagaaaaccccauugucuuagcccaaaaccuccuuaugcugauaagcaacuucagcaaagucucaggauacaaaaucaguaugcaaaaauuacaagcauucuuacacaccaauaauggacagagagccaaauugugcaucaacucccauucacaguugcuacuaagagaauaaaauaccuaggaauacaacuuacaagggauaugaaggaccucuucagggagaacuauaaaccacugcucaaggaaauaagagaggacacaaacaaaugggaaaacauuccaugcucauggauaggaagaaucaguaucacgaaaauggccauauugcugaaaguaauuuauagauucaaugcuauccccaucaagcuaccauugacuuucuucacagaauuggaaaaaaacuacuuuaaacuucauauggaaccaaaaaagagccugcguagccaagacaaucuugggcaugaagaacaaagcuggaggcauuaugcuaccugacuucuaacuauacuacaaggcuacaguaaccaaaacagcaugguacuuauaccaaaacagauauguagacaaaaggaacagaauguaggccucagaaauaacaccacacagcuacaaccaucugaucuuugacaaaccugacacacacaagcaauggggaaaagauucccuauuuaauaaauaguguugggaaaacuggcuagccauaugcagaaaacugaaacuggaccccuuccuuacaccuuuuacaaaaaucaacucaagauggaucaaagacuuuaauaagaccuaggaccauaaaaaucuuagaagaaauccuuggcaauaccauucaggacauaggaaugggcaaagacuuuaugucuaaaacaccaaaagcaauggcaacaaaagccauaauugacauaugggaucuaauuaaacuaaagaguuucugcacagcaaaagaaacuaucaucagagugaacaggcaaccuacagaauaggagaaaauuuuugcaaucuauccaucugacaaagggcuaauaucuagaaucuacaaagaauguaaacaaacuuacaagaaaaaaacaaacaaccccaucaaaaaaugggcaaaggauaugaacagacacuucucaaaagaagugcagccaacagacauaugaaaaaaugcuccucaucccuggucauuagagaaaugcaaaucaaaauuacaaugagauaccaucuuacaccaguuagauuggugauuauuaaaaagucaggacaugacagaugcuggagagguuguggaaaaaugggaacgcuuuuacacuguuggugggaguauaaauuaguucaaccauuguggaaaacaguguggugauuccucaaggaucuagaauuggaaauaccauuuggcccagcaaucccauuacuaggcauauacccaaaggguuauaaaucauucugcuguaaagacagauucacauguauguuaacgcagcacuauucacaauagcacagacuuggaaccaagccaaaugcccaucaaugauagacgaauuaagaaaauguggggaggagccaagauggccgaauaggaacagcuccagucuacagcucccagugugagugacacagaagaugggugauuucugcauuuccaucugagguaccggguucaucucacuagggagugccagacagugggcgcaggacagugggugcagcgcaucaugcgcgagccgaagcagggcgaggcauugccucacucgggaagugcaaggggucagggaguucccuuuccuggucaaggaaaggggugacagacggcaccuggaaaaucgggucacucccacccaaauacugugcuuuucugauggcuuaggaaauggcgcaccagaaggucauaucccgcaccuggcuuggaggguccuaugcccacagagucucguugauugcuagcacagcagugugagaucaaacugcaaguuggcagcaaggcugggggaggggauccugccauugcccaggcuugcuuagguaaacaaagcagccuggaagcucgaacuggguggagcccaccacagcucaaggaggccugccugccucuguaggcuccaccucugggggcagagcacagacaaacaaaaagacagcgguaaccucugcagacuuaaaugucccugucugacagcuuugaagagagcagugguucucccagcacccagggggagaucugagaacgggcagacugccuccucaagugggucccugaccccugacccccaagcagccuaacugggaggcacccccacaggaggggcagacugacaccucacacggccagguacuccucugagacaaaacuucaagaggaacaaucagucagcagcauucacaguucaugaaaauccacuguucugcagacaccgcugcugauacccaggcaaacagggucuggaguggaccucuagcaaacuccaacagaccugcagcggaggguccugucuguuagaaggaaaacuaacaaacagaaagaacauccacaccaaaaacccaucuguacaucaccaucaucaaagaucaaaaguagauaaaaccacaaagauggggaaaaaacacagcagaaaaacuggaaacucuaaaaagcagagugccucuccuccuccaaaggaacgcaguuccucaccagcaauggaacaaagcuggauggagaaugacuuugacgaguugagagaaggcuucacaugaucaaacuacugcaagcuauaggaggaaauucaaaucaaaggcaaagaaggugaaaacuuugaaaaaaauuucgacgaauguauaacuagaauaaccaauacagagaagugcuuaaaggagcugauggagcugaaagccaaagcucgagaacuacgugaagaaugcagaagccucaggagucgaugcgaucaacuggaagaaaggguuucagugauggaagaugaaaugaaugaaaugaagugagaagggaaguuuagagagaaaagaauaaaaagaaacaaacaaagccuccaagaaauaugggacuaugugaaaagaccaaaucuaugucugauugguguaccugaaagugacggggagaauggaaccaaguuggaaaacacucugcaggauauuauccaggagaacuuccccaaacgagcaaggcaggccaacauucagauucaggaaauacagagaaugccacaaagauacuccucgagaagagcaacuccaagacauauaauugucagauucaccaaaguugaaaugaaggaaaaaauguuaagggcagccagagagaaaggucggguuacccacaaagggaagcccaucagacuaacagcggaucucucggcagaaacucuacaagucagaagagagugggggccaauauucaccauucuuaaagaaaagaauuuucaacccagaauuucauauccagccaaacuaagcuucauaagcgaaggagaaauaaaauacuuuacagacaagcaaaugcugagagauuuugucaccaccaggccugcccuaaaagagcuccugaaggaagcgcuaaacauggaaaggaacaacugguaccagccgcugcaaaaucaugccaaaauguaaagaccaucaagacuaggaagaaacugcaucaacuaacgagcaaaauaaccagcuaacaucauaaugacaggaucaaauucacauauaacaauauuaacuuuaaauguaaauggacuaaaugcuccaauuaaaagacacagacuggcaaauuggauaaagagucaagacccaucagugugcuguauucaggaaacccaucucacgugcagagacacacauaggcucaaaauaaaaggauggaggaagaucuaccaagcaaauggaaaacaaaaaaaggcagggguugcaauccuagucucugauaaaacagacuuuaaaccaacaaagaucaaaagagacaaagaaggccauuacauauugguaaagggaucaauucaacaagaagagcuaacuauccuaaauauauugcacccaauacaggagcacccagauucauaaagcaaguccugagugaccuacaaagagacuuagacucccacacaauaauaaugggagacuuuaacaccccacugucaacauuagacagaucaacgagacagaaagucaacaagcauacccaggaauugaacuuagcucugcaccaagcggaccuaauagacaucuacagaacucuccaccccaaaucaacagaauauacauauuuucagcaccaccccacaccuauuccaaaauugaccacauaguuggaaguaaagcucuccucagcaaguguaaaagaacagaaauuauaacaaacugucucucagaccacagugcaaucaaacuagaacucaggauuaagaaacucacucaaaaccacucaacuacauggaaacugaacagucugcuccugaaugacuacuggguacauaacgaaaugaaggcagaaauaaagauguucuuugaaaccaacgagaacaaagagacaacauaccagaaucucugggacacauucaaagcaguguguagagggaaauuuauagcacuaaauggccacaagagaaagcaggaaagauccaaaauugacacccuaacaucacaauuaaaagaacuagaaaagcaagagcaaacaacauucaaaagcuagcagaaggcaagaaauaacuaagaucagagcagaacugaaggaaauagagaccaaaaaacccuucaaaaaaucaacgaauccaggagcugguuuuuugaaaggaucagcaaaauugauagaccgcuagcaagacuaauaaagaaaaaaagagagaagaaucuaauagacgcaauaaaaacugauaaaggggauaucaccaccgaucccacagaaauacaaacuaccaucagagaauacuacaaacaccucuacgcaaauaaacuagaaaaucgagaagaaauggauaaauuccucgacacauacacucucccaagacuaaacgaggaagaagucgaaucucugaauacaccaauaacaggcucagaaauuguagcaauaaucaauagcuuaccaaccaaaaagaguccaggaccagauggauucacagccgaauuguaccagagguacaaggaggaacugguaccauuccuucugaaacuauuccacugaauaaaaaaagagggaauccucccuaacucauuuuaugaggccagcaucauccugauaccaaagucgggcagagacacaaccaaaaaagagaauuuuagaccaauauccuugaugaacauugaugcaaaaauccucaauaaaauacuggcaaacugaauccagcaagcacaucaaaaagcuuauccaccaugaucaagugggcuucaucccugggaugcaaggccgguucaauauacgcaaaucaauaaauguaauccagcauauaaacagaaccaaagacaaaaaccacaugauuaucucaauagaugcagaaaaggccuuugacaaaauucaacaacccuucaugcuaaaaacucucaauaaauuagguauugaugggauguaucucaaaauaauaagagcuaucuaugacaaacccacagccaguaucacacugaaugggcaaaaacuggaagcauuccauuugaaaacuggcacaggacagggaugcccucucucaccacuccuauucaacauaguguuggaaguucuggccagggcaauuaggcaggagaaggaaauaaaggguauucaauuagggaaagaggaagucaaauuguaccuguuugcaggugacaugauuguauaucuagaaauccccauuaucucagcccaaaaucuccuuaagcugauaagcaacuucagcaaagucucaggauacaaaaucaauguacaaaaaucacaagcauucuuuuuuuuuuuuuuuuuuuuuuuuuuugagacggaguuucgcucugucgcccaggcuggagugcaguggcgcgaucucgacucacugcaagcuccgccucccggguucacgccauucuccugccucagccuccuguguagcugggacuacaggcacgcgccaccaugcccggcuaauuuuuguauuuuuuuuaguagagacgggguuucaccguguucuuauacaccaauaacagacaaacagagagccaaaucaugagugagcucccauucacaauugcuucaaagagaauaaaauacguaggaauccgacuuauaagggacgugaaggaccucuucaaggagaacuacaaaccauugcucagugaaauaaaagaggauacaaacaaguggaagaacauuccaugcucaugggugggaagaaucaauaucgugaaaauggccauacugccuaagguaauuuauagauucaaugccauccccaucaagcuaccaaugccuuucuucacagaauuggaaaaaacuacuuuaaauuucauauggaaccaaaaaagagcccacaucgccaacucaauccuaagccaaaagaacaaagcuggaggcaucacgcuaccugacuucaaacuauacuacaaggcuacaguaaccaaaacagcaugguacugguaccaaaacagagagauagaugaauggaacacaacagagcccucagaaauaaugccacauaucuacaacuaucugaucuuugacaaaccugagaaaaacaagcaaugggaaaaggauucccuauuuaauaaguggugcugggaaaacuggcuagccauauguagaaagcugaaacuggaucccuuccuuacaccuuauacaaaaauuaauucaagauggauuaaagacuuaaacguuagaccuaaaaccauaaaaacccuagaagaaaaccuaggcaauaccauucaggacauaggcauaggcgacgacuucaugucuaaaacaccaaaagcaauggcaacaaaagccaaaauugacagaugggaucuaauuaaacuaaagagcuucugcacagcaaaagaaacuaccaucagagugaacaggcaaccuacaaaaugggagaaaauuuucgcaaccuacucuucugacaaagggcuaauauccagaaucuacaaugaacucaaacaaauuuacaagaaaaaaacaaacaaccccaucaaaaaguggacaaagaauaugaacagacacuucucaaaagaagacauuuaugcagccaaaagacacaugaaaaaaugcucaucaucacuggccaucagagaaaugcaaaucaaaaccacaaugacauaccaucucacaccaguuagaauggcaaucauuaaaaagucaggauacaacaggugcuggagaggauguggagaaauaggaacacuuuuacacuguuggugggacuguaaacuaguucaaccauuguggaagucaguguggcgauuccucagggaucuagaacuagaaauaccauuugacccagcaaucccauuacugguauaauauauaccuaaaggacuauaaaucaugcugcuauaaagacacaugcacacguauguuuauugcggcacuauucacaauagcaaagacuuggaaccaacccaaauguccaacaaugauagacuggauuaagaaaauguggcacauauacaccauggaauacuaugcagccauaaaaaaugaugaguucauguccuuuguagggacauggaugaaauuggaaaucaucauucucaguaaacuaucgcaaggacaaaaaaccaaacaccgcauguucucacucauagaugggaauugaacaaugagaacacauggacacaggaaggggaacaucacacucuggggacuguugugggguagggggaguggggagggauagcauuaggagauauaccuaaugcuaaaugacgagucaaugggugcagcacaccagcauggcacauguauacauauguaacuaaccugcacauugugcgcauguacccuaaaacuuaaaguauaauaauaaaaaaaaauuaagaaaaaaauagaaaagaaaguguggugcauauacgccauggaauacuaugcagccuuaaaaagugaugacuucauuuccuuugauuggacauggaugaagcuggaaacugucauucucagcaaacuaucacaagaucagaaaacuaaacacugcauguucucacucauaagucugaguugaacaaugaaaacacauggacacagggaggggaacaucacacacuggggccugucagggggugggaggcuaggggagggaugacauuaggagaaauaccuaauuauaugugauagguugaugggugcagcuaaccagcagggcacguguauaccuauguaacaaaacugcacauucugcacauguaacuuagaacuuaaaguauaauaauuuuaaaaaaagcucaacaucacugaucauuaaagaaaugcaagucaaaaccacaaugagauaccaucucacgccaguucgaauggugaucauugaaaagucaagaaacagccguugcuggugaggcuguggagaaaaaggaacacuuuuacacuguuacugggagaguaaaauuaguuccuucauuguguaugacaguguggugauuccucaaagaucuagaggcagaaauaccauuugacccagcaaugccauuacuggguauauacccaaaggaauguaaaucguucuauuauaaaaauacaugcacguguauguucauugcagcacgguucacaauagcaaagacauggaaucaacccaaaugcccaucaaugauagacuggauauagaaaaugugguacauauacaugauagaauacuauguagccauaaaaaggaacaagaucauauccuuugcagagacauggauggagcuggaagccauuauccucagcaaacugacucaggaacagaaaaccaaacacugcauguuuucacuuaccaguggcagcugaacaauaggaauacauggacacauggucagggaacaacacacgcugcggccugucauggggggcggggggagggagagcaucagaaagaauagcuaauggaugcugggguuaauaccuagauaaugaguugauaugugcagcaaaccaccauagcacacauuuaccuauguaacaaacuugcacaucaugcacaugugucccagaaguuaaaauaaaaguugaagaauaaaaauugcacauguaacuaaaaccaaaaaauacuguauguaagugaaaguugauaucaaaauaacuauuaauaauuuuaauauauuauuuuucuguuuauacaggauuuaaugguuuuuagagcuauuuauagauuauauuuuauauauuuauauuugauauauaacauuaggucauauaacuuaauuaaggcaaagaaauuuuuguaaaaaucuacucagauggcagaauaaacuuuggcaacccaaggcuuuuuuuuccuuuuauuucuaaaccuguauuuuuggaauaauuuaagaccauuuugaaguauguaauuaacccaguucagauuaaacugccauuuuaaugaaauauaguuugaagucucauauugaauuuauuauuagguucacauggcccccuuucauuugcugguuuauguuuaucuguuucuauaauaaucccaucuccugguauuaauauauuuaauauuaccuguaauauaguauaggcaugaaagauuuuuauuuuuauuuuuaaagauuuuuauuuuaaaaaaggaguugcugauaagagagcagcugaaauggaauaggauuaucccuucuguugacugcugacuucccaaaaaaaggccagaauauccuguugaugaagcaaagcuaaguuuauuccuuaauacaauaaagggcaagcacaaccuugauagagccuuaguagacucugcaagggagaguucagggguagauauugcaaaaccuugagauguuuaagagcuuucaaugcagucgucugauugagacgacagcguucaugauauaauaaugguugaagguuuguagcaacagcaggcuaaggaucuuaaccaagucuuguaaauacacaguuguuugauaaaugaguuguuugagcaguagagggaguacugugaaaggggacuguuugaguacucuauuguugggguaaauggauuuuugggaaguuccugaagccaacagugaaguuauuuacugauuuacugccuuaucuuucugggcaagaaacuucuuggcacaaguaguagucauguguauguaggcggccuuaguucauagaccuauaguuaaucuauguggaugcagugguuucacuucucauuucuaagagagcuagaacauaaagaguucuuggucugugagauaaauugugggaaaaauaagguauauuugaggcaucuguggucuuuuuagauaugcagauuaaaauauauugucauuuuaggacucagguuuuaaaaggaaagaaaaacaaggugaauguucuuguguucuuuuuacuuuaaaaauuaugcaauguguuuauuauguucucaguauuguuuauagguuauaguuauuaauuccauccauaaaauaaauuacuuuuacucugaaaucaggcuguuuagguuugaauucuggcucugccacuuacuagcuaugggauauuggauuaauuacuucaucucuuucuaccuuguuuccuuauuucuaaaaugagaauaauucuauacauuuuucaugggguaacuaaggauuaagugcauuaguguauggaaggugcucuagacaguucccagcacguaguuuagugcuguauaaguguuacacauuguuaguauuaugauuacuacucuauuacuacuacuacugcugcugccacuaauaucauuaucuuuuaauuuuuaagcaaaguugaaugacugucuuguaacaaaguaauaguuuuauaaugcuaacaaaaauccaacauuuacauucaucaucuacagggagaaaaauguagucauuguuaaaggaauaaagugcuuuaauuuuuuuccccaguuaaagccuaggucugauuuaagugcaugaaguagguuuauugcuuacaucugguugauucaguagcuauuuuuugauugccuauuaugguugacacugggcaagaggagguagccaaaucugggagaguggcuuuuauacuuguaauggagaaacaauuuagucuuuuuauugaguaguagaacccugaaauuuuguuagaaauuuuccuuauaacagauuuaugcauuaaacaauuuuacugcauuguuuauaacaguccuuuuugaaguuuaguuucaucaguaaaaugaguuaagauuguuuuaaaguuuuaucugagcauuuaaacccaguuauucuauuauucugugaaacuguguagaaaauucuuauaaaggaaaauuuuggccaggcaugguggcucaugccaguaaucccaguacucuaggaggccgagguaggaggauugcuugaggccagggguuugaaaucagccaggccggcauagcaagacccugucuauauuaaaaagagagagagauagagaaaaauaaauaaauuggaaauuguauucuauaccuugauguuguguuuugguuguaaaaaauaauucuauuuucauggagaauguuucaaagaaaguuuagauauuuugugguugucugcauuuaauuuacuaggaagcaaauuauuuauuagaauauugaccaauuuguaaauuuagcaucagaauuggcucugguauaagaauuaaaaugagacugguaggcgcuaggucuuauuuaucauguccucacuuuuagaaauuggguuauucuuacucagagccucuuucagaguuuuacuauccacuguaaugguagcuuuggugcuguguaagccaagagcccugguagaugcaugcaaccuccuaaauuugggccgauugaaucaguuaagugcucagcuuuuucauauuugauuuccuucaugcaguucauccacuaggauacugugaaagaggcaugacauuuuuugguauaaagagagcuaaacaucguauauuuaacucaguuuuaacaaaaauuccagaaguggucccaguuuugcuuagaaugucaccauuuuggaguuuugugaauguguucuguucuaucugaaaaaguaaacaguuggauggaauuuuaucaauugcaccaaguacacugaacuacauguuaggacccugacuuugaaugcacagagcuuagcauacauuuuugaaacauaaaauuauagacagugaaaauauccuaaggaucuguaaguuuuagggacuuuaaauaaaacuggugauuuauugauuuagaaggaaucucaagaguucuguuagucccuacaaaagaauccuaauuuugaggaaggauugcauuuaauggcccugaagagguaaguauguauuaagcuuaagaaaaaucauuuacaaauagugaaauuuagauauuauugcuguauaacaaacuauccuaaaauauuuuuuaaauuuaauuuaacucuuaaaaauauuuuaacuucuauuuuagguucagggguacaugugcaguuuuguuauguaggcaaacucuugacucgggguuuaguuaacagauuauuucgucaccccauuaccaagcacaguacucuguagguauuuuuuuucuuccaaaccuaucccuucuccaauccuccacccuuaagaaggcuccagugucuguuuuucaacuucuguccaugucuuuucauuauuuagcuuccacuuguaagugagaacaugugguauuugguuuucuguuccuucauuaguuugcuaaggauaauggccuccaguuccauucguguuccuauaaaggacaugaucucauuuuuuuuguuaauggcugcagaguauuccaugguguauauguaccauguuuucuuuauccagucuaccagugaugggcauuuagguuacuuuuaugucuuuacuauugugaauagugcuucagugaacauuugcaugcguguuuaugguagaaugauuuauauuccucuggguauguacccaguaaugggauugcugugucaaaugguauuuauggcuuuaggccuuugaggaaucgccacacugucuuccacaauagcugaacuaauuuacacuucccccaacagguauauaaguguuccuuuuucuccaccaccuaaccagcaucuguuauuuuuugacuuuuuaguaauagccauucugacuggugugagaugguaucucacugugguuuugauuugcauuucucuaaugaucagugauauugagcuuuuuuucaugguuguuggcugcaugugugucuucuuuugaaaauugucuguucauguccuucacccacuguguuaugggguuguuuuuauuuuuuuccuguaaauuuguuuaaguuccucauagauucuggauguuagaccucugucagacguauaguuagcaaauauuuucucucauucuguagguugucuguuuacucuguucauaguuucuuuugcuaugcaaaagcucuuuagcuuauuuuugauuuaucaauuuuugcuuuuguugcaauugcuuuuggcauuuuugucaugaaaucuuugccaguuccuauguacaaaaugauauuuccuagguuauccuuuaggguuuuuauuuagguuuuagguuuuauuuagguuuuagguuuuacauuuaggucuuucauccaucuugaguugauuuuuguauaugguguaaggaagggguccaguuuuagucuucuguauauagcuagcccguuaucccagaaucauuuauugaauagggaguccuuuccccauugcuuguuuuugucagcuuugucaaagaucagaugguuguagguguguggguuuauaucugggcucucuauccugcuccauuggucugugugucuguuuuuauaccaguaccauguuguuuuugguuacuguagccuuguacuacagugugaaguuggacaauaugauuccuccagcuuugaucuuuuugcuuaggguucccuuggcaauucaggcucuuuuuugguucaauaugaacauuaaaauaguuuuuuuccaguuugugaagaaugucacugguacauggaaaggaauagcauugaaucuguaaauugcuuuaggcaguaugaccauuuuaaugauauugauucuucccaucuaagagcauggaauguucuuacauuuguuuguguuaucucugauuucuuugagcaguguuuuguaauuuucauuauagagaucuuuaacuuccuugguuagcuguauuccuagauauuuuacucuuuuuguggcaauuguaaaugggauuguauuccugauuuggcucucagcuugggcgcuguguaagaaugcuacugauuuuuauaaauuguuuuuguuuguucguuuguuuuuugagacacaguuucacuuugucacccaggcuggagugcaguggcaugaucucggcucacggcaaccuccaccucccagguucaagcgauucuugugccucagccucccaaguagcugggauuacaggcacgcaccaccaugcucagcuaauuuuuauauuauuaauagagacagaguuucacuauguuggccaggcuggucucgaacuccugaccucaagugauccaccugucucggccucccaaaguccugggauuacaggugugagccacugcaccuggcccugauuuuuauaaauugauuuuguauccugaaacuucgcugaaguugcuugucaucucaagaagcuuuugggcagagacuaaugagguuuuuuagauauagaaucaugucaucuucaaacagggauagguugacuuccuuucucucuauuuggaugccuuuuauaucuuucucuugccugauugcucuggccaggacuucgaauacuauguucaauagauuuggugauagagggcauccuugucuuguuuugguuuucaaggagaaugcuuucagcuuuugcucauucagcaugauguugacuguggguuugucauugaugacuauuauuauuuugaaguauguuccucaaugccuaguuuauuugaggguuuuuaacaugaggggaugcugaauuuuaucaaaggcuuuuucugcaucugugguuccugucuuuaguucuguuuaugugaugagucacauuuauugauuuguguauguugaacuaaccuuguaucccaaggauaaagccuacuugaucaugguggauucacuuuuugaugugcugcuggauuuggcuugcgaguauuuuguugaaaauuuuuauauagauguacaucaaggacauuggccugaaguuuucuuuuuuuguugugucucugucauauuuugguaucaggaugaugauggccucauagaaugaguugaggaggauucccuccuccucaauuuuuuggaauagcuucuguaggaaugauccuagcucuucuuuguacaucugguagaauauggcuaugaauccgucugguccugggccuuuuguuugauugguaggcuuuuacugauucaguuucagaggucacuauuggucugcuugaggauucaauuucuucuugguucaguguugggaggauguacauguccaggaauuacucauuuauuuuagauuuucuagcuuaugugcauaacgguguucauaguagucucugaugguucuuuguauuucuguggggucagugguaaugucuccuuugucauuucugauuguguuuauuuguaucuuuuuucuuuauuugucuagcugucaauuuaucuuacuuuaaaaaaaaaaacaacuccuggauucauuaaccuuuuguaugauuuuuugucucuaucuccuccauuuuagcucuugauuuugguuauuucuugucuucugcuagcuuugggguugguuuguucuugguucucaaguucuacuaguugugauguuugauuguuaacuugagaucuuuccaacuuuuugauguggguguuuagugcuauaauuucccucuuaacacugccuuagcugugucccagaaauacugauuuguugugucuuuguucucauucauuucaaagaacuucuugauuucugccuuaauuucauuauuuaccuaagagucauucaggagcagguuguuuaauuuccaugcaauuguauggcuuugagcaauuuucauggccuugauuucuguuuuaauugcacagaagaguaugguugguuaugauuucaguuuucuugaguuugcugaggguugucuuaugucugauuccgugguugauuuuagaguauguaucauguggugauaugguuuggcguguccccaaccaaaucucaucuugaauugugguuccuauaauucugacaugucaugggagggaccugguaggagauauuugaaucuugguagcaguuacccccacacugcuguucucaugauaauuagugaguucucacgagaucugaugguuuuauaaggggcuuuucccucuuuuacucugcacuucucuuuguugccgccaugugaaggacauguuugcuuccccuucugccaugauuguaaguuuccugaggccucccuagccaugcugaacugugagucaauuaaacuucuuuccuuuauaaauuacccggucucagauaugucuuuauuagcagcaugaguacggacuaauacaugugauaaugaaaagaauauauauucugucuucuuagggugaugaguucuguagaugucuauuagauccauuuggucaagaguuuaguucagauccugauacuauuaauuuucugccucaaugaucuauuacugucaguaggguguugaugucucccacuauuauuguguaugaaucuaagucucuucauaggucucuaagaacuuguuuuuugaaucugggugcaccuguauugggugccuauagauuuaggauaguugaauccuaaauuuuuaggauuuaagaauuguugaauuggacccuuuaccauuauguaaugucauucucuggcuuuuaaaaaucuauuuggcuuaaagauuguuuggucugaaauuaggcuugcaacuccugcuuuuuucuguuuuccguuuguuugguagauuugucucuauuucuguuuugagccugugggugccauugcaugugagauggguuaccugaagacagcauaccauguaucuugcaucuuuauccaacuugcuacucugugccuuuuaauuggggcauuuagcccauuuauauucaagguuaguauugauaugugugaauuugauccugucauuauguucuuagcugguaauuaugcagacuucuuugugugguugcuucauaguaucacuugucuguguacuuaaguguguuuuguaguggcugguaauggucuucccuuuccauaucuagugcuucucucaggagcucuuauaaggcaggucuagcauuaaugaauucccucagcauuuucuugucugaaaggaucuuauuuuuccuuugcuuuugaagcuuaguuugacuggauaugaaauuuuugguuggaauuccuuuucuuaaagaauguugcauauaggcccucagucucuucuggcuuguaggguuucugcugauagguacacuauuauucugaugggcuucucuuuuuaggugaccuguccuuucucucuagcugcuuuuaacauuuuuucuuucauuuugaacuuggaaaauuugaugauuaugugucuugggggugaucuugaaguaucuuguggugguucuccacauuuccugaauuugaguguuggacucucuagcuagguugaggaaauucucauggaugauauccugaaauauguuuuucaacuuguuuucuuucuucccauuucuuucagguaugccagagagucauagauuuggucuuuuacauaauuccauauuucucagagguuuuauucauuccuuuuuguucuguuuucuuccugucugacuguauuauuucagaaagccagucuucaaucucugagauucuuuucuccacuuguucuauucugcuguuaauauuugugguugcauuaugaaauucuuguaguguguuuuucagcucuaucagauugguuguauuauuuucuauaugagcuauuuugacuuucaucuccuguauuguuuuauugugauucuuagcuuccuuggauuggguuucaacauucuucugaaucuugaugaucuucauuccuauccacauucugaauucuguuucugucauuucagccaucucaacccaguuaauaacccuuaacuggagaacuagugugguuguuuggaagaaagaaggcacuucagcuuuuuccauuguaagaguucuuguacugguucuuucucauuugugugggcugauauuccuccaguuuuugaaguugaugucuucuggauggauuguuuugcuuuuuuuuuauuugaugcccuuggggguuugauugugguauaagguggguuugguugucuggcuucaauucuagucugcuccugggucuugcaggaggccccaguuauuacugccuuugugucugcauuucuuuuguugguuauucugguccaaggggcucccucagacuggggcugcaguugagugacaagcccuauccuagccaaguugcccuaaucuacuaucugugugcuuccuggggggacaugggaguugccucugcaaaacaucugaguggcucacugccucaaucuagaaguauguuggggaauuguggggaagccagguugauucucuccuucucagucuugcauggguccaugugguaagggugagucccccugggggcugucacucacucacccuuucccguguugaagagguuuuccuggcucugcacugagccccgacagacuggugcccagcuuugccccucuuuguucucuguguuccccugcugccuugauguaucucaucaugguuucucagaugaucagccugcagaacccguguucacuagcacuuuuguuuucucccccugggaguggcacacaugaacuacuuccagucuaccaucuuagcccugcccccagauauccaaaaacuuaguuucuuaaaaacaaugauuuaucucaucauuaagaaauagaggcuaaaaagaaaaagggaaaaaugauguauuauuuuucacaauucuguggguuaucaauugaugauucuucugugcuaugccuugcuugaguuauucauguggcuucauucaucugggagcuguacuggagcuggaguguacaagacugaaucucauucucaaaagacucuuuccauguggccucucaucauucaguaguauagccugagcuucuuuaccggaugguuucuggcuucuaagaguaacauuccaagauaauccucaauggaaauugcucaucaugucucuguuugcaucacagcuaaggaaagucacauggccagguccagagucaguauaggaggagacucuacaagcacaugaauaccaggaauuaugguucacuggaccaccaauguaucauucuaccucaagugguauaaggcaucuuaaguccuucaugugguugggacgugagacuagaaccugaaccaguaguauugugacacuaagaugcuagauagugcuucucaaacuuuagugugcaacagaaccacuuggggagacuguuuaaaauuauuauucauggacccuaauuuuagaaucuuuuuucaguauaucuggaguagagcccaagaauaugcauuuuuaaaagaaucccuggguuuuccugauaaacacccaguacaagagccacuuaugagaaauucugggcagggaccaucuugcauuuccuuuaguaaucugccaucaucagagucaagccuuauaaaaguugauacaugauugaagauuccuaguuuguucacuauggcaggucaauagcaaccaaggagaugguuagggaagagucaccuuuugauuuucagcuguucuuauaacucagaucccugugcuggauuuuagguuggugagaauuuuuuggaguaauggaaaaugugaguaguugggacacucugcuuuacacaaguagcuucucuaaugcacguuuacuucuuuauagcaguuguuuaaugaaaauaacgguaaaucuugaucuguugcuagacagugcuuagauugaucuuucucuagugagauuggaaugaaacccaguuucauggaaagaaauagcacuggcaaaaauguaacaugggguuuucucaaaagucauagcacaguuuuaagcuuuaauaacuucagaacuauaaauaccacaaacaauaaauaucacuuauaagcuuaauuaucuaaguuucuuuauaccuuuucaguuuuuuauuuugaauaauauuuaauuucaguguuuuguuucaguaaacauuuauaaaagaaauuuagauaauuccuguuuuucacuuuuuuuuuucuauuuuaagauucagagucacggugauucagggaaugauguuauugaggcaaccugacacacaugccuuuggaauauucauuuguugacccaguagguucuauguaugcacagauacuucuaggaagaacaacauuaauguaagcuuuaugcagaauuuugaugacagugccacuccucuugccuguuuuucauucacuugucuguuagaggaccaugccauuuuagaacucaugguaacuaaugcugagcauagcuacacaugauuuagaccugaggaaaacauaucuuaaaaaagaguuuguagcaaagauagaaugugcccacuccucugcuuuggaggauccucuaguacugguuuucuauguauccuccuaacccuuuccucugcagauuaaacaucugcguaauugcacaaugacaaaaggaagacaagaguuuccuccuaccaugcugugguucugcuuuucaggcuuuuuuuuuuuucuucuacccaagagcugggcuaaucuuuaugaaucugugauccaggauucagaacacaugauguuacuuuaucaagauauguuuuaaaacaugaaaacccaaaguagcaugaucucauuuuauaagacuugaaaaaaugauucaaguuacauggcagauuauaaaugcugacauucuggcaagauaauuauaauugauucuuaggaggaagaaagagggacgauuucuaaagaaaagguaguaucuuucagaaaagucuaugaaaagcuuggguuuccaaauaauaaguuaaaacaugggaggaguugacaugaaaaauauugaagggacauggucaguguaauugauuuuugaauggauuaauaaaugguacccuucuuugcuuuucuauauauucacacaucuuacuuacucuagaaaaccuaugguucaaaguucuaacuuauuuuaguuauuaguucuuuucuaaccuaucaccaacuuacaucuacuaugucucuuuuaacacuuagcauacguacugugacuucuaugugugcaaaauaggaagugaguuacucaucccaguuauuucaccagagcaguuucauggugguuauugaagaacagccuuguuaucaaagggaggguagucuucuaggauaauauuaaggauuucaauuuaagcagauuggaaggaacuaaagugacucuagugugcuuaaaaaugacucuugaaauugugguuacaggucugugccacagacuuucuucuccguuuuuaaaaguuauucuucagaauauccugaauuugaggucagaaaaucuuuaagccaaaucuuauuuaaguauugggcugaaucagaauaugaaguuucauauaugaaaugaaaguuuaauaaaugaaacaagguuuggcuuugcaucauagauuuuuauuuaaucuguuaaugugauucaaaacaugcaccucaaauuauuugauacagaggugggaaaugcuaaguuuuacucaggaauucaucuuaguagaaaaauuuagaaauacagacaaaugucuauuuuaaaaaucacuuacuccuaccauccagagauucuaacuguuuacauuguugcauuuucuuccuucccuuucaaauagaaggaaacacaacaaaaugaaugaauuucauaguaaugaacuugagcaaaauaagaaagacaugaagcauauaugcuguauuacucuaaucacaaaaaguucaaauauaggcaaaaaucaaccacauauuucaagaauucauauguaggugguaaacuauaaagaaaaguuuauuccaaagucagguaggugucuccccuaagagaagaaagggucaugauugggaggcauauauagagggcuucgagggugggcuuuugaugugggugaugauaacuguagauguucacuuuaaaauuauuuaaucugagcauaucuguuauauauuuuaccauaaaaguauauuuuauauuuuacaauguaaaauguauucaauauuuuacaauuuaaaauauaaaaauuuucagcuauaucaccuuuuccauggccaaaggaguaguugugaugcuuuguuguucucagagaccuuacucgcaguaaugguucugaaacguuagugugcaucaggaucacuuggauuaaauauagauuccugggcccugacuccaaaguaucugauuuggaauaucugguuuagagcccaagaaucugcauuuguaauaaguucccaggucaugcuaaagauauuuuugcauggaccacacuuugagaaucaccagauagcaaagcuguaccuaucuauagaaccaugcuggggaauaacagaagaaaauggaggcccauauucaguguauauaguauaugcuuacaacagaaaaggagcaagaauuauauaccuugugauccguguugugguauuagucuauuuuuaagucuaucuaugaauggcaauauaagccuugccagugcugagggaaucagagccauuuaaaacaaacaaaagaaacaguguucuuauaauaagaugucuaaauuugugaauuuccuuaacugugacuuuggaaaguuagaauaaguaaaaaucaacguaccuguuuauuaaaaaaaauguugugcaaaggcuaacuuugagaaugagaagauauauguguguguguauguguguguguguguguguauauauauauauauauauauauauauauauguuuuauuuuauuuuauuuuauuuuuuuugagacaaggucuuacucugucauccaggcugagugcagugaccugaucauagcucacuggaaccucaaccacaaccuccugcagucaagugauccuuccaccucagccucccaagcagagcagcuggcacuacagacacgugccacaacaccuagcuaauuucuuauuuuuuguagagacagggucucacuaugguucccaggcuggccacaaacuccuggacucaaggaguccuccugacuuggccccucaaaguguuggaauuauagguaugagccacugugccaggccuaugucuuuuuaaaauagaaacaaacacucaaacuaauuauagguaaggaacaacauuuauuuacuuuguguuguucauguuaaaguuaauggauccauggucuugaauuaucauuucagucuucuuucauuguguuugcuugaaaaacuaagagauuuccucagcagaaaccuuuuaagccagaagggauuggaguuuuaucuuuagccuucuuaaagagaauaacugucagucaagaauuuuguauccagaacaaaacuaaguuuuguaaaugaaggagaauuaaagucauuuucagacaaacaaaugcugagagaauuuguuacuacuagaccagcucuauugaaaaugcuaaaaggaguuuuaaacuuuaaaagaaaaaggcaauuaugaaccagaauagaaccucuugaaagcauaaaacuaauggggccuauaaaacaauaacaauaaagaaaccagagggggaggagccaagauggccgaauaggaacagcuccggucuacagcucccagcgugagcgacgcagaagacgggugauuucugcauuuacaucugagguacuggguucaucucacuagggagugccagacagugggcgcaggucagugggugcgcguaccguucgcaagccgaagcagggcgaggcauugccucacuugggaagcgcaaggggucagggaguucccuuucugagucaaagaaagggaugccggacagcaccuggaaaaucgggucacucccaaccaaauacugcgcuuuucugacaggcuuaaaaaauggcgcaccacgagauuauaucccgcaccuggcuuggaggguccuaugcccacggagucucgccgauugccagcacagcagucugagaucaaacugcaagguggcagcgaggcugggggaggggcgcccgccauugcucaggcuugauuagguaaacaaagcagccaggaagcuccaccugggcggagcccaccacagcucaaggaggccugccugccucuguaggcuccaccucugggggcagggcacagacaaacaaaaagacagcaguaaccucugcagacuuaaaugucgcugucugacagcuuugaagagagcagugguucucccagcaugcagcuggagaucugagaaugggcagacugccuccucaagugggucccugaccccugacccccaagcagccuaacugggaggcaccccccagcaagagcacacugacaccucacacggcaggguauuccaacagaccugcagcugaggguccugucuguuagaaggaaaacuaacaaacagaaaggacauccacaccaaaaacccaucuguacaucaccaucaucaaagaccaaaaguagauaaaaccacaaagauggggaaaaaacagaacagaaaaacuggaaacucuaaaaagcagagcgccucuccuccuccaaaggaacgcaguuccucaccggcaacggaacaaagcuggauggagaaugacuuugacgagcugagagaagaaggcuucagacgaucaaauuacucugagcuacuggagggcauucaaaccaaaggcaaagaaguugaaaacuuugaaaaagauuuagaagaauguauaacuagaauaaccaauacagagaagugcuuaaaggagcugauggagcugaaaaccaaggcucgagaacuacgugaagaacgcagaagccucaggagucgaugcgaucaacuggaagaaaggguuucagugauggaagaugaaaugaaugaaaugaagcgagaaggaaaguuuagagaaaaaagaauacaaagaaaugaguaaagccuccaagaaauaugggacuaugugaaaagaccaaaucuacgucugauugguguaccugaaagugauggggagaauggaaccaaguuggaaaacacucuguaggauauuauccaggagaacuuccccaaucuagcaaggcaggccaacauucagauucaggaaauacagagaaugccacaaagauacuccucgagaagagcaacuccaagacacauaauggucagauucaccaaaguugaaaugaagguaaaaauguuaagggcagccagagagaaaggucggguuacccucaaaggaaagcccaucagacuaacaguggaucucucggcagaaacccuacaagccagaagagagugggggccaauauucaccauucuuaaagaaaagaauuuucaacccagaauuucauauccagccaaacuaagcuucauaagcgaaggagaaauaaaauacuuuacagacaagcaaaugcugagagauuuugucaccaccaggccugcccuaaaagagcuccugaaggaagcgcuaaacauggaaaggagcaaccgguaccagccgcugcaaaaucaugccaaaauguaaagaccaucaagacuaggaagaaacugcaucaacuaacgagcaaaauaaccagcuaacaucauaaugacaggaucaaauucacacauaacaauauuaacuuuaaauguaaauggacuaaauucugcaauuaaaagacacagacuggcaaauuggauaaagagucaagacccaucagugugcuguauucaggaaacccaucucacgugcagagacacacauaggcucaaaauaaaaggauggaggaagaucuaccaagcaaauggaaaacaaaaaaaggcagggguugcaauccuagucucugauaaaacagacuuuaaaccaacaaagaucaaaagagacaaagaaggccauuacauaaugguaaagggaucaauucaacaagaagagcuaacuauccuaaauauauugcacccaauacaggagcacccagauucauaaagcaaguccugagugaccuacaaagagacuuagacucccacacaauaauaaugggagacuuuaacaccccacugucaacauuagacagaucaacgagacagaaagucaacaaggauacccaggaauugaacuuagcucugcaccaagcggaccuaauagacaucuacagaacucuccaccccaaaucaacagaauauacauuuuuuucagcaccacaccacaccuauuccaaaauugaccgcauaguuggaaguaaagcucuccucagcaaauguaaaagaacagaaauuauaacaaacuaucucucacaccacagugcaaucaaacuagaacucaggauuaagaaucucacucaaaaccgcucaacuacauggaaacugaacaaccugcuccugaaugacuacuggguacauagcgaaaugaaggcagaaauaaagauguucuuugaaaccaacgagaacaaagacacaacauaccagaaucucugggacacauucgaagcaguguguagagggaaauuuauagcacuaaauggccacaagagaaagcaggaaagauccaaaauugacacccuaacaucacaauuaaaagaacuagaaaagcaagagcaaacacauucaaaagcuagcagaaggcaagaaauaacuaaaaucagagcagaacugaaggaaauagagauacaaaaaacccuucaaaaaauuaaugaauccaggagcugguuuuuugaaaggaucaacaaaauugauagaccacuagcaagacuaauaaagaaaaaaagagagaagaaucuaauagacgcaauaaaaacugauaaaggggauaucaccaccaaucccacagaaauacaaacuaccaucagagaauacuacaaacaccucuacgcaaauaaacuagaaaaucgagaagaaauggauaaauuccucgacacauacacucucccaagacuaaaccaggaagaaguugaaucucugaauagaacaauaacaggaucugaaauuguggcaagaaucaauagcuuaccaaccaaaaagaguccaggaccagauggauucacagcugaauucuaccagagguacaaggaggaacugguaccauuccuucugaaacuauuccaaucaauagaaaaagagggaauccucccuaacucauuuuaugaggccagcaucauucugauaccaaagccaggcagagacacaaccaaaaaagagaauuuuagaccaauaucguugaugaacauugaugcaaaaauccucaauaaaauacuggcaaaaggaauccagcagcacaucaaaaagcuuauccaccaugaucaagugggcuucaucccugggaugcaaggcugguucaauauacacaaaucaauaaauguaauccagcauauaaacagagccaaagacaaaaaccacaugauuaucucaauagaugcagaaaaagccuuugacaaaauucaacaacccuuuaugcuaaaaacucucaauaaauuagguauugaugggacguauuucaaaauaauaagagcuaucuaugacaaacccacagccaguaucauacugaaugggcaaaaacuagaagcauuccguuugaaaacuggcacaagacagggaugcccucucucaccacuccuauucaacauaguguuugaaauucuggcccgggcaauuaggcaggagaaggaaauaaaggguauucaauuaggaaaagaggaagucaaauugucccuguuugcaggcgacaugauuguauaucuagaaaaccccauugucucagcccaaaaucuccuuaagcugauaagcaacuucagcaaagucucaggauacaaaaucaaugugcaaaaaucacaagcauucuuauacaccaauaacagacaaacagagagccaaaucaugagugaacucccauucacaauugcuucaaagagaauaaaauaccuaggaauccaacuuacaagggaugugaaggaccucuucaaggagaacuacaaaccacugcucaaggaaauaaaagaggauacaaacaaauggaagaacauuccaugcucauggguaggaagaaucaauaucgugaaaauggccauacugcccaagguaauuuauagaaucaaugccauccccaucaagcuaccaaugccuuucuucacagaauuggaaaaaucuacuuuaaaguucauauggaaccaaaaaagagcccgcaucgccaagucaauccuaagccaaaagaacaaagcuggaagcaucacacuaccugacuucaaacuauacuacaaggcuacaguaaccaaaacagcaugguacugguaccaaaacagagauauagaucaauggaacagaacagagcccucagaaauaacaccgcauaucuacaacuaucugaucuuugacaaaccugagaaaaacaagcaauggggaaaggauucccuauuuaauaaauggugcugggaaaacuggcuagccauauguagaaagcugaaacuggaucccuuccuuacaccuuauacaaaaaucaauucaagauggauuaaagacuuaaacguuagaccuaaaaccauaaaaacccuagaagaaaaccuagggauuaccauucaggacauaggcauaggcgacgacuucaugucuaaaacaccaaaaacaauggcagcaaaagacaaaaucgacaaaugggaucuaauuaaacuaaagagcuucugcacagcaaaagaaacuaccaucagagugaacaggcaaccuacaaaaugggagaaaauuuucgcaaccuacucuucugacaaagggcuaauauccagaaucuacaaugaacucaaacaaauuuuuaagaaaaaaacaaacaaccccaucaaaaagugggugaaggacaugaacagacacuucucaaaaggagacauuuaugcugccaaaaaacacaugaaaaaaugcucaucaucacuggccaucagagaaaugcaaaucaaaaccacaaugagauaccaucucacaccaguuagaauggcaaucauuaaaaagucaggaaacaacaggugcuggaggggauguggagaaauaggaacacuuuuacacuguuggugggacuguaaacuaguucaaccauuguggaagucaguguggcgauuccucagggaucuagaacuggaaauaccauuugacccagccaucccauuacuggguauauacccaaaggacuauaaaucaugcugcuauaaagacacaugcacacguauguuuauugcggcauuauucaccauagcaaagacuuggaaccaacccaaauguccaacaaugauagacuggauuaagaaaauguggcacauauacaccauggaauacuaugcagccauaaaaaaugaugaguucauguccuuuguagggacauggaugaaacuggaaaacaucauucucaguaaacuguugcaagaacaaaaaaccaaacacugcauauucucacucauaggugggaauugaacaaugagaucacauggacacaggaaggggaauaucacacucuggggacuguugugggguggggggaggggggagggauagcauugggagauauaccuaaugcuagaugaugaguuagugggugcagugcaccagcauggcacauguauacauauguaacuaaccugcacaaugugcacauguacccuaaaacuuaaaguauaauaaaaaaaaaaagaaaaaaaaaaaaagaaaccagaguaucuagguaacaaguaacaggauaacuggaacaguaccucacaucucaauauuaacauuggauauaaauugcuuaaauucuccacuuaaaugauacagauuggcagaauggauuuuaaaaaucacaaaccaaauauauacugucuucaagagacucaccuaauacauaaagauucauauaaacuuaggguauaggagugcaaaaagauauuccacuccaaauggaaaccaaaagugagcaggaguagguagucuuauaucagauaaaacagauuuuaaagcaacaacaguaaaaaaagacaaagaaggucauuauaugaugauaaaaggaucaauccaacaagaagauauuauauuccuaaauuuauauacacuuaacacuggagcucccagauucauaaaacaauuacuauuagaccuaagacaugagauagacaugaaauaauaauaguaugagacugcaacaguccaccgacaacacuagacagaucaucaagacagaaagucaacaaagaaauaauggaccuaaagugcacucuagaacaaauggaccugacaaauauuugccgaacauucuaccuaauaacugcagauuguacauucuuuuaaucagcacacagaacauucuccacaauagaccauaugcuaggccacaaaacaagucucuauaaauuuuuaaaaaucgaaauguuaucagguaucuucucagaccacaguggaauaaaacuacaaaucaacuccaaaaguaacccucaaaacuauacaaauacauagaaauuaaacaaucugcuccuggaugauuuuugaguuaacagugaaaucaagauggaauuuuaaaaauucuuugaaaggaaugauaauauugacacaaguuaucaaaaucucuggaauauaguaaaagcaguacuaaaaggaaaauuuauagugcuaaauaccuacauuaaaaaaucugaaagaugauaaauugacaaccuaacaucauaccucaaggagcuagagaaagaacaaacuaaacccaaagcuagcagaagaaaagaaauaacaaagaucagagcagaucuaaaugaauuugaaacagcagcaacaacaacaacaaaaauaccaaagaucaaugacacuaaaaguugguuuuucaaaaagauaaacaaaguugauagaccauuagcuagauuaaccaggagagguuaaaguaaguucaauuagaaaugaaacuggagacuuuacaaccaaccccacagaaauaaaaaagaucauuugagaccacugugaacaccucuaugcacacaaacuaaaaaaucuagaggaaauggauaaauuccaggaaacauaaacacuccuagauuaagccaggaagaaauagaaaccccgaacagaccaagaacaagcagugcgauugaaucacuaaucaaaacaauugccaagaaaaaaaaauagcuuggggccacauggauucacaacugaauccuaccagacauucagagaacugggaccaauccuacugaaacuauuccaaaagauuaagaaagagggauccucccuaacucauucuaugaagccaguaucauucugauaccacaaccaggaaaagacauaagaaaaaaagaaaacuacagaccaauaccccugaugaacauagaugcaaaaauccucaacaaaauacuagcuaauucaagcagcacaucaaaaagauaauacaccaugaccaaguagguuucauuccagggaugcagggaugguuuaaaauaugcaagucaauaaaugggauacaucugauaaaaggaauuaaaaagaaaaacucuaugaucaucugaauagaugcagaaaaagcauuucauaaaauccagcauccccguauaaaaaaacucaacaaacagauauaaaaggaacuuuaccuaaaacuaaugaaagccauauaugacagacccacagcuaacaucauaauaaauggggaaaaguugaaaguauuccccuugagaacuggaacaagacaaggaugccacuuucaccacuucuauucagcauagugcuggaaguccuaaccagagcaaucaggcaaggauaagaaacaaagggcauccaaauugaaaaagaggacaucaagcuauugcuguucaugaauaauaugacuguauaccuagaaaacccuaaauacuccuccaaaagacuccuggauuugacaaaugaauuccguagucucaggucacaaaaucaauauacacaaaucaguagcagugcuauacaccaacaaugaccaugcugagaaucagaucaagaacucaguccuuuucacaacagcuggaaaaaaauaaauuaccuaggaauauauuuaaccaaggagguaaaagaucucuacaaggagaacuacaaaacacugcugauagaaaucauagaugacacaaacaaauggaaacacaucccaugcucauggauuggaauaaucaauaucaugaaaaugaccauacuacccaaagcaauccacugauucagugcaauuccuaucaaaauaccaacaucauuuuucacagaauuagaaaaaacaauucuaaaauucauaugaaaccagaaaaagaaccugaauagccaaagcaauccuaugcaaaaaaacaaacaaacaagaaaacagacguagaggcaucacauuaucagauguuugccacaaggcuguaguuacaaaaauagugcugguauaaaaguaggcacauagagcaguggaacagaauagagaacccagaaauaaagccaaauacuuacaaccaacugaucuucaacaaagcauagagaaacacaggcugaggaaaggacaccuuauuuaauaaauaaugcugggaaaacuggauaaccacauguagaagaaugaaacuggaugcuuaucccuuaccuuauacaaaaaucaucucaagaugguucaaagauguaaaucuaagacaugaaacuauaaaaauuauagaagauaaccuaggaaaaacuauucuggacauuggcuuaggcaaauaauucgugaguaggaccccaaaagcaaaugcaacuaaaauaaaaauaaauaaauaggaccuaauuaaauaaaagaaacuucaguacauuaaaagaaauaacuaucagaauaaauagacaacccacagagugggagaaaauaucugcaaacuauacaucuagcaaaggacuaauaucuagaaucuacaaugaacucaaguacaucaacaagaaaaaaaaaucccaucaaaaugugggcaaauaacaugaauagacauuucucaaaagaggauauaagaaugguaaagaacauaugaaaaaugcuaaacaucacugaucaucaggaauaugcaaauuaaaaauacaaugagauacugccuuacuccugcaaaaauagccauuauuaaaaagucaaaaaauaauagauguuggcauagauguggugaaaagggaacaccuauacacugcugguaggaauguaaauuaguacaaacuguauaaaaaacaauauggagauuucuuaaagaacuaaaaguagaucugucauuugauucagcaaucccacuacucaguaucuacccaaaggaaaauaagugauuauauuaaagacacuugcacgcauauguuuauugcaacacaauucacaguugcaaacguauggaaccaaucuaaguguccauuaacgaaugaguggauaaagaaaaugugauauauauacaccauggaauacuacucagccauaaaaauaaugaaauaauguguuuugcaguaacuuggauggagcuagaagccauuauucuaagugaaguacucaggaauggaaaaaccaaaaaccguauguucucacuuauaagugggaaccaagauacggguaugcaaaggcauacagaauucuaugauggacuuuggcgacucagaagagggaggguugaggggggugagggauuaaaaaacuacuuauuggguacaauguacacuacuuggaugaugggugcacuaaaaucucagacuucaccacuauauaauucauccgugugaccaaaaccacuuguaccccaaaaacuauugaaauaaaaaaauuuuaaaaacugagauuuucauauaaugagaauagccccugcauaauaacauucaugaaaaucuccuagaaacauggauuuggcuucuaaugggacauuugcuuacuccaaccacauagagacuggccucuuaagauuaggaagcagcucacucuauccauagcuggcaguacccugugcuguagaaacuuaauuuuacuuugugauugugugguuaacuuuucuguauuaaccugacuuugacuuuagacuucauaugaccuauuuacccaaucuuacacaguuuucaguuuccagccuaucuacucaguaccguacuuuauuuuguuuuucuuagacuguccuuguuuuaaaacugugaucuuauuucaaccaagguauagcuguucuuagcuuccuuugcaugcugagccugucuuucuucacagugaggaggaaccccugacuacucuuuccuggaaaucuucauucccauaggucuucucugcugucccuaugaugguauggagccuguuuuuauuauuuucuacucacuuaauugcaucuugaugaauuucaguacacaaagucaccauauuguagguauaucuacaaagguguuguuauacuggaccagaugcaguggcuuaugccuguaaucccagcacuuugggaggcucaggugggaagaucacuucaggccaggaguuugauaccagucugggcaacagugagacccugucucuacaaauaauuuuuaauaauuagcugggcaugguggcacaugccuguaguccuagcugcuugggaggcugagguaguugaaucacuuaagcccaggaguucaaguccagcuugaguaacauagcaaggccccaccucuaaaaaaaaauacaaauaaaauaaaguucuauugguuacucuuuuuacuaccuuguaaggaauguacagcuuguucuuguuaggaaauugguaaggaaaaaugugaauuucagauuuggguaugugguguuaguggaggaucagaaaucuauuggaugaauuaaaucugucuuuuaaaagcuacuuucuacuaauguggguuuuaugaucaccugauggauuaauuugagauccauuaagaccuaagugccuuacugguucccaauuuaacaauucuguggaauccaaacucuuauuuauuuugauuuguuuuuacuuuuuugagacacggucucgcucugucacccaggcuggauugcaguugugccaucucagcucacugcaaccuuggccuccugagcccuagugauccucccaccuuagccuccugaguaucugggacuacaggcacacaccaucauaccuggcuaauuuuuuuuuucauauuuuuuguagacaugaaguuuuaccauguugcccaggauggucuggaauccagacucuugucugcaauugauuuaauauaauucuacaauauuuuuccuuauugcaaggcagaaaaccauagacauuuguagcuuaaaccaaucugagugcuuccauuaaaaauuacaggaagauuaucagugaagugguauugccuaguaacauauugcucucuaggagacagaaagcuuuuccaccugguuuuuaugccuaagguuauuuguuaugcauguuugccaagauuaguauuaaauuccuucuguugacuuuaguaacacuugugauuucuuuuauauguuagcauugaacauuaaacucucauaaucucuaguuuuuugauuugucuuuacacuaaucauguuuuaaagauacacgucuauuuuuuaguuaaaauggcuuugaauuuuauuucacuagauuuaaauuuuaaaggaaaucauauccuuccaauuugauuuaaauugguuaugguuauuaauauuaaacaugucuauuuuaggcaccaguuuuauuaguucguguacucuuggcuacaucacgauuaaaacuuuucuuucaguuucuuuccaaaauaaacugcaagauuuccuuguugacauuuuuucauuuuuaaaaaucguuucguuuuauuucccaccaccccuguuuauuauauggauugugaagcaaagcauacaggugauagugaauuaucuuguacaacagccuggucgcuucuuuaaauuucaguuuuguaaguuguuuugcucaccaaaguguccuuuucaugggcucucaugcucgugaguaggguuuuguugucaucuguaucuugcuguuacauccaguaaguuuaacauucaugguaacgauauuuuucaaguguuucuacaguguaaggggcucauuggcugcaagauugcugugagguauauuauagaugauagauacuaugauuuucuguuuauuuguuuuauuuuuguuguuguuguucugagacagaaucuuguucugucacccaggcuggaggacaguggcauaaucuuggcucacuguaagcucugccuccuggguucaagcgauucuugugccucagccucccagguagcugggauuacaggcauguggcacuaugucuggcuaauuuuuguauuuuuaguagagauaggguuucuccauguuggccaggcugggcuugaacucaggaccucaagugauccacccaccuuguccucccaaagugcuaggauuacaggcaugagccaccgcacccaggugguagauauugugauaucaagggaaaauauugaugccaggaaagaccuuaacaucagaauaaguuauuuucacaagaaauauuuuugauauagauacauguggcaaaauaaaacuauuagauuauuaacuaugaaaaccaauuuuguuagaauuuugaagaauacuaugcaucuacuuuuuaacaacuuaauuuuuuuuuuuuuuuuuuuugagauggagucucagucugugguccaggcuggagugcaguggugcaaucucggcucacugaaagcuccgccucccagguucacgccauccuccuuccucagccucccgaguagcugggacuacuggcacccaccaccaugcccagcuaauuuuuuguauuuuguuuaguagagaugagguuucaccguguuagccaggauggucucgaucuccugaucucaucauccucccaccuuuggccucccaaagugcugggauuacaggcgugagccaccgcaccuggccaacaacuuaauuuuuaaugauguucucucuauuaagcaguuuucuagaacuauuaauaaacaauaaagugaucuuuuuuuccuccuuuuucugccaaauugauaagaaucagaaugguaagaaggaaagaaaucuuaaagucugaauaaucaguaaguuaagugaugauccucugaacaauucagaauuuacuacauauacauucuauaaccaucucuguuaaagauuuuauaguauauauucagaagaucaaacagauguuucauagcuguauauacacauauauacacauauguauauuuuugcauauacauaaauuauuuaauugagguacauacauaugccaacuaaauauuuugauuauuuauuuuauuauaauauaaucuuaggcucuggggcaagcaaaacuggguuugaaauucaguucuaucacuuacuaguuauuaaggcauauuguuuaauccuugaauauagauacucaacaucuauaaaaugaagauuauacuaguacuuuccucauaggcauuaucuuaguucauuugagcugcuacaauauaaauaccauagacuggaugucuuaaacaacaaacauguauuucccacaguucuccauagugggaaguccaagaucagguccugcagguucaguuucaggucagggcccaugguuuucuucauagaugacaccuucucacugugccuuuacauggugaaagaggcaagagaacucucuggagcuucuuuuauaagggcacuaaugccauucacaugggcuuuguucuugcuaucuaaucaccucuuccccacaaaggcccuaccuuuaucacauugggaguuaggaucuuaauuucagagggucacaaauauucaguccauagcagcguugugaggauuauguguaauaauaugugacuagcuuacaccauguauagaugagaaaaaacuagcuguuuccccaaauuuguguuauccuuucauuguguagacuuccuucugggaaguaacucuuuuuucuuggagacuuuauuuccuaacuuuacugaguuuguugaaaaguuaucucucuaauuugaauugcuuuugcacuuuuguaaaaaaucaguuggacauauuugugugguucuauuuugggauuuuuuuguucuguuccauugaucucuaucacugacaauacuacaccaucuuucgguuauugcaguuaauaaugaaccaugaaauugaguagacugauuaccucacauuuuucuuuuuugaaauuguuuuaguuauucuaguuccuuuaucuuaccauauaauuuuagaauaaucuuaucuauugcuacaaaaaaaacuugcugguauuuugauaacaauuuuguuaaacuuauuugucaauuuagggagaauugacaucuuuauugugugaaguauucccugaacacuguaugcucuucauuuauuuagcucuuucauccagcauuuuguaguuuucauacacaaguucuauacauuuuugguuagauucacacccaauuuuauuuucuuuuugagugauuauaaaugcuauuauaguuuuaguuucaguguucaaguauuuauugccaguguguagaaauacaacugaucuaguauguuuaccuuguaucuuucaaccuugcugaaauaauuaguucuagauuuuuuuuuaggcuauuugggauuuucuauauagacagucaugucauauacaaauagagacaguuauauuucugccuuucuugucuguauacuuuuuaucuccuuuucuugucugguugcacugacuugaauuuuccagcaccauguugaaucagagcaaugagaauggacauucuugccuuguuuacugucuugcauggaaagcauucagucuuucacuauuauguuaguuguagguuucuguagaugcuguuuaugaagauggggaaguugccuucuauuucuauuuuuuucuuacaguuuuuuugauuuaugagugcuguauauuuucaaauguuuuuuucuguaucaauauaugcagauauauaucuauagauagauaugugaucaacauauauugauguguucaugugauuuuucuuccuuagccuguuaauauauugguugauaguuugaauaauguaccaggcuugcauaucugaaauuaacgucucuuggucaugguguauaauucuuuguauauguugcuaaauuuauaaaauuuaaaauuuauuggaaauuauaaaauuucuaaaauuuuaacauuuggaaauaauuuuuauguuuagccagauacagugguaugugccuguaaucccagauauuuaggagccugaggcaggaauauuguuugagccuaggaguucaagaccaggcuagucaacauaguaagacccuuucucauauuaaguaaauaaauuauuguuuuaaaauuuuuuaaaaaguauuuuuauauuuauauuuauaagggcuauuggaguguaguuucguuuuuuguacugucuucauaugauuucaauaucaggauaauacuaguuuuauaaagugaauugggaauuauccuauguauacaauuuugaauugcacuaacauuguacuuugaauuuuuuucuaugcaauuaaauaauauuugaaaaugugauuuuuaaagucugaguaaaaaguuaguuguaggaacuuauucuucuuuaucuaacuuuuuccuguuuuuuauuauuuagaacuuaaaauuuuuuuauuacuaauaauucuauggugagcaucuuccuauauaucgugugaacuuguccuauuuauucuuagaauuuguaauagauauagauuauaaauuucuuuucauauugauugaagcauaguguuuaauauuuagauuagauuaaauuucauauuuagauuaggguuaauauguaaucauuuuuuuauuaucauuaaugagacccuuuuauggaucugcaagaccaaagcugauuucauacuuaauugccuuuuuuaauguguugucauuugcacugauggugcaaaagcgauggugaacaaaacugccacugccuuagaacgaaucaaggcaguggcaccaaacugugcuaguaguuacuguauuuuuaaccaucaugcaucugcagggggaaaaaaaagccauacuuaguuaagaauaucuuagaugcaguaaaaauaauuuuauuacuuuuugauccucaaauauaggucuuuuuaauacucugugugaaguaaugugaaguacacauaaagcuccauauaaugguuuuaaggaaaagcauuugugaguaauccuauucacaauuguuugcacugucagcucaauuagaugcuuuuucuuuuauggaauaccauuuuuacuugaaagaaugacugacagacaaauugugcuuauucagacuuggguauuuggcaggcguugucuuucaaauuaaguaagccuaucauaucaaagaaaacaacugacaauagccuuugccaaagauaaaauccaagugaagauaaacuacaaaggaaaacuaaacuuagaaccuuggaaaacuguauucaccacuuucaguuugacaacuucccaauacauuguauaacagaauagaaagacuauucugaugaaauuggugaugauauuaacaaauuuuuaauugauuuuugacguauaaugaaaugaaucagcauuuggaaaaucugcauaacucagugagcugguauuugccaaaugauuaaugugugauauuaaaaaucaugucugagucauaucauaguuucauucgaaguacauacaagauagaccaguggauuuuaauguaacaggguaaaaaaaaguuuauugauaaagguuuuagauuauacauugcaacaaacuuuuaagaagcuaccacuuaucaaguaaaggaaaauauacacaguuauuguaaaagauuauuaaaauauuccacuauuuuucaacuaaauauacuccaaccaaaacaacauauggcaacagauugaaagcugaaguaaaugugagaguccagcugccuuuuauuaaaugagacauuaaagagauuuuuaaaaaauguaaaacaauaucucucuucucacuaauuaaaaaaaauacuauaaucucuuccugaccuuuuggcuuagaucacauuuuuaaaaaauuauaauuuuccucacaaaauguuauuuauguuaacauuuaaaggauuuuuguuauauuuaaauauuuuaaaauuuuguuuuaacucauaauaaauauggauagagauaaccuauauaaaggcuaagaaacuaccacuugucaaguaaaggagaauaagcacacuuuaacuuauauuauaauaaauauugauagagauaaccuauauaaaggucuucaguacuaucuaagagcuaaagggucuaugugaccaaaauguuugagaacuucuggccuacaggauaaaauccaaaccucuguauaugguccauaaguccuucuaucauggcuucugccaccucugcucccuucucuucugucucauuuccuuuccacucuauuauucaguaagaugaagauacuuuuauuccagaacuaugguguuuuacaucuccuuaccuuugcuuaauguuccuuuugccuugaauauguauucuucuccagcucuuuauauaaaguacugucuccaaaugccucuuggcaucauuucaguucuaaccucucuguaccucuuauucugucuuuauaacucuaucuguugguaugcaaucccaugucacuaauuuugugcagggaguuuauuuuacucauucagccauuggauaugcugcauccucaagaucugaucaguuuccuacucuauaaaugcuauuuaguauguuuuggguuucuauguccaaaauaauucagugucuuuccccuuauuaauuugguuucaucauuauuuguuuucuucuuaaaaguauugucauucuuccauucacuuggauucaaaaucuugaaaucaucuuuuauccuucuuucaucuucauacucuguauccaguuuaaucccauugcuucuugugugaaaauaucuuauauucacuaccuccuuucucuacugcugccauccacgcuuugaagcucaaaauaagagagaaaauauuuaaauauaucauggccuauuuuuuuccaaucagcauucuaaaugauuucaaaagcuuuugcuauucuuuccacuacuuauucuuuucuucagaccagcuugcucaucacuauugcauuagugaccuuccuaaaauacuacuuuaguuuuguauuuucucacucaacauuuuuguugacuucucauuucuuuuggcaguguuucuuuuugaaggaaaacuauucucauggacgcucaguguugacauaaauuauuuuaauuuuuaguaauacaacuuaaauauguccaaauauaaaacuaaauacaaacuuuugcacauacaagugcauggcuaaaauaauuugcaaauucguagcaaggaaaauauaaaacagaauuuaacauaauagcauuaaugugacagaagauguuauuugccauaaaaacaagcuuaacgugaauauaguacagacucugaguuaggcaugagccuguucuacugugaugacucaguuaauccaccacuuuucugucuuugagcuucugagaaccuuuguuucuacagcaugcuaugauaucauuuggccuucauuugguacagauguaucauuugagaaacagauccaccucuggcuuuuucucaccccucagccugcuacaauuaaaauagcacuacuuggcuaugguaagauaguaaauacgaaugcacauucagacacuaauaguacauggugauuuagggucacucgguaagauccagaugauccagaauauggugugugugugugugugugugugugugugugugugugugccuuugugcauguauguguaagagacagaguuuuaguugacuugaaaaaaagaaacuuagacuuuuauaggaaacaaauggaaucucaaagucagccccauuugcccagagacuauagacuccaauauagaaaccacucaucuguaggauaaagacuauauuccucauguugguauccaaggccuuuaucgauuugaauucaaucucuuuuccuuuuuuauuuguuuuucuuuucugucuucuuacugucuuuuaaauaugcucauacuuucccagaugugugccuucucuccuaucccuguauaagcccaucuguccacagccuuuaaggaccauucaugcuuuucauuuccccgugaagcuucuuccuaucucuucaguuacaauuugauuuuucuccuucuuugaacucuuguuugaauuccuucuguaucugguacuuuggcauuucguuucuuuguauuaaauaaugccauuuauaauuguuugauuuuuauguucucuauaucaccuagacuucaggggcuuuaaaggcaaaauauuaucuuaaaaguuuuuugcauaaaccucagaaccauuguugauauucuugaagcacuuacaaaggaaaucaaaugauuagauuuaaugcucaguauuagggauuuaauuuaguuucucuugcaaaauauguguuuuuuuaaauauagaguauaaacaaaaaguacuuugcuauaaaaaauuugcauuucuaagaaacuaaaaugucuuaaaauuuuguauuuuuucacucauuguccuucauuuucaggacuguugggaaagauccugauggcuauccgagaugcagguuuugaaaucucagcuaugcagaugguagguaguuuacaaugaaccauaauauuugugaggauuuuuuucaaaaauaguuauaaaaugcuuuacauugaauguucccuguguacucaugaaccacauuaaaaauaaaagacauacuuacugaacucaguaaccuuccuguagucaaaaaaugguuuuugaaaugauuuuucccauauaauauuuuacugagagaaguaauauucaaugauacaccuaauuuaagcuuauaagguaaguuuauacaauucuggaaacuuuaguugcaaaauaaauaaggaccaaaaacuguauuuuguucuuauaaacaaaaaguagaaucaaagugagaaauugugaugaguuuucugucuucuggauucuucacuaaacaaauaaugaaggaagagaaucaguucagauuuuuuuucccuaaccagugccuuuugcugguuuuuggacuuucucucaagacugucuuuggaguuaguguauucuagcaacucuguuggcacuuguaccgcugcaccuucagagcccacgcuuguucaaaauugcguuguucauacacuccuaggaaaccuuucagugagaaacaacacccacuuugguagaggucauaccuuugugcuguacucaucgguacauuugacuagaaauugggcaacagauuauuauauaaaucagauaaacaauuugguuuuuacaguguuugaagcccagcaaguuugugcuuuuuugauagugaaauaccaaaauagccauuuugaagcugagaauuuucuuacugguauuauuuguauuuuauuuucugaaaagaaacagcuuucuaaagucuuaagauuacccaaaaucaaggaccaggacacaaacuggaguucuauuuugugccaauaagccaaaaaagaaaaaaaaaaaagggaaauaguuuacaaagucauugagcaaaacuuaaagacuaaugagaaaacugauauuugaagaaucuuaccuagaauuauaaaguaauugucagccaaaacuuucuaaaaguauuagcuuggugauauauuaacaagauuguaggaugacauguaagccuauuuaaaaaaauauagaaauguuaguuuuaaacacugaccuaauucuagaucuacaguuuagcauagugauuggugauuggguauaguuuguacuaaugaaaaaaauaauuuuaaaaaugauuaauugagccuauagguaaggcaugguaguguaguagcaaacacagucguggacuuguggagucagaaagaucuauuucugaaucuugggucagcuguuuucuaggcauguggccuuggccaaaugucaagcauucuuauucucaguuuucucaucuaggcaaugaaagcauuaguaucugccuaaauggguuacucagcagauuaaauaaaauaaucauuucuggcucaaauucuaaguauuuaauaaaugauaucuucuauuaguauuuuguugcauuuagcaaaacauaugugaauguuggauaaaacacugaaauccaacagaauuuccucccuaugguaguaauguugcccauaaaaauaaauccuccuagcuuaaaugauuguccauauuggcagaaauuucucagugggucuucaauccuggcaacaauaaacaagcaaaauggagggaaaauaaaacugggaauucugaggcuacuuuuuaaaaaaaauaaggucuuaguuuuugagaaccuuagaauuuaacgaaauuuuauuccuaacuaaauuuaaauucagccuugauaagaauaagucccucuagacuuacuuuguaagcacacuuuuacaguucuuuuugaagaguagcaggaaguccacaugacuuguauaaaugcuuuaacacaaaccagacuaacuagggauuuuuccgaaugcuugggaggaaaaugguauuguuuucuguuuccucuaaaagucugaacuacuuuucuuuaguaauauuucuuucuugugccacuaaucuaucaauaguauaauuaauauugcauauaaaucuucuuuuguaucaagaaugagguuuuauucagagagagguguaguguaguagguaaaaguauuaucaauggggucagacugcuugagauaggaugccaguuugaggaaguuguaugacuccucugagucuuaguagucucaucuguaaguuggagccauuaauacuaccuaugcaguaaggugguugugagggcuaaaugagaugaugcacguauagaaccuagagugaugcuguuauccauuauuauucuugaugaguugauguuuaauaacacuuuuucuucaaagaguaaucuauguaaaguuuauguuuuagaguaaagaagagauuacaaguguuaagugcuaaguguggcuuauuuauuucccuuuuguugguugguuuaugguuuuguuuuguuuuauuuuuuaauauaguucaauauggaucggguuaauguugaggaauucuaugaaguuuauaaaggaguagugaccgaauaucauguaaguauaaaaguaaauguaaaacauuuguacuguuaagugaaaaguauaggaugcaguguuuuggacuaagcuccuguacuaggucccaaauggccagacugaaaaucaauacagagucauucauacuaaaguucugugucaacgaccuagguuguuaucugaccuucugagaaaucaggagagagcgagccaaauuucccaaacaggcuaauuuuguuugguauaauaaugaaguuuucucugucuuucauccauacaacaaaaaguaaccugagguaaccugauguuaaccagucaguuauuuccacauuacauucuucaaacuguauaccuuucauaucucccaaaauucauugcaaccagccugcagcuuccuaaauucaguucucuucuuuuuucuucccccucuguagagucagaugcuagguucagaucuuaaaucuucuaguuauaugaccaucgacaauuuauuuaccuucuuuaaaccuugauuaacccauuuauaaaaugggaauaaugcuauuaccuaccuuaugagauuguugugggaauuaaaugaaauaaauuauguaaaacugucucacauauuaaaaguacucaguaaauauuaccugcuauuauuguuguuuuuauuauuauuuagucugauauaauucuuugguaguagauuccguguugauuauuuacaccuguauuuucugcuucaacauguacagucauaaaaaggugauaauuccuaucucaugcuguuacuaugauccacacuuauuauauauauugaguaucugcuauaagccaaauaaucagugaugaacaaaaaacauacugccugcauuuauggagcuuaugcucuggagaagauagacaugaaaucaaaugauccuacacauagcuaccuaaggacagcagucaaaaggcuguaaaggaaacagaaagguuguuuuuuuguuuaaaaaauuugugacuuaauuaaaaacuagggugacuuaaaaauucugagucaauuuuugaaggaacauguuaugcuuuugaugaaguucuuuguuuaacauguuuuuucuuuccauuuuauacauuuugacagccuuguaugucuauuuucagugguaucuguaaucaacacugaaagagaaugagugagagagacaaagaaagaaaaaaggaaggagggagagagaaaaagaagaaagaaagaaacaaaggaaaaaaaggagggagaggaaaaggaaggaaacaaggaagggagggagaagagcagacaaaauuuacucuucuguuuuuggaaaacuuguucaugccuucugcuccuucugaaaauuuggcuuugacauuuguguguaggcaguacuucaauaucagaggcagaaaaucagacucaauauaauuauccauaaaaaaucaauuacauaugaccuuugugaaauagcaaaauggcuuugggggauacacucaggaacucuaaugaguagaguuaugaguaccauauaaauuuugaaguccuuuuccuccucuuuuagcuucuguaguuuguauuagcugagaugacugcuuuuggaucaauauucaaauauauucuguaauaaauuauuuuacuuugauguuguguaucguaaauccucaaagucaugaaaaugguuuacaugacccugcauggucuggccucaucucuuacuacuuucccguagucucacucagcuccuagccucuaagcugaucuucauauaucccuacuguacuucugccucaaagucuuuauauccauuuucacuucugccuaaaguauucuuuccuauucaagagggugaaaaaaauuauuuuugaguguucuagacacuaugagaggcauuuuucuuggaucauguuuuucauuauacagcuuuauauagagagcuaagaaucuuaaaacaguauacuuauauuuuuccccuauuauucugugugcuguuguucucauacauuuuacaucuauauaugcuauaaacccaacaauacaaugcauuucuuugaacaauuauguuugaaagcaacugaaaauacaaaaauuagcuagaugugguggugggugccuguagucccagcuacucaggaggcugaggcgugagaauagcuugaacccuggaggcugagguugcagugagccaagaucgugccacugugcuccagcugggcaacagagcaaaacucugucucaaaaaaaaaaaaaaaaaaaaaaaaagaaaagaaaacaacagaaaggaaaaaaaagaaaaauaaagcaacuaaaaaauaaaaaugcauuuuauguuuauacuugacauguuuacuguugcuuuguauagauuuauauuuuugucuggcauuuuuuuccuucugccuaaagaacuuccuuuaauauuucuuauuauauaaugcuucugauggugaauuguaucaggucuuuuuugucuuaaaacgucuuccuuuuuucuucauuuuugaaaaauauuuucccaccuggguauagaauacagauuuacauuuuuuggucaucauuguugucauccuuaucuuuuucccacuguuauauaauguucuuuccccugccccccccccaacacccuggcugcuuauaaagcuuuuuguuuuuguuuuuagcuaauuuuauuauuuugcauccuaauguacuucucuuuacauuuauuauccuuggguucuguuggaucuauagguuuauggguuucagcaaauuuggaaaguuuuuagcacuuauuuuaaaaaauauauuuauguuuaucaccuuuucuucucuucugagauucuaauuacacauauaauagacagcuugacaugguugcacagcagggcuuuuuucuucuucuucauuuuucuuucucuccaugcuuauuuuugaauaguuucuauugaaugucuucaaauuuauugcucuucugcagugucguauccuguucaccccauucaguguauuuuuaaauuuagaugucuuagauuauaucucuagacguuguauuuggaucuuuuaaauauuuuuuauuuucuccucaccaaguuuauauuuccuuguauaauuugagaauguggagcuuauaauagcuguuuggauauccuuuuuaugucauuuauuuaauugcugggucuauuuauugaguuuucuucugguaaugguuaguauuuuccuacauauuugccugccugguaauuuuuuuacuggauacuguauauuguaaaauuuacauuguuacaugguagauuuguaaagagugcucaauuuuggucuggcaccuaguuaaaucacuuggaaucaauuugaaacuuuugagucuugcuuuuaaucuuuguaggauggguauagagcaucuuacaaucuagggcuaauuuaggccaacugcuauggugcaguacccuucugaggacucuccuugaugcuccauauaucauauaaaaaggccuuucacucuggcugguagaaacauaaacucuucucagccuugugcugucucugaguuguuuggucuacuuucuggcaauucuuuccccagccucaaguaguuugcuguacacaugugacagauuaguagccaaagacucaugggaacuccucugcagauccuguagcuuauuuucugcauacuccccucaucucuccaguauucuuuccugaaaauaaggcuacauuggccuccccgaagugcaaucuuugucuuuucaacucagagaacguugggcucuguuguguuuccucuaccuggucuacuggucuggaaacugccucuagacaguaagacagagcaauucuacagcucaccuaaucuguuuccauacuuucaggggucauagaccugugcugcccaucacccaguguaugaaaacuauuguuucguauauuuuaucuaguuucuagauguuuaauaugggagaauaaaucugguccuauuauuucuuguugcuagaaugcauuaugauuuuuaaaagguuuuuuaggauaaaaccuuugaaauuuauauauauauauuuaguaaugugaauucaacaacauuguauucaagaaggccuuugcaaggaagauauacuagaagaucauuccaaauaaugaaagugucggaugauaaagcauuauauuaaaaugugauaggaauggagaagagagagcauaucuaaaaaauauucuucaaggaaaaauggacagaauuugggaacugcuugauaugugggauauaaguggggaagaagucacagaugacuuuaaggacauuaguggaacagugaaacaauuaaaaggggagaguuaaaaauuguuaaauucuuuucauucuuuuauauuacauaucauaggacauggugacagaaauguauucuggcccuuguguagcaauggagauucaacagaauaaugcuacaaagacauuucgagaauuuuguggaccugcugauccuguaaguuauuguuuaaaauauuauccuaguuuguguuaucuauucacuauuuuaacagguuuaaaauuuuucguuuguuccuuuaaguaaauaauguaaaaaugaauauaauauacaaaguuuuaauucaaaauggcacuucauaaaauuuauuuuuacauaacauuccaagaaagauaauuuuuuuuguuaacuuagugacaauauagaauaggcagaagcauuuacuaucgcauuuucuuuuuuucuuucuucuugcuaaauuguccagguaaauacauuuugcaagcuucauaauagaaauuaucuaagguauuauauauccuuugacauaggggggccauaaauaaagcuuuuauaauacaguggcaacauaccaauacauaaauaaauaugggcaauaagacuuaugugaaauuugguauucacuaguauaccuuucaguuugcuuuggguuuucuuccuaaagcaaacuacuuuuucuuggacauuuaacagugcauguauguauguguguauagguguaggggggugacaaguagaaguagcauuagaacgcuaugauaaagcucuaugcaaauauuagaaacuugauaggauuaugggaaguauuaaugauuuaaauacuaaccuuaauguaaauguacuguuuccuguauuuuacuauuauuuauaaguaguuuauugaagaugagcagccaauucaauuuaauuuuauucagggcauuguuuauuauuuuuaauuuuuuuuuuuuuuagauggagucucacucuguugcccaguguagagugcagcggugcaaucucggcucacugcaaccuccaccucccgggcucuagugauucuccugccucagccaucugaguagcugggacuacaggugugugccaccccgccuggcuaaucuuuuguauuuuuaguagagacaggguuuuauccuguuggccaggcuggucuugaacuccugaccucaggugaucagccugucucggccucccaaaguguugagauuacaggcaugagccgcuaugcccggccauuuauugaacacccuuagauguaagacaauaaauccacagcaucuauuaagaaaucaucuugugucaaagugcugcuagauuaagcccaguaggggagaacaacacuccuguugucagugaucuaaaaguauauacauaaagaucuuuuagaacauuuacagugccacaugcaaauaaggauauuguuauuucaguaaaauccaaauguuggauuguguagcaacagagcaguuaauaugaccugaaaguaguuaagaaaacuuaaaggaagagagauauaagcagggguaugaaagacaaauuagggcacaaagagaaugagaaaagaucuaaagcaugugcaaaaacaccaaugaaggaauuugcaaauuuacugugguauacagcaagaauauuuucuugacuucagugggaaauacauagcuggaagcacaaggaaauacauuuucuuagauagaggaaauaugguagagaauucugguagagaugggugugauuuuagccuuagaagccaggauaaaaauuguaauucuauuuaauuugaaucccauaucauaggaaauuggaauuccuuguaugcagcuuaauuuugacuauacugaauuguuacuuugaugcaacuaggucaaacuaaauuggaagagauuaaagucagaggcucuagaaauagaaagagacagaccugaugacaucaauagagaaagucggcaggaccuccuuuauaucuuuucagggagaaagaauagauacuuaaauaacacaugugguugugauagaguaaugauuacaaggugacucuguugcaaaggccauugagagaaauugguaaugaugcuguuuauugaaaauuaauuauaauaaauuaggaagggauugcuuuuuggcuagaugaguaaagguaacaguuuuugccauuuuuaacauuuuaaauuucugauuucuguuugaugggcaagagggguuuuuguacuuuuuuuuuuuuuuuuuuuuuuugagacggagucucgcucugucgcccaggccggacugcggacugcaguggcgcaaucucggcucacugcaagcuccgcuucccggguucacgccauucuccugccucagccucccgaguagcugggacuacaggcgcccgccacugcgcccggcuaauuuuuuguauuuuuaguagagacgggguuucaccuuguuagccaggauggucucgaucuccugaccucaugauccacccgccucggccucccaaagugcugggauuacaggcgugagccaccgugcccggccuguacuuuuuuuuaagguaaguaaaacugugagugaucagcuugaccuaacaaacagaaguaaauuaaagagauaaaaacuaaaacaaaaaaggaaagaaauaagaugauucauucuuuuguucucucauuuauucaauaaauauuuauugagcccaugucaguauuugugaauauauagaagcccaggcugggcaugguagcacacaccuguaaucccagcauuuugggaggauaaggcaggaagauugcuugaggccaggaguuggagaccugccuuggcaauauagugagacccuauugcuauaaaauuacacguauauauguguguguguguguguguguguguguguguauacacacauaauuauauauuuuuuucuaucuuuauuuuuguuauauauauauauuauguaauaaaguugauauaauauaagccucaaagaucuuagccugugaguaaacaacuguaaguggcuaauuuccaugcaauauggcaauugcauuguuagauauuugcggguacucuaggaacccagaaauauagcacuuagcucagccugggaaugugugacacagugguuugaauguguccacgaaaaguucauguguuggaaacuuaauccccauguguauauguugaugguauuuggaaguggggccuuugggagguaauaggauuagauaaggucaucauggugaggcccacauggugagacuaguggcuuuaugagaagaggaagggagaccugagcugacaugcacacucuugcccuaucaccaugugauaucaugcaucauguuaugacacaguaaggucuucaccaaaugcuagugccgugcucucagaccuuccagccuucagaacuuaguuauuucuuacagaaauaacuuuuaaaaaauauuuucaaaugcucucacccagcagaaauacauuuauuuucuccauaaauugccuagucucagauauuguagcaaaagaaaauggacuaagauaugugacaaaugucaggggagacauggcuucugagcugaauuguaaggaauuagaacuuaucuuagugaugaagguggcaaaugauaugguuaaaguuuugaaugccuaaaacaacaacacuuuggggcuacagcaagcucuuuauuacugcuggaacuaauguucagcgcaaggaaugauaaaggauggggucauucgggaggagcuggggagugagcagguucacgaucauagaaagaagagucucgaaaagaaaacaaugcugauucccauuuuuuuucuaaguauuuauucaaggaacauuuacugagugaauaguaugugcaaggcucacuccuggguccuauugcuggggcauaaaaaagaugacuagaauacguuauauuuccuuaaggaccucguaaccucaugauagcucaaucuugaaacucuuucagggcccugaaucuugucucauuaaguauggauggcauuacucuacuguguuuuuuugguucauuuuaguugucuauaaguuccucauagcauuauagaaaguugcaccacagggauuuuaaaauuuggaacugauuuaacguguaaaauguuaacagugguuaucuuuaggagguggaaauaugauaauguuucaguucuguuuuccuauauuuugcaaaauuucuuuaaaguacuuauauuacuuuuauaauaacaaaaauacuuuuuaucuuaaaaccugaaaguuaaugaacuuuugaaugaggaggcauauacuucuaagaacugauuaucuugugucucagacuccugaguuacauucuguuucuaaguggagauccaggaugucaggcaggacuguaugccuuugauggggguuuucaaaucagaagaaauacuauaguaguuacaaucaagcuauguuuugaggacaauaaaauggcucuuucccuuuggucucagaauuucaaaauccauuugauuccuuuucuccauucuuuucuuucccccuuuucucuccaccucgccaacaaauggauauugaaugcuuacugcaugccaguaacugcuaggugcuacuaaguuuauauuaaugaucaaaccaauacagguuuguuuuuugaagaauguaugaucuagcucuaggaagagauagaauugauaauuaaauaguaaucucaccuuaaagugcagaugugccagucuauucauguauuauauuaucuuaaaauaauuuagaaauucauuucuucauugccuagucacucccauaucuaaagaaagacccuuggugaugagaugugcaaauauaauuagugcuuggaagauggccagguaccuaauggccaugcaauaaauauuugaugaacuaaugaauaaacuggcuauauuauauauauauaccuaacaccugguacuaacuuauuauuuaaauauuuuuucuaucgaaauggguccugcuucuuacaaauuauuuucuaagauauagagcuauuuuauaaagugauucacaagaaaguucagccuaacagugaccauuaaaucaguuuguaacuauauauguugcagauugacaugauuucaucauugaugucugugcuuuuggcauauucuuccccuuccaguucuuauagcuggaaggaaugcucauuauguauuaacaaaauuuuuuucggucucucuagaagugguguccaaagaggagagggugcacaagacaauucauuagggaggggggaaauauuagacuugcaauuucuauuuacuaucuacaaaguaauaaugagauuaaguuuuaauaaaauauaauguguggacugauaagacugcauuucuauaauuuauuuaaaauaucugcuuaaagcccugcaguggcucccuauuaccuuccauaggaaggcuuucaaaguccuccaugaaacagccauuccuacuucuagccucauuucuugcugcauuuugugccuuuccucuguccucugcauuugcacuuuacccuccacuaacgucaaacuggaccgagcagggugguuccaccuguuaucccagcacuuuggaaggcugagguaggcagaucacuugaggucaggaguucaagaucagccuggccaacauggcgaaaccccaucucugcuaaaagcauaaaaauuagccaggcaugguggcgggcaccuguaauccuaacuacucaggaggcagaggcaggagaauugcuugaacccgggagguggagguugcagugagcugagauugcaccacugcacuccagcuuggacaaaaaagugauacucucucugucuaaagaaaaaaaaauuauauauuauaucacacuauuuauucuuccuuaauaaaccagugucuuucuucuuucuucuguuucuauauccuucucuuauugucuuauugacagagaaacuuccucagcuauugaaacuuugcccaagcaccugagaauuaaauauuggucccaccacccucagacagaauggcuacuuccucuuuuguggccuuauuuuacccuauauauacuauuuuuauaucaccuguuaaauuuuacuguacuuauuuauuuaccgucugucuacuuccugaaauuguuccccaagaucauguuuuauucaucuuaguauuucuagcauguagcagaguaccucgaauguggaaaacacuugauaaauaguugaugguggaacaaaugaauggaagaauacaucuagagucauguacuggacaaaugaauagauuuuucgaaauagaauaugguccuauuaaagaaaaaaaguccaggauuucccccagacuuuugaauuugccuuguuuucaccacucauauuguaguaugacaugauauguaaaauauuacagaucuguuaaauauauauguauaaauguguguauauauguauauauucauauauauacauauaugaauauccaaaaucuauuaaacaggaaaucucagaagaagagagcauccacaccugaagacagcuuagcguaagaugaggaagguucagacuuggaaagacaaccuaguaugggguuuuagagcccaggugggguaagcaugguuucccuguagaaggaauggccuggcauagggugcccgaucuuaugcacagagaggagggccugugauccuggggagcagccuggcauggggagucagaaccugagugaggugaagagagcauucacacuuggaggcagcccagugccagaugggcauugauacagaagggagaucuggccuggugugucagagccugauuggcaugaccaaggcauccaggugagaggcaucgccugggucaggauauugaagccugugugagaugagaagagcaucuucauggggaauagaugaugacagauaugggagguugguuauaugugguagaauucaucaaauaacuagauaaauuaaagacaauaggagccagauuucucucagaggagagauauacaaauacagaaaaugagaaaacugcaaugaacuuuguguucgaauugaaauuggagauaugauaugaaggcauggcuuucaauauacacagauuaaauguagaaauaaaagauauaaauguguguauguguacacacucagaaaaauacaucucucucucucucucucucuauauauauauaugcauguauucccauacacauauuccauagcaaagaacauaccuaguuuccagaucuugacuucuaaauaccauucuucacucuacgaaaugaagauccucagagaagugaaauggcaaauuccagaacuaggggaagcaaaauacaauaugaucuuggaaaaucuuuuuaugccaaaguaauggugacauaucaauaggacacagaagccagcuugaagggguuccacuaguugaaucgaaaccaauuugagcaucuaaguaaaucaugauagcaacacguuauaaucuauucauuguuacuaaaauaggaaaccaagacuuuagacaaauaguaauuaauuaaucaaaauuuuguuuaaaaugggauauauauaguuucaaaaucccuucccacaaaauauuuauuaauuaaaaaaaaacccuuaacauuauaguuaauaauguuaacauaggcuggcagacaauaagaaauauuaaaaaaauguagugauaaaagugaauaucauagauuggaggaaaauuaaaucauauaccacaagauaggaugaaauaaaaagaauguaacauuauuucugugauauuccugccaaauauuuauaacugaauucaauuauacagaaauaugacaugcccauggccucuaaucuuuagaaauauaaaggucacaaaguugaauaaagacugaggaacuguucaggacugaaaaacacugaagagacaugauaucuaaaugcagcaugugauuccaagucaggauacuuuggccauaaaugacauuauugagauaauuagugaaaccucaccagggucuaaguaugaagacuguauugugguuauauaggaggcuguaguuguugguaagaaauauaaacuaaaauauuuggagguaguggagcaucagauuagcaacuuauuuuugaacgauucauagcaaaaacaaauuaucuguagucuauuaguaacuuuucuauaaauuuacaguucuuucaaaauaaaacuuaaaaugucaaguuuuuacaacucaaaaauaaguaaauaaauaaaaugucauugucugugaagucaaggccagcuccacugaaaaugugaaagaaauagauuauauuguuuagcuccuuccucuccucgccauaguccugaggucucagcccgggguuccucuauugucuuaacagaacaaagucucuaagcaggucuggucaauuuggucacacugagacacaaauuacuauucagaaucaauauauuaccauuuccuugggguuuuuuccuuuuccuuuacuuuuuaaacagauuucauuauuuuuauuuuaaaagaaaauuucaacuuuggaauuuuaguuuccaggaagcuaagaaaagcugacuuacaggacuucauaguugcccuucaaucauucaugcauucauaaauguuugagugccuacugugugccaggcaguauucuaggcaccaaggauacaccagugaacaaaacaaaugagaaagugagagagacagagagauaaaaucuccucacagggcaccaagcuuacauucuaguuggagacagauaauaaacaaauaaaaaauagaauacauaguauuucauaugauggaaaaugaagaaaggaagcaaccugaguuaaggaaguguagauaggauuugauuauaaguuggagucaucagagaagggcucacuaagaaagugauauuuaagaaaacauuuagcuagggacaguggcucaugcuuguaaucccagcacuuuggaagguugaggugggaggauuguuugagggcaggaguucaagacuagccuggucaauauagcaagacccugucucuauuuaaaaacaaacaaacaaacaaaaauaaaacaaacaaacaacaacaacagaccagacugggcaacaagguaaaaccucaucucuacaaaaaauacaaaaguugccaggcaugguggcacaugccuguaauagguuaaggcugcagugagccaugaucgcaccacugcacuccagccugacugacagagugagacucugucucaaaaaaauuugggugugugcacauguguguucaaguuuauguguauauaaauauauauaaauauauuuauauauucuacuggcacauauacuaccuggcacacaguauauagguauacaaauauauuuccauauauuuguaugcauauaaagacuugaauauguauaaauauauguaaacauauauacauauaaagcucuugaaaaagccagccaugcugauuucucagugaagagcauccuaggcagaaggaacagccagugcaaaggccuugggagaggagcuugcuugagguaaucuagaaacaccauguaaugagcaagguagaagauaaggucagagagaugagggacagggcagaucucauagguccucauaaugacuuuagcuuuuacucuaacugggaccauaaguuauugaagaguuuggagagaagagugacauaauuugauuuuaaaagaaucauuguuacuaguguauugagaauagucuaaagacaagaguggaaguuauaauccagguacaagaugauggugaguuggaccaggauggugguaauagacauggugagaaauagucggguguuauuuaccauguguuuaccuuuuuucucuuuaucuuaaguggaugaguagaugaagguuaaauugaugaaauagaaaaagggaaauggaagaauccuuaguucuacggaguagaaauggaauaaaacagaguucucucuacucuauuaugauuuuaucucacucuauugaugagaaaauggaaggugaauucauauuccugccugucaauuuaguacauaacaacgcuuagagaaggcauuuauaccuaaccagagauaacaggcauauccacagauuaacaugugccaagcauuucuauuacuaguuuauaguaaaagaaacauuuuucuuagguaaucaacuuaauuuauuuuauaagcauuuuguuaacuuuagcaaauguaaaaauaauuuaaaaauacauuuucaggaaaguauuaagugguuuaaaugcauuuuaacauaagaaaauugaaaguaauccaaguacagugaguauauauaaaaaaaguuauguguuaguaauuuauuuucuuugaagugauuugcaugcaauaacuuguaauaccuauuaagugauucagugauuacaaaauaauccuggagaaaaugaucauguguuuaaugaagaaacauuugucuaaccgagaaaaagaaagaaaacccucaucucaaugucguauauuaguuggaugaccaacaccguucccaauuuggccaggacugucacagguuucacacugaaagaccagcauccugagaaaucccccaaucccaggaaaagugggaugguuaaucacucuaaauaauuuaccuuuuaauuguauaccucuuaaaauugaacuguaauaaaguuuauuuauauucacuuauaauuuuuaaauagauguuauauuaaguuauaaaagcuuagaaguacaguuaaacuacuuccacccacauccacaaaaggucaauuagauuuauuuuuuaauuaacuuuucauuugcuuuauaaguuauccuuucauuggaauuauuuacagguagagguauuaaguacaggcccacuucucaaaacaacauauggguugaaagcuaaaguauagagguuggggaaaacaugcguaacugaaauguaaguccguguucaaacucaugauuugugaaaaucuuucaugaaggaggcaaaccaaaaugauaaaaaaaugaggaaaaagcugucuuggaaggucuccuuagccuuccuuccaucaaguuucuguagcuucuucaucauauaagguauauuggaacgcauuucagaauaggagauuuagaguaaauauuuauuuauuucaacugucauuaucuauucauaaauucaggcauuuauuaaacacuugcuaugaaccugauaucauguuuauuuauuggggauucaaagaggaguugagacccuuaagaagcucucaguauacugggagaaucagacaaauaaauugcaauaauguauuguaggcuggguacagugacacauaccuauagucccagcuacuuuagaugcugagguguaaggaucacuugagcucaggagcucgagacuagccugggcaacacagugagauccuaucucaagucauaauaauuauaagauaugauaaagguuaucuuagugagaaguacagaaugcucaggaaauacagccauccucugguaucuugggggcuugguuccaguacccccucagacaccaaaaucugcgcauaguuaagucccuuauauaaaaugguauaguauuugcguggaaccuauucacauccagauuacuauuacuacuuaauacaaugccuacacaucacuuaauuuguguggauucaauguaguacuuagcacauggcaaauucaaguuuugcuuuuugcaacuuuguacaauuuuuuuauuuuuccaaauauuuuugauccgugguugguugacuuugcagaugcauuaacucauggauauggaggacugauuuuacucugaaggaacccaacccagucuguguugagugggguggggcugaggccuagggaauaggcuauucagaaaaggcuucccugaggaaaugaugccuggagcuauaauuuaaagaaggaguuaaauuuggcuuggcaaagaaggaaaguuccagagaaaugaagagcuccuacuuauaggaaauuaaagcuccucccaucugccuucaaguuucccuaaggaaagucuggaucuucagcaagaaguuucacccuuauaggagaaaaaguuguauuuaagauccagggcauuuaucuuaaggauggaguugcauucaaaagugguaucucacgucaucugaaaucuuagucucuuauuuuuguguuuuuuccuacuuccaguggaauuaaugauaaacacugagauuacuucuaaugggaauggguauucucugcaaaggauuuuuccucuuucccagggcuacuguagaugaagacuuuuggcaggcugcauugauuggcauugggcuauauuacuaaaaaaaaaaaaaaaaaaaaaaaauucaaaauuggaaaaauuuuuuaaaugccuuaacaggaaauacuauuauuuuuucuuugcuuugcuuuguuuguuuguuuuucuguuuuucugagacaggguuuuggucuaucacccaggcuggacugcaguggcagccugaaucuccccaucucaagcaauccucccaucucagcaucccgaguagcugggacuauaggcaugugcuacauggcuggcuaaguuuuaaaauauuuuguagagaggagguaccaccauguugcccaggcuggucuccugaguucaagugauccuccugccucaguauccggugugcuaggauuacaagcaugagucacugcaccugguccaguaguucuuuucaagcaggaaaaguuuuguauagagaaauguaggcaaagucauuuaggauacagagggaaguaggugaggcucuaggggaauaaguuguacuacgguaagaaacuaaaaguguagcuaaacuguucuacauaagaaauaaaagggaaaaaagcaguuaagccaccagcagaggcugagccuggggaaagagaauuuagcaucugggugggugaaggaauuuucagaacauaauuucuaaaauuuaagucugagauauuuguguuucuggggcauaaauccucuauaucccaaaacuuaaggaaauuuaguacauauuaaagcuuugggugguggugguguggguagaaaagggaaguauaaauguguaacacauuuaccacuacugcuggugccuagaggaaggaguggcaucauauugaaaagcauagugcagcuuauagugcugcuuuaagcuguggcaggugaggaaguaaacagugaagccgcaaccagcacaaaaaggcuacaccaugcaauugauucaaauguacguaacagucuuguuuuccuaaauauaucaaaggggagaaggcaaugggguaaauacuuuuccuuucuuugacguuuuucuuauaugacuuuuuauccuacuguuguguuaaguucugagacuaaaggaauacaauggaaggggggcugcaaauagaacagauuuuacaauuuggauaguuuucagucagcacuauccaauacgaauguaauacaagcuacauauaauguaauacauuugaaauuuucuaguagccacaucaaagagaaacagauggcauuaauuuuaacaauauaguuaauuuaauauauccaaaauauuuuaaggauauaaucaauacaaaaauuauuaauggaauauuuuauaaucuuuuuccuuuuuugcacuaaaccuuugaagucugucaugcauuuuacacuuggagugcaucccaauucuaacuagccaaauaucaaaugcuuaauagccacauguggcuaccauauuggacagugaaagucgagaccauuucaacagacauugcuuaggaauauagaagucuucuccauuauuuguuauuauuggagugcuauacuuggguuuguugucagaauaaacaauaaaguauaauauugcuuaguuuugauuucuuugcauauauuucucucugguuuauuauuuucaacuuuauugacaaaauugacaaauauaacuauaaaaauuuaagguguacaaaugaugauuugauauacauauauugugaaaugguuaucacagucaaguuauuuaguacauccaucaccucacaguuacaacuuuuguguauguggugaggacauugaagagcuacucucuacaaaaacaaaaacaaaaaaaaucuguuauucuucugcuuuuauaucacaacagucaacagaaaagaccucugugacuuuuggucaccaagaaguguguggggauuuuucccuaccaacaaccaaucaauucuguagcggauucuucaacagacacuagcuaguugcccucuaauucaauucaauucuuacauuaucuaccuagagaucccauagguugaggguucaauuccacaagacugcccccacuuccugugcuaauugcaauucccagauuguuuugcuugugcuuuuacugacuugcuauaaauaaauuggaguuuccacaacccccacuuugaguuugauuaauuugcuagagcaacucacagaacuaagggaaacacguuuacugcuuuauuauaaaggauauuacaaaggauauaaagaugcaaaggaaauguauaagaagggguguggaguuuccaugcugucucugggugcaccacccuuuagggacuuucauuugcucagcuaucuggaagcucucugaacccuguccuuuuguauuuuuaugaaagucucauuucauagucaugguugguuaaauuauuggccacugaugauuggcuuuaaccuucagcuucucuucccucccgaaaaguuaggaaguagagcugaaagucccuucugaucauacauugaucuuucuggugaacagcucucauucugaagcuaccuggguggugucagccaucaguaaacucauuagcauacaaaaagguacuuaucacuuugaagauuccaaagauucuaggaguuguaucccaggacuaagaccaaauguguuuagacaaagaucaaauguauauuucacaauaucacaacucuuuuagcaaauuucagguacaguauguaugcucuacuuuagauucccagaaguuagaacuuuuuuaucuuauaccugaaaguuuauacccuugaccaucaucucuccauuucuuccaucugccaagcccuggcaacuacuauucuacucucaauuucuaugaauuugacuuguuuagauugcacacauaggugagaucauuuaguacuugucuuucucugacuuauuucacuuagcauaguguccuccauguucauauugucacaaauggcaggauuuccuucuuuuuaugauuuaauaauauucucuuguauauguauaccacauuuucuuuaaccauucaucacuuauccauucaucugccuuagccuaccuuuaaaacuaacuguuuucuggcuucccaggugggccuugcuuucuaaagcucaaauaagaugcuaagcuaguauuuagcaaccuugaaaaaaugagucaccucuccuuuuuuuuuuguuucauuuugacauuaguaccugucacuucucuuuacaacaaaauaaauaauaauagagguaggaggcagagaaacucuaggcagacaggggugagucccuggugaagccucaccuucaagccaaaaaaccugaaacccguggcccaaagugagaacuucuaucccuauuugccuggucuuuccugauugguucuuucugaauaaugucuuuuuacaaauugaauguugccuuuuucaaaacuaccuauggcuuacccugccccccauccugugccuauaaagaccccagacucagccaguagaggggagaagcagcuggauaucuagaagaggugaguugacuucagagaugauggcuggaugucagaaggaggcagcuugacuucaaggagagagggagagaggcaaccugacuucaggggagagaucugcccuucccuuccccuccagcuccccuuuccacugagagcuacuuucauugcucagugaaauuauccgcauucaccauccuucaauucauuugugugacuucauucuucuugggcaccagacaagaauucggggcccaccaagugugaauacccaaaaaggcugucacacuggcccuuugcccucacuggcggagggcagcugccccacauaaggcaaagggcccacugagcugguaacacacugcuguccacaggugguggagcuaagagagcauuguaacacacccucuggggucuuggcauugcaggcacccccacuuggaugcugccacagggccugcauggaguuugcuucugccggugccaaaguggccagcugguuccugcauuugcucaccuacgcaugcccucccacaaggcauugagcauggcaggcugaguaaauggggcaccgcugucaugggucucaugaagggaucaagaaaauauccugcauuaucaauaccuuuguuucuugacaugguccuggagaaaguuacaaagccuuuuucuuuucucuuuccucucuuuuuaaauaaaguuauccuaagaagcaaauuauaccagauguuuagugucuucuagucagaaaauguuugauguucuuaugagaauuuaacaauaacuuggaccuauuaucauuuuuugaaauggcaaaaauucaaacaaaagccuucaugguuuugaaaucaauaaaggaacucaggggacucagaagagccacacggguucuauagucauguuucaaacaaggcuguucccuucuuuucuucagcaggcucagagagcagguuaggaaaggaaagaccagucuuuucaaaggggcuaacaauggagaucaauauugagacuuuuuucuuggaugucuacucaucuaauuuuaauccaugauauaagcucccuuuccaaaccacuugcuucuaacaugucuuccuacguuuuaucuugaagagcacuuucucauucuuuauacuugguuuguccccuaaacuacaaagccugaagaggacuaagguuuuccuuucucauaauucacuuuugaaauuccaagaucaguauaauuaacuguauagaucuucaaaagauaugcuuguacauacuagaaagcuuacugcuguggacaucugugggcucauuaccaccaaucaauauguauuacaaagagaaugaauguauagcacuggguaaucuggagcaccuauuaacuggaaauuagcuuaacaagcuuacacccuguauguguguguauguuuguguguauauauauauauauuuauuuauuuauuuuauuuuuauauuuuuucccaagauuauuguuuuuaugagacagcucaacugcugucugaccaggaugggucucuuuuggccagagcuaaacacugacccaaaucucuuuggacaaucaaccagcuaaagaccaggaaaauuuuucaguucuuguucucuuccuuccuuuagcauuuggcauguuuaaagauuaguugguuauaauucuguacuuaagaaagacaaaaaagagaaaaaauuaauggggagugauacacaggaaagaugccuauuucauauauguucagccuuauugaucagggaaaugcauauuaaaggggaauaauacaacuuuuuaaaccagugagguuggcaaaauuuaaaaaaauagauaaaauccagcauuggcaaccaugugguggaagagguacucgaggcuguaguacuaugggugagauuuuuuuuuuuacuccugugcaguucauucucauuauuuacaguaguuaaguucuauaaaguuaccaugaacacugacuuggugaauacugaacuauuguuccuaggagaaauacagaguuagguuccugugagccuguggucacaacaaauauauuaaugaucaauauauaaccuuguuuuguguguauuucuguuuaaagacacuaaauaaauaucguugaucuaguaacauugaacucauggccagcaugacuguaacucaugccugaaugaugccugcauuacauauauauuuucuuuauaaggcacaucacagcacuguuauacuuaggacucuugacagcucuucggcacuaugcucaggaacuguuuuaaauaguaaagucaccaacagaaaauacaaaaaugcaaaaaauguaacaccaaguacacugcaaaaaggacaccuauagccagguauaguggcucacaccuauaaucccagcaacuugggaggaugaggugggaggaucacuugaagccaggaguuugagaccaacuuguguaacauagugagacccugucucuaaaaauauuuaaaacgaaaacaaaaacaaaaaaaccuuagcugggcaugauggccugugccuguaguccuagcuacucaguacucaagaggcuaagauggaagaaucacuugagcccaggacuuaaaggcugcagugggccaugacaguaccacuacacuccagcuagggcaacagagcaagaccuugacuuaaaaaaaaaaaaaaaaaaaaggacauuuguuuuaaagugugaagugugagaguuaaaauaagaaggcagagagugucaccuuguucacccucauuugggaguacucaugaguacucauuugagugacucaaauuuuugcugcucugcacaugucuaccaauggccauacaugugcuauuaauauugauuuugggguuacaaauaaauuucagugaguagguaaauucacaaacauggaauccacaaacaguggggauugacuauauuuucuauguuuuuuaacaaugaauuuaaaugacuuuuuuaaaaguauuuaauagcaauuuauuaaauaauuuauuaaguaaaguuauuaaguaaaacaaauuuauuaaguaaauagcaaaguaaauagcaacuaauuuuuaaaauaaauauuuucauuuaauaaaauauucuggcuaaagaaaagaauuucucuugaagaggagguggcugaaagggguuuaauacaauuaguaaaaauuacauacuagaaaauacuuagauuucagaauaacugugugucuuggauuucuuuugcuuugguguuaaauaaugcucaauccccaaauuuguugaaaauaauuacucucucugugaauauaaaaagaagaaacauugcaaccuaguaagagaguaacaaacagcaguugacauuaaacuacuguauaaaacaauauuguaucauauuuuucuaugaaaauuaaaauuuuauucaaauauaauaguauugaaucaacggcaaucuuuuccugaaaaagcagaagauguaauucaaauuuacaagucagagguuuggaauuuuauauauccuuuucuuguaaugcguggauuuuuuaacuaaauuuuuuaaaugaagauuuuucucuuuucugguuguuccugccauuaaguaucauaacugggauucaaaucuucacauuguugcucucaacuucaugccuuuaaccauuauaucauauuguuuuauuacauguucgugauccuaucacaauauuaccagggcauaaaacaugugcaaaucuaaugacuuuugaaaauuaaauagaaaaguauucucuguuaaguuuuaaaaguagagauugcauaauauuuuuuccaggugauuuagcuguaagcugauccaaaagcaacaagauagaugacaguuuuuaccuuauauuuccuauaucaugauuacuuguauuauggauagaaagucaaaacccagagaaacguuaacugauuggauuaaaggcaaaaagaacuuuauacuaucucagccuccuagguaugacauacuguaaauauaggaacaaaauaauguuuuccccuauaaaaccauuuaaacagcauuuuuaacagauacaugauaaauagugcugugguaaauuauuuuacaaaaauguuuauuauguuuccagauuuauuuuaaauauuacuucaucauauaguucaccaaauaugguaauuguauccucucauacagucuuccaagcaaaacauuaugcuuugauaaacuggaauuuaaaaaagaaagggaaaacaugagauauguucuuugaucugaaagaacuaaugaucuggagcugaacuggagcuugcaaaagaaaaauuaaaaaaaaaaagagcuuaugaucuauaugagggauucaauagacuaugguaggaauaugauagucccgugaccuggaauauaccuaaaagucuuauuuaauguggccugcaaacaaaggggaaggaagccccgaugaggccaggggaaugaagcagaaacgggagagaacgacuggggcaggguagcugauaauuguucagugugugauucucuagagguauuauauugccucugauuacagaaccuccuccccauccccugcuuucuuuuuuccccauuuuauuugugauuaugacguaacuggcaaauuuguaguaacugucauuuuguaguaacauauuguucuuguuuuggcacauugcauuuacaguguacuccuuuauucugauggaguguguguguguguguguauuuaaauauuaugaaugauuuguucuagagcaucugaaacuaccacagaaggacuaucuaaacaacaaacuuagaacauaguuucuagaugaauaccaauguuccaacccccacggggcaccaacacaucugauacagaauuauuuugccacgauaauguuuacuauuaccucacuuaggaaccaagcauugggaugcucucuagguucuagguugacacauacauuucuggaauggaggcuucagucucaagcaauaauuggaauaauaucaacaauacuuucauauauucaggcauaucuucuaguguaguggagaauauagaaaagucuuaggaauaaaacucucagagauucccugugguauacagacuuggguaaacuagaaauaaauuucacuuuaagggauuuuugcccuuuuaccuccauuuuuguuagauugagauuuacucaguuuuauuugacuaaaauuauuaaauacacuguggguguuggguauugaggacugagcaugauagacauuggcucuguccacauggaauuuauagucuagugaggaauauuguuauuaaacaaaugauuacauaguuguauauauuacaacuaugccaagucuuuuagaagaaucugauaauugugcaagaaauuauauuaauaacaggaggcucuagcuuagcugaaguagaggaauuccugaaagauuuucauuuauucugaagccuguagaggcccuaaaucuggggagaaccuagcauauucuaggaauucaaggaagucuaauuuggcucuagccuacaaugcaaagaggaaaguagccuacaagguaacuaaagagauugcuuaggccagaguaugaaggccacauuaacuaguuuauauuuacucugagugcaacaggaagcuccauggaaaauuuaaauaaagaauuaaugacaucuagguuguauuuuuaaaaagcucuguggcuaugauguggaaaauuuguuggaggaaaauaaaggaaaucggacuagaaauaaugggaccuugggcuuggaugguaacaguggaagguuuugaaauauauuuuggaaggagaacuggaagaacuugguaauuuggacaugggcacaagcaaguacauaguuuauuuacuauagaugaagaaauucuugauagaaauguuuguuuuauuuuggaauauauacaguaacaguaauuaaaacaccaaagccuuuauucauuguuucaauguuucucuggagcuuuuccagagauuuaaauaucacguacauauaaauagcuuuuacucucaaaagcaggagguagaaauagcaaaaaugcaugcaaucuugaauuuaaacuauuuuaacuuuggcaucuauuagguuuuaguaaauuuggaacccccuagucuuugaugaaaaaggucuugaguaugucugguuuuguucuuaaaguagugguguggcaauaaugaggucuuaugcugcuccuucaguguuaauuuuaauuuuguagauuuuuuaaaaacucaaguuuuguaaaaacaaaaaaugcuauauuucacccuacuauaaccagcagauguugcuuucuuauuaguucugcuguggagauucauguguggauggaauuaauugacuaaaaucuaaaaacagauggacuauggaaacacauucuuuauaaccuuacaggaucgaaauccaaccaauauauauguauuuuuccaaaccuguaaaucuauggaucuuuguauuacuuuauuaucacccauaaacuugaucuaaguaauuaaaggcaacauuuagagacuuuuugggauuauuuccaguuuuggccuuuaagccuuccuacuaauuaauuaacauaauuuacuucuaggaauugugacacuugcugagauguuacacuuauuacuacacagaaugcaaaugaaauggcucuuugaauuauuaacacuauaaucucuacuuucagagcuacagaaaugauuagaauagaaauauaccuuucuucuggaaaguuuuacuauuauuuugguuuaaacauaaguauguauguagauuuccacuggggaguuagcuguuaacagccauuuuuucuuuguuauccuuuucacuguuaaacuuacuucaaaaggcuucuaaagguuccugacauguuacagagauaauauacacaguaaaguuggccugaaguauuuuugucucugauuuauucauuuauucagucagccaacccaccaaccacuaaccaaccaaacauuuacagacuuucaaagugcauaugaaguauuaauaguucuuaguacuagcaaugaaaacaugaacaagacaccuuugcugagccagaggaauuuauguccuaguugaagaaaagaauuguauugucaauaauugcaauaaagucuuauaauugcaauaauagacauauauuaaauggaaaaaaauuuacgaucaaauaagauugagaaauacugguuuaaaugaaguuaagcagauuuguguacuaaaggacucuagaacaugucaaaugcugacaugcauugugaaucuccaaaagagggcaucugguaugaaguauuuuccaauuuuguugccaaaaguuacagaugacaaccaggauaaggagaaauuccugaccauaauucuugcuaagcugcuuucagggaccuugaagagaacauaaagaacuuugaaacauagcuuuuacuuuuuagggaagagaaaaaagauaaacaggacuccauaaaucuagccuucauuauuuuguuuucuuuauuuccagacuacucacuccagcacccucccuuccccaccgcaucagaucuuugcacugauuuggaggcuucuaugcuuuccugcuuuugaauuucucaucaauguuagaaaguaacauuguccuguuauuaaagcuuauucauacugauacaccaaaacucauaaauacuugcauuuuucagacuauuuucuaguuauaaggugaaaaagauugccuuuaguuaaaggaauuuggaaaaaaaucauuuuguuuuguuuuucuuuguugucucuuuuuuuccuucugcuucugugauagugaagguguaguuaauuuugauccucuucccccuuggguguacccugagacuaauccuagagcaagguucuuauccugaugucuacagaccccuauggcuuuugggaauagaauucaggggugcucuaguuugguuugcuugacucccccaaaucucauauugaaaugugauucucagcauuggagguagggccuagugggaggcauuuggguccugggggcagaucccucaugaauggcuugguggcauccucaggguaaugacugaguucucacuguguuaguuuccuugagaacuguuuguuaaaaagagccuggcaucguucccuucuuccucuugcuuccacccuuacccugugaucucugcaugccacuuccccuucaccuuccaccaugaguagaaacagccugaggcccucaucagaagcagaugcugguaccaugcuucugguauagccugcagaaccaugagccaaauaaaccucuuuuccuuauaaauuaccuauccucagauguuucuuuauagcaaugcaaacggacuaagacaaggggucugugaacuuggaugagaaaaaaagaaucguguuuauuuucacuaauaucugacugaauauuagaauuccauaaauauaaacaacuaaucacuguuauagcuauguguuaauauaguaguuaacuuagcaaccaccagaaauugcaaacauuuucacauugcauuacaauuguacauaucuuaaaacaucauuuacagucauugcuauuuuaaaauuauaagaguuauuaaaucagcugcuacauuuuaauaaauauguacauuauaucacaaaauauaaaauauucugauaauuuuauuuuagaguaauuaauuuccugcaauucuauguauuuuaugcauuuaaaaacauugcuuugagaaggguucauaggcuccaucaggcugccaaaagagguucuuaacuuugucuuugcauaagacaaaauuaugaacccuaguccuaaaggaagauacacaaaggucaaauaagaaucccuggaguugaagaccaagcauuaacccaagacagcuucuuccuuuuuauuccuuguccuaguauuaauccucccuacccuccguguuccaggccucugagguauuccuccuuguaagacuuguagccauccauucuuuuucagucucucaacaucagcuccaacuuccauauagauauuugaauuaauuaauuaguuaauucaucaaauauuuucuggggacuuacuacauacuaaguacuauucuagauacaguagaaauacaguggcaaaagaacaaacaauaaaaucuaucuucacagaggacguucuaguuggggggaaacagaucaggagcggaauaaauaaguaaaauauauaauaugaugguaaguguguaggggaaaauaaagcaggggagggaaauaggguuuuccagaaaagggagggauuuauaguuuuuaaguagaauggacagagaaggcugcauuuaaaaguuaacauuggauacagacuugaaggagaugagggugacagucaccuagcaauccaggcuggaggaacagcaagugccaaagcuggaguaugcuuaguauauuggaagaagucaggaggacaguguggccagaguggagugaaugugugaggugaggucaaagagauacaggaugggaaagaagaucacauagagcguggaaagcugcugaaaauacuuuagcuuuuacucugaguaagaaggggaccauugcagaguuugagcagaggaccaacauaaccuaacauguuuuaacacaauaaugcuggcuuccauguggugaauagacaaaguggggccggagcagaagcaggaagaaugaauaaugaaugccaguacuugacauguggugcuuugcagugggcucuagagccaggccgccugagauucuucaucuguaaaauauaaucuguuucuucaccaauaaaacggaaaaagaauaagccgguugugaggauuauaucagcuaauaugggcaaacuucuuagaauauuccauaaauauggauuuuucuuacuuuucucagagccuaggauacaugcugugaggguaccacacaacuauuugacacauaaugggcaagaugggaagacuugaaugaguuuugggcaaccuuguuccuaugucuugauuuuaggagaguaauugaggaaaggaagcaccagauguugccuuuagaucuggaaccuuauucuuuucauacauauaugugaugauggugcuaaagcucaaauuacauaagaucaugggaaaacaauugacacugacucugauuauagaaaguagugaauuaguaaaugaaaaaacuaaaagugugguuauaauaguaaguauuguuuuuuaaguaaacugcaacauuacauugucaguuuauccuaaagaacaauaacauaagcauacuauuuugcuagacuaauuauuagugugacaauaguaaauauauauuuauaggcuuccugcuuuggucuuauagaauaaucuuauaguugaucaaaaaauuagauggaaaacuguuuucaguaugagauguugggccauccuuguuuuaugaccuucaagaaagaaaagaaacuuccaauggaauuacaccaucuguaaagauacuaagcuugcccaaagaacacagauagcaaauuugagagcuuugauaagaguucaaaauugaauaaaauugagucaauaauuauuuauugaaauguagugguagucaaggcauuacuagauuuugcuugcaaacuguuguaagaaaagauaaguuuacagacaauggcaaaauaaaucugacaguaagauaaaugcuuuaagagagauacagguugugaauaagauuuucaaggaaagugcuuacaucucuggaguaagugcguaagguuuccgagagagugcgacaucugaaagaaggugaacccuguggaauacuuagaauuucuauaaucugaaaugggaaucuguacuuuuaaaaugagagauuaugucacauaggcauugagauugcaaggcugaguaauuuaguuugaagcauuggauauaguauaauaguagacaauaaagcuagagagauauuagcaucauaaugaguccaaggcugggaauuuuguuacuuaauaaacaugaaaaaccauugaagguuacugacaaaguagcacugucaugugaucaaaguaagaguuaugugacaauaucuaguauggauugagugaaaguuuaggaggagaggcagccaguacugaggcauuugagaaauaaaaauaaaaucccaagcucccuacugacugaacagaucccucacuuggacaaggggaccccagagaaaccuuaaaagcuaaauucccuggccugguguggugacucacuccugcaaucccagcacuuugggaugcuaaggugggaggacugcuugaagccaggaguucaagacaaaacugggcaacauugugagaucuugucuuuucaaaaacugaaaaauuaaccaggcaugguggugcauaccuguagucccagcuacuugggagacugaggaaggaagaucacuugaguccaggaggucaaggcugcacugagcuuugaucaaacuacugcacuccagccugguugacagagcaagacccugucucaaaaacaaaacacgaaaauaaacgaguucccagccaugaggggaugcgggaucagacacaucucauuauaccuacuccuuugcuaaccaucauuagccuucccuaaggguuaaagagaaacuagccauuuugaaaaacuugcuccacugcugauaucaaccauauaaaccauugcugcccucccuucuguaguuuugacagggcaacccaccagcauuccuuccugauuagagaccaccaaccacagaaugguucuggccauucuacggagacugagcacagagggcuuuuauguccucugcuuuaccuuuugauuuauaaggccuaauuguaauacauucaaauguuaaaucuucacccuagagugaacaugguguugcagucucaccagugcaccacaguguagcagucucucauugugagguaucacccagaauucuuugucucacaaucaagagaauuaaggagcguggacacaaagagugagguuggagugaaaguuuaauaagcacaagaagaaagcucucugacagggagagagggcccagaagaggguuaccauuuguacaguugaauacaaagacuuuuauaagaaaacauugagggcugggugucucauuugcauaaggcaugaauuucugguagcuccagcucauccuccuaaugugcauacaggcuuuagcuugacuuacuccauauuucuuuguuccccuuacugcacaugugucaggggauggaauuuuccauugcaagccugacugggcaagucacuuguguagccuuucuuaucaguggggcugugggcaugucuuaggcaagccauccugugcaguucccuuaccugugccugcaggcuguucuuuuguuugaaaggauucaacugaggacccacccucccugcccgccugccugaccagcuucuuccuuucucuucucucaaugggacacauguuucauacacauuggccuacugugcauacccaugccauuacuucaugaauauucauagcuccuccuauaacccauugaauauuuauacuuagccaaacugcucagcauaaauuucuguucccuuuaccccucccuccaauugcauguuucuggcuucuggccagagauuaugcuuccuagccuguugguauggccacccuucagacuacaacccuuaaugagaaauaagcucuccuuuucaaaguuauuaaccucaucauucuucaauggacacauuauagcaguuuaagaagccaugcuuuagagagauugcaaaggagaacaauuuuauaggccuuacuuaacuucuguaggccuaugucaucaucucuuaaaccucacugaguuacuguguuaggcuguucuuacauuacuauaaagaaauacgugagacuggguaauuuauaaauaagagauuuaauuggcucaugguuuuauagggaggcaucaggaagcuuacuguuaugucaaaaggcaaagcaagagcaggcaugucacauggcaaaagcaggagcaagcaaaggaguuggugguggggaggggggugccauacacuguuaaaccaccagaucgccuuugaacucagagugagagcucacuuaucaccaaagggauggcccaagccauucaugagggaucugcccccaugauucaaacaccuccuaccagaccucaccuccagcacuggagauuacaauucaauaugagauuugggcagggacaaauauccaaacuaucaguuacuaugugcagcaaaugaacuauacauguaaaacacaugacauaaugugggaaacauaguaaugcugaagaaauauuagccaucuggugaugauggugaugauuaugccauuguugcugcugcugcugccagacuccccagauuaucuuaccacauccauuuucuuuugcaaacaccauuucccuaccugccuuuuaaguugugguguuucuuggaauucuguuuucaaccugaacuuugauauuuuucugcaugucuuccuuugauaauucuauccacuuuuaugaccuuaaccaccaccaguaggcugguaacucucaaaucuuguuuccagucuaagaacaccuccugagcaccagauccauguuucuaacuggcuauuaguaucucuacaagaacaauccuacaggcaagcagaucccauucuccuuccuugcaaacuugcuucugugcuucuuuucuuaucuccauaaauucauuaccagccacagucagcuaagccagaaaccuugaagugugucuuugcuuuugccuuuccccaacccauuauagucaaucaaguccuucaagauaccuucucaccaucucguaaauauuccuuucuguccauuuccaguuccccuaccuuaauugagauuuucaucacuucccgacuguuuuauaccauaaccuccuaauuagucuccauaccuucagaauuacuucacugcaauucuguaaccacacugcugccugaguaaucuuuuuaaaauguaaaucuagucauauuaugccccugcuuaacacuguucuguggcucccaaugucuccugaguaguuaaaacuccucagacaacacuuuacauggucuugccccuuucugucuauguagcagaauuuacugaaucuuuguuuuauuuauuuauuuauuuauugagacagucucgcucugucacccaggcuggagugcagugauauuaucauagcuugcuacagccucuaccuccuagacucaagugauccuccugccucagccugccaaguagcugggacuacaagugcgugccgccacaccuggcccauguuuuaaauuuuuguagcgauagggucucucuauguugcccaggcuggucucaaacuccugaguucaagggauccuccugucucagccuuccaaagugcugggauuacagaugugagccauggcacccaggcuugaaucuuuguuuauaaugucaguuuuauuaucauucagggauggugaggccaaugcaucagaugauugccauugaaaagauagcuacaauccccaagaggacagugcacacugcacaugcagggccacacagggaaacaugagggugggucaggaaacagaagaauagggggaaauaugggcaagagcuucuauugugauuuccuugggaaggaaugggugaggaagggcuaacaaguucaggauuggcuaguuugaauaauuucaguggacuguaggguguacagggcuguucuaaguugucugacccugucccugaggaaauuagggcaggggaauauugauccagauuguaagagccugauagaggagguuggaguggauggggucugaccugguugguuugcauaugaaaggcaaucucacaggggagcccuuuauuaucucuagaagauggcuggccuugggagggacagucuccucagggucaauaaggccccagauguuaaaacaucagaauaaaaagaugugcuuaacacagucucuuacccucacuggcuaugcuccaagcaauucuaaaugacuugaauuuccaaccacucaaggcuaaauuccucuacccucuuccuggagggaagauaucuucuuggaaauaauugcuuaucucuuaauuuaaugauauucuugguaaagcccucccggauguuuccaacagaauaacucccugccauguuuauugaguauugcuuaucacguuauauagugauauauaaaauaagaauucuuauuuuacaccuuuucccccacccccaccaguccagaccauaagccccuugaagaaugggaccgucauacucauuuuuuacuuucuggaguuuguaaccuagcagggugcuugguguguaguugacuuucaguauauauuuguugacugagaugaaaaauaacuaaugaauaggugaaugaauuaauaaugaauuaauaaguucuauaucagucauaccuguggaaaacucaucaucauugaauuuccuuuauuuccuaaaaccugaagaguuaggccaaagucuuucaguuuuaucauuugcacuaaguugucaucaaacuaaaugauuuaugcuucuccuuccaacucuaaaauucugaauuuuggcugaguaaacuuuuaguacuuuuggugaauuauaccuuuuccuuuuaccuuuauauggcuuagaguuauaaugugcaguuuugaaaguugcagcucugggaaaugugguacaugauuuuuauuuuuguagacaauaggaaccaacaaguauagcaaagugguuaagacccugggugcuguugggcauggugaaauacacuuuagacucagcuacuugggaggcugaggcgggaggaucacuugagcccaggaguuugagaccagcuugggcaacauagugaggcuccaucucaauuuaaaaauaauaauaauaauaauaauaauaauaauaauaauaauaauaaaaaagacccuggguucuguuaucuaucuaaguucaaauccuaccuccaccacucaguagcuuugcucuuggcaagugugguauccuuugaaaacuuuaguuucuucauuuguaaaauuguaauaauaaugauaucuaccucauggaauuauuauugugaagaauaagugagauaauuuauguaaacuuucuagaacauagugaauacuuaauaaguguuagcuaacauuauugucacucuuguaauagagguuauuauaauuaucacuauuuaaugauacucugcacucuuaaacaguaugauacuggccaagguuucaagguucaguggccuuauuugugauaaaugaaaaauagacauaauaugauguagacacauguagcuuuaaguacguuuaaguauuauuauuauuauuagucacauuuuaugaaaucgaaauacaagucaauguaagaacaucuuuuuuguuuuauaauuaccuagguggccugucugguaauuuaauucuuucagagaagucuuuuuaaaaaggaaaauaagaaaaucuuuguguaaaaauugagcaaggucuauacaugugauuuuuaacagcuuuauugagguguaauucacauaccaauaugauucacuuguuuaaaaacauauagcucagugguuuccaucaccacaauuuuagaauauuuucaucacuucaaaaacaagcccuauaccuuuuggcuaucauuugccuacuucccaccucacccucagcccuaggcaaucacuaaucuacuuucuaucucuauagauuuuccuguucuggacauuucauaugaaugagaucauauaauauguggucuuucaugacuggccuuuuucauguagcauaauauuuuuaagguucauccacauuguaucaugcauucaguacuuuauuccuuuuuauggcuaaaucauaauccauuguauggauauaccagauuuuguuuauucuuucaucaaaugauagacguuuggguuguuucuaucuuuuggcuauuaugacugaugcugcuguaaacacuguguacaaguuuuugugggaauauauguuuucaguuaucuugaguauauucuuaauaguaguauugcugaguuauaugguaacuguguuuaaucauuugaaaaacuaguagaguuuuuuccaaaauggcugcaccauuuaccauuuuacauuaccacuagcaguauuugaggguucucacuucuccauauucucaccaguauauguuaguaugacuuuuuaauucuagccaucucagugggugugaagugaugucugauugugguuuuaauuugcauuucccuauugacuagugauaucgaguaucuuuuuaugugcuuauuggccauuuguauaucuuccauggagaaauaccuauucaguucuuugccuauuuuuaaauuaagucauuuuuauuauugacuuguaagaguuauauguuaucaauaaaagucccuuaucagagauauaauuugcaaauauuuucucccauucugugggcugucuguuacuuuucuuguugguguccuuugaagcaggaaguuuuuuaacuuagauuaagucuaauuuaucuauuuuuugcuuuuauugcuuauacuuuuggugucauaucugagaauccuuugucaaagccagcaucauaaagguuuuacuccuauguugucuucuaagaguucuaaaauuguaggucuugcuuuuaggccuuuuauucauuuugagugaauuuuuguauauggugugagguaaggauugaacuucauuuuuuugcacauugcuauccagcuguugaaacauuauuuguugaaaagauuauuauuucccccauugguuggccuuggcaacuuuguugaaaaucaguugaaaguggauguauauauuuauuucugagcucucaauucuauuccauuaauccauaugucuaucuuugugccauguguacauuugaucuuuagguauuuucuuguuuugucuuauuuuucuccuagagaauguugacaucuaagaauacacacacacacacagaguaguuuuuaauuaauacacaguuuuuagucaugauuauagagcuaacuagacaucagaaaugaaucauccagaauuacacacuuaaauaugaauaugaauagaaauuucauaaauaaauuucauaaaccugaaauuuuucuaaauaaaaucuaaaagcauaguuuuuauuuugacaaguauuauauuuuuccaaaaaucuuuuucaauuuauaaagcaguuaaauauagaacauuucauuuugguccuaaggcuaauauggugaaauauagguacucuuauuuacuuauauuauuguaacuccauuuuaucuaugaaaaaacagaaucaugaaaacaugaagugaucuguccaggucacucacucagcuuaagacaaaucugcacaaauuuccuaaccccguucuguacucuggcuacucuaucaggcuaccucuauacuguuagauuaggaaucagcaucuuauuauauaaaauauuuucucuaauuauaacaaguauaucaaaggcuuuuauauacaagaggacugcauccugggaucuugaaucuccaguuuucauaccauucuagcaaauaacuugcugcguagccguaugcucagucgucaguagagaaugacagagccucauguuaugugagcagcuugguaggaugcacucacuagcugagugauuugcucccacucaccagccucugcaguauuacaaauuagugcacaucacauacuuuuagaauuucucuuaaguaguugaaguugcaaauauuaaaucucuaaauuucaagccuuuauuaauugugaaaguauccuaaugauuuucuacacugugguucuuuucuaaaacuaauucuuacuuaccgcuuuuauuuauucaaccauguaucaagugcuuuuuaugugucagacaaugccaagcaugcggauacugcaguaauggcacaaaaaaaucccuuuucucacaaaguuuuuguucuaauagaaagacagacaacaaaugaguaaaauaaguacugugagaauaaggaagcaauaugagagauggggagugcuuugagaaggaagccugucugaagauugauaaccuugaacauggcauuaaugagugcugcugcuacauggucaaaagaaaugguugcgcuuuaaacaaauacuguucugugauaggccaaagagaaguuaagaauagcaugaagaauagaauauaguuguaagaauauuucaagauaagauucuuccagcaaauuuagcuuucuuaugccuuuggauaacaguaacaacaaugaaacaccauccauauaucauccacaauuuauucgcagaaauccaaauugguacuuaguuaccucaguuauuugugcuuaguaguauuugugcuugaauaucucauucucaaagagaucaaagccuaccuuuucccacccacauuuauaguuguaacagccuaacacucaauuacuuauccuacuauauuugguuuuacuuucuucuguaacaaguaaguauuagcuucuaaacauacuauaccauuuacuauugaacacacuuauuuuuuguuuccuuucacuagcaugcaagcucuuggaaggaaaggauuuuugguuuuucacugauauauucagaaaagugucugguacauaguaagaacucaguauauauuuuugagagaaugaguguuaguaaaagaugaauuaaauguccauucuguauuguuuaaauacacaucucaugaacuauuuguuaugacugcuauauccaguuaaugacccagaaacuugauaacgauuugcucuaauccucaguucccuucaagguaaacuuucugauguucaucuuauaguuggagaaaugaggcucaaagaaccuaauuuuaaaaccuuuuuaaaaaaguaucuuuugaccagacauaguggcucaugccuauaaucccaguacuuuggaaggcugagaugggaggaucacuugaggccaggaauucaaaaccagcugggaaaaauaaauauaaaaauaaauaaauaaguagauaaauaaauaagccaggugugguggcacaugccuguagucccagcgacucaggaagcugaggugggaggaucccuugagcucaggaguuugaggcugcagugagcuaugauugugccugggugacagagcaagauuguugucucuaaaauaaaauuaaagaauuuuaaaaguaucuuuuuauuguuuccaaaagacauauucuuauuaaaaagccagcaucuuaacucuguucuaccugguuccaucuugaauuguuuguguuuuauaaugucaagaauauauuuccaaauuauaauugcauauaaugcaaaaaacauguuuugaaugcccuuaaagcauuuaagaauauaauucugcugcugaguuagucucuggucuguucuccaugauuucugucugugauaauaguacuaauauauauguuguagaugagagugguaacauucuaaacaccaaccucaaaagauuaguuguauaauauuccaguuaacuucaguaaccaaucaugaaacugucacccauggaauuuuaacucuuugaggauauuugccuaaguauccuuuuggauuagguacuuuuucugacucugccccuaacauuuugaauuuaguuuugacuuugccugcuucucuggccuuagcaucuucuauuacagcuaagaauugucaaaagacaaaauuacaacaaauuuaguuuaaagaucuuaauugacuuuuauuugugauacuagaauugggcaacaccucauucuguaaaauagaaugagugccccaauaagcugagcaguugguuuuauagucacaaaaggacugaggaaagcagaaacagaaaacaaaaaguggguugguuauuucaaaauuaauuuccuuguaaagguuaaagcagagaggauuuucuuaucaugccagcuaaaacuugaagauuuugcuauuaucucucacucuccugaucucucagaaagucagauaaacugaguuuuggcuugguaacauggaacuuuaccaucugugacuccauuuugguuugguguguugggccuuuugcaggaaggaguucaguccagaccagugggcuccuaucaauauuauuuaaacagaacuaugucgcccugucuacuuccaaacccaccuucuugucccuugccuuccauuccaugugugccaccuuagcccccauagggauugagaaauuuugauagcugucuucuuccauaguguacuuuuucuuuuuuuaaucucuauguuuuuauuucauuuuggaauucaacugguuuuuguuuccccauuccuuaacucauuuucauuucccuacuccuuguaucagucuuuuuugccucgcuauuuuucaguauguuuaucugaaugauucucauaaaaagugccuuucaguuccuucauuuuuucuuuuuucuuuuuaaaacuauucuucccuagugauuuuuuuuuaacugcucuuuggcugcauucacuauuuuucuuuuuuuuuaacaagugauacuguuuucuuuaagaucucagcuuaacauuuuaccucuuuuauuucuuuccacucucuuuuuauucuuagaauaaauauguucguuguucugaauaucuuuaaaaauaacccuauuccaaucagacaugucccuaucacagucagaaggaggggcucaaguuucccuaaaaagugcacauuaggaauggagcauagccaccagcuggagcugcuagcauuucaaaaucucaggaggcugcagcaacaugugccaggccuuaucucuguaauacacaugugcugcuugucaguuucaaauguuaacccucagcagcauuacuuaaagucaguaggcuuuguguugugauggaaggaaaauauuuuuaaaucuucuugagacccugggaaacuaccgcuuuuggacaugaaagagccugccaccuuacaaauccaucaauaaguaaaagccacugacaccagugccauguuucaguucaguuaaguuggcaugaauaguacugagccaugguguucucaggauguaauuacuaaggcguuuuauuuauaucgcagugaaacaauccuaccacuugcaaggacaaaaagagagacuuugggggcccuuaaauguaaucagcagacaugugccacccuuucaccuuuguauguugauuuuuguuuagugacacuguagcaaaacaauaaccauuagcuccagauaguaaguauguacaagcaugaucuuuauuauuauuauuauuuguggagauggggucucacuguauugcccaggcuggucucaaacuccuggccuuaagugauccuccugccucagcucccaaaauguugggauuacagguaugaacuacugcaccuggccaagcaugaucuuuuuaaaagcacuuaauugaaauauaaugaaaauauuaacucacgguauauauauuucaggaauugacuauucauauuauaaaauaauucuauauuuuccaaaagaauuccuuucaggagugcuucaaaaaggaguuuuccugcauucuaaauaaauccuaaauuuaauauauuuguuuaaaaaaugaaauacacacaguuuggggaaaacagccuggccuuauucacagaaggcuguauauuuguacaucaugcauacuguuuucaaguuaccauaacuaaguuguucagaccaaauaguuuuucuccacacaauaaccauaccaagagcucuagguauauaaaauuuacagaacuguuacagaguaaacuuaugcaaaggaggguugaguauuaccauacucccuuuuuucuuauuuuccaaguaaaguacuccucgguauuugagggagauugguuccaggaccccucagauaucaaaaucugagaugcucaagucccugauauaaaauaguguaguaauugcauaugaucuaugcacaucuuccuuuaucaucucuaguuuacuuauaccuaauacaauguaaaugcuauguaaauuuuguuauacuauauuguucagggaauaauaagaaaaaaaguuuguauauguucuguauaggugcaauuuuuuuucaaaauauuuuuugaucccagauuguuuguguucacggauacagaaucugcggauacagagggccagcuauacugucuuuccuuuaagaugucuccagcugccccaaucuugagugaccuuugccuuccuucaaacuccuaugccguuaauugucuacaccucucaccuggcaguugucauaugcuucuuguauaguuuaucuuuuauguauauuuacuuccuagucuaggaacuaacuagagaagucucuuuacaccuuuuugguaucuccaauacuugaaaaaugcucuuaaaacagugcuucucaaacauccauguacugugcauagaaaacaccuggggaucuuguugaauugaaaauugugauucagcuggucugggguggggccugagauucuacauuuaugacagacucccaugugaugugaugcagcuggaccacagaccacauucugagugaccagugucugucaaaccuucagcaaauguuuauugaugaugccauuuuuuuuuucagaaaaaggauaagagauuuaaauuuguuaagugcugcauuuuuauguaauaugcaaauagcacuaagacugaacugagauauugauugaaaaaauacgcugaaugauugaagauguuagauaucuuuuuuucugauuucuccaucugaucaauaggaauggacuuuagcuuauccauuuucauuaauaccagacuggaugagauuauacgugaauaacuucuacuucugucuucacuagauucaggcugaaaagcaaaagucuuuauaacacauuucuagucacguaaauaauacaaacuuuuucuaacuuuucucuuauuugggacaccuagcuuugcggagcagaugguuuucccaguaaacucuuagauucuauagguaucacauuucagggucaagaauuacgcauauccucaguauaaacucuguaaagacuuuuuuucucuuguuugauggaacucaaaaauggagcaauaauaguuaucaacaagcaaugagucugaguccucaggcuuuaauggcaaccaacaaacccaugcuccuuauugcagaggaagagugcauuguugauucgcuuuauauccccaaauagaaaacacguuaaggguaauccugggaaauuaugcuuacuucaaaccuugauugccaacacugaagugucuaaauagcacuucaccauuuuucugguuguuuucuuagaaacaguucacuugcggccgggcgcgguggcucacgccuguaaucccagcacuuugggaggccgaggcggguggaucacgaggucaggagaucgagaccaucccggcuaaaacggugaaacccugucucuacuaaaaauacaaaaaauuagccgggcguaguggcgggcgccuguagucccagcuacucgggaggcugaggcaggagaauggcgugaacccgggaggcggagcuugcagugagccgagaucccgccacugcacuccagccugggcgacagagcgagacuccgucucaaaaaaaaaaaaaaaaaaaaaaaaaaaaaaaagaaacaguucacuugcuuccuuccugugauaaaugccauauuuauuuuaguaugagucaaccuacacuuuuuuuauauugccucucuccccagacccccaaaucuccaauuucucacaagugaauuuaggcaaacuaaagaagacaucucuguuccgugaguauuaaaaucaaacauuuuuaaauguaaguuauaaaaauaacacuuucauuguuuucuuccuaauuacuaaaguaguccauguuuauuaccccuauuccaccuccaaaaaaaaaagaagaaaaauuauggaaaagagucaagaccuaauagacuaaaaauuuuaaaacuauucuuguuugccuacuucucagaaauaaacacuguaaaauaaacauuuugaccugaccucaaaccauugucuuuuuauauauauauuauaaaaauaaaauuaagauuauauaaucauuacuacuuuguaacauccuuuuuaaauuaaaaaauauauuguggucuucucuaauaucauuaaauauauuuccauaacaugguuguuaacagcugcauaguguuccagcauauggauuaacuaaccauuccccuacuguugauuuuuuucuaauuuuuauauaagaggauguugcagagaccagacuuauacauaaauguuuguacaaguuuuuaccuuggaacuaauuucuagagguaaaauugcuaggucagaggauaaaagauguucauuuauaauuuguuucaucuugcccuuucuaaaacgacagaaguaguuuaauagaacuuugacuuauauuauuucauaguuucuuuugaaaauuauuuucucucaauagcaaaacuuuuguuggcuccugacguacauuaauauacaaaagagcuacuuaauauuuggaacacgaauuaaccugaggaguucauaaacaguaggcauugcaaugaacagcauuuaucaacuugacuuaccagcuuacacugccauaguucuguuauagucaugucacauuugagacauuaguuguacaaacaguacaugaagcaacucacaugaauuuuaauugagaaugaauauuugccaaaacaguaauuugucuuuuuaagucuuuguuucauaugcagagaauuuuauuuguuaagcauaguguacucagagucaggccaaucagaaauaauauaagaaaagaaaaacugguuaacucuuucuaucuauauuagucuaaggaguaccagggcuaacaaaucuugauaguaugcuaauuuguuguguuucaaaacuugcucuuuauccuguugcgaaagcugaauucaauagaaaaaugauuauauuuuuaaaauaaaugaauuacaugagcccacagcacugauuuuaaaguaggacuugcauugauacaguuuauugaauaaagcaaaaauuuuuacaaguauuuuauaaguuuaaauagcaaauugaaauugugcgaaaauaaugauuuugugauuauuaaacauucauuguuuuaagagugcauguaacaaaaaguaucuguaguuaccuaacacuauaauaguuaaaauaccuguuaauauguauaaguuaacucuacauuuuuguaaaaguuuacaacauugucauuguuguguucauuuauuuauuuuaaacuuccuuuuuuaguaaaaauguaaggccauuuauaaaauuuaugcaauauaauaaaauaaagugaaugaggaaaucaagacagagagcaaaugaggcucuaaacaauaaaaugcaugccaugaaauccuguacuuuuguuauggguagccacauuauuacucagcuuuuagacuuccacccaaucaaauuauaugacugacaguguccaugacaagcaaauuaguugcucacaaaaagcccaacuuuuccugauaccuaauagaaaauucccucauggaucucaaaugaagacacuaugugauccagcauucacuguccucaauaacuaccaguuucuuagaauauuccuuuuaagaugcuuaugguaucaccucaguguguaacaauuauaugagaagucaaaaugaucugaucccacagcuggugcaauauaggaauagaguuuuaaaggaaaagauguguuuguuguguucccuuaagcaaucuucuauaccuguucuuuaagucaagguuuugauuaauaccgaaugacaauagguucagaguuaaacuuucugaaaaauagcuggaaugugguuauuguauguccacaugcaagugcagagcagugugcuucaccucuuagccaagccaggugugcucuuuguggagauucagaauagcauggacauucaauugaauggauggauaccccuaaugagggaguacccaggcaggaccugaacucauucccaauaauuuguugcauagacgugauugaacaaucaaguuuccaaagcucuguaguauagaucaugauuguacagcuuuagccugaaauuuauaaaauaagcaggugugaucaguugcuugcccuaugccaugaaauaaaacacccacacauucaaacaaagcaaaacaaaaaccaucaauaaaauacuuauagacauuugucuuugaagcuguuauuuucugauguacucuccaagaugaacuucguacaaaauauaccuuaagggcagccagagagaaaggucggguuaccaacaaagggaagccugucaaacuaacagcagaucucucugcagaaacccuacaagccagaagagaguaggggccaauauucaacauucuuaaagaaaagaguuuucaacccaggauuucauauccagccaaacuaagcuucauaagcgaaggagaaauaaaauccuuuucagacaagcaaaugcugagagauuuugucaccaccaggccuaccuuacaagagcuccugaagaaagcacuaaauauggaaaggaaaaaccaguaccagccacugcaaaaacauaccaaauuuuaaagaccacugacacuaugaaaaagcugcaucaacuaacggguaaaaaccccagcuagcuaaugacaggaucaaauucacacauaacaauauuaaccuuaaauguaaaugggcuaaaugccccaauuaaaagacauagacuggcaaauuggauaaagagucaagacccaucagugugcuguauucaggagacccaucucacaugcaaagacacacauagucucaaaauaaagggauggaggaauauuuacuaagcaaauggaaagaaaaaaauaaaaaagcaggguucgcaauccuagucucugauaaaacagacuuuaaaccaacaaagaucaaaaaagacaaagaaggguauuacauaaugauaaagagaucagugcagcaagaagagcuaacuauccuaaauauauaugcacccaauacaggagcaccaagauucauaaagcaaguucuuagagaccuacaaagagacuuagacucccacacaauaauagugggagacuuuaacacucuacucucaauauuagacagaucaacgagacagaaaauuaacaaggauauucaggacuugaacucaacucuggaccaagcagacccaauagacaucuacagaacucuccacccgaaaucauucuucucagcacccacaucgcacuuauucuaaaauugaccacauaguuauacauaaaacacuccucagcaaaugcagaagaacgaaaaucauaacagucucucagaccacagugccaucaaauuagaacucaggauuaagaaacucacucaaaacugcacaacuacauggaaacugaacaaccugcuccugaaugacuacuggguaaauaacaaaauuaaggcagaaauaaauaagauaaauaaguucuuugaaaccaaugagaacaaagacacagcauaccaaaaucucuucaacacagcuaaaacaguguuuagagggaaauugauagcacuaaaugcccacaucagaaagcuggaaagaucuaaaauugacacccuaacaucacaauuaaaaaaaccagagaagcaagagcaaacaaaagcuagcagaagacaagaaauaacuaagaucagagcagaacugaaagagauagagacacgaaaaacccuucaaaaaaucagugaauccaggagcugguuuuuggaaagauuaacaaaauagacugcuagccagacuaauaaagaaaaaaagaagauucaaauagacacaauaaaaaaugauaaaggggauaucaccuacuaaucccacagaaauacaaacuaccaucagagaauacuguaaacaucucuacucaaauaaacuagaaaaucuagaggaaauggauaaauuccuggacacauacacccucccaagacuaaaccagaaagaaguugaaucccugaauagaccaauaacaaguucugaaauuuagguuuuuaaaugaaucuuaaguaugaaauauauuguacauagucaaaccccucagagcaauagagcauucaaauccuuagccuguguguuccuaugaagccuguccaaauaaguugcaaaauagugucuagagccugcaauccuguccguggugcuauuuuguuauuugugugagucucagguuucaauucucaaccuaaugaaguaccauuuaaaagcaacaauuagagaagcagccacaucucuucccuuuugcaguagaaauacucuaauuuuauuacaauuccccaauguaaauucugguuggucuuccuguauugccuagaguucaucuuuacccauuuugcaauucaaucuguuuggugcauuucuacuuauauauuuuuaaaaauauguguauuuuauaaauacugguguauaguuuuugaaugcucagaagauugaaaggccuagagaagauucaguccaaugcaaacaucauauauuaaguacuuccuugugucagagguacugaaugcuguaagggauacuaagaugaguaagacacaaucucuaauucuaauguauuuaucaacucuaggaagagacauucacaacuaaguuuuugcaugcuaaguaaauauuaauugaacaauucgacaccuauuauguacuuggcacuguucuuggcaucuggauauagcagggaauaauacaguucugaucugugcucuuacagagggacagacaacauaaaauuuuaguuacaauauaaaucacugugcuaaaauacccuuuguagcacagagguuuauuaacucuagcuauggauuaagaaaugcuucauggaagugacaauuuuucuagagucuuagaguuucauugaccagaaaagaagaggaaaaacaagcuaagggaaagcacagcauaaacacauaauggcaagaugugaaaguauuaauaagcuucaccccauucuguuugacagggauuuugaauaucacagagaaaauacacaggacucaauggaaguuuuguaaagagguuuacuguuaugacaaauauguauguucucuuuuuuauccugggucaaauuucaucugccuuuuucacuucuaaauauuuucuaaagcauaaaucauguagaaguguaugaaggaaugaugaggcugaaagaguagcucaagcaagaugaaaaaguuccuugaauugucgugucuuauuuuggacuuauuaauuguuggacuuacaaacaguggaggcccaucagagguguuugagucaggaagaaauuguaucaugcugacucucaauugcauuuugcugaacuaaaguaguagcuuuaguucagaauggaaagaaguucacagaaccaagaggauccugugaaacguugcauggguacccuagaguucccucuuuugugcuccccuuauagcacuuugcauauaucucuaguagagcucuuguuacacugugagugcuuuuagaguguuguguugaagucagcuugcaccagcuugcaagaucuaauuguuaguaucacuuuccaauucuaugcucugccuugguaggaauauuuacaccaugaaaaugagcaaacaauacaaaucuguuuuuuauuguuguuuuuugaaaacuguuaaacaguuacuagcacaucaccgacuguuuauuaacaugucugacuucuuauaagacugugaccauuuagaauaaaaauaccaucuuauuuuuauuuccuuauuucuagcccaguaccucacaaauuauagguaucaauaaauauuuauugaauauguagagggacagauuaacaaaugagaucaacaaauuagguaaugaccaauugauuuugggaauggaugaaaugguuggaaauagcccuauauuauguagccugaacauuugguaauagugauacuacuagaaacugaagaagaaaaacugaguugagagggagaggcagagggagggaucauaggggaagauaauuguuuugauuugggacauguuguguuugagguacugucaaaagaccaggauuagagaugcccagcauucacuccaguuacuaucaaaugacaguuuugaaauuacuuuuccugugacuuucuaaaauacuuaacuauacagacuaguugaaguucaaaguuauuuauuuuuuuaaaagauugcuucauuucaauaguacaagagaaaauugcauuuuuauaauacauucugaacacuacguuugcagggaaaagcagagaucagauagccuagaagagaaugacugaggaaauggaauuuuguuuuuuuuuuuaaaaacaauguaaguguguuucaagaucauagucacaguuuacaauucuauuaggaagagaaaaaugaauuuugggggaggauaaaguuaaaguuaccuuuuagaauauaacuccuaauaaaaaguuuuucuuuucaaaaaagcuauuauaaugugaccaugagaaaaaaaaaucuuuuuacaauaaaguauuagggaaguaaaaacaauauacuuucagaaggcaauaacuuuacauuaccuaagaaauggcauauucugauuuaguaaauguucucauuaauaggauaauacaguauaaucuguacacauagggcuuuucuuuuuuuuuucuuuuuuucugagauggagucucgcucugucgccuaggcuggagcacaguggcgugaucucggcucacugcaaguucuaccucccggguucacgccauucuccugccucagccucccaaguagcugggacuacaggcgccugccaccaugcccggcuaauuuuuuuguauuuucaguagagaugggguuucaccauguuagccaggauggucucaaucuccugaccucgugauccgcccgccucagccucccaaagugcugggauuacaggcgugagccacugugcccggccagggcuuuucuuaagaaauauguaaccaagaaaauauacuugacuugcaacuauagugaacagaguuuauucuuuucuuuauaaaugggagucuugccucaagaucauauauaaagaugugaguuauugcuuauagagguguauauauuuaaaauauauaauaguaauagacaugucuaacauaagaugaaagauuauuuauuauaugugaucucucauguuuagagugaauuggucuuuucuaugcuauggauauucaccagaagauuaaguaguucuuuggggaauagucuuaauaucucaacuggaaaagucauuuaugagcaugcacuuauaaacuuaaugcuauucuaguggauuaguccaauuccacauauuugucacauggcauuuuauaucugugaugaaacaguaauauuauccucaaucaaagucacagagcaaguuacuuucagagcuauggauuagagcuuagaguucucauuuccauucucaggcagguguguccuaguuugagaaaaugugauacacaaaaccaccaccucacaaaauagauaaauggugguuacuuagauuucaaaaggauguucuucgggguuccuuaaaauaggcacuucugaaggaucuaauauagccuaaggagcccagacuauugguaaccaagaggccuaguuucucuacccuaucauuaacaaaguuaaugggguauauaaauuugagcauguuagucauuccauucauccauucacuuauccacuaaaucauuaauauuuuauucaaugaaucuuucaugaggauucuguguguuggauauaaaaagguuguaguccuuguuuuuaaggaguuaagacagaaggguaaacaaacaguacauuuuuaaugguagagguaaugcagccuguuagcagaccacuaaaaccuaaacaagaugugaaggugaacugugauaguaggaguagacuuggaaaguaaggaaagaaugcuaugcuaaagaaauagaaucugugugacuugguaacaaauuagauggggggcccaaaagggagagagaggagucuuaggaugacucccaagcuguuggccuagguaacuugguguaagaguggugccauuuaugacgagagggaauuuaggaagagggggaguuuugggaggaagacaaugagguuaguuuugugcaagcugaguauaagagcccugugggggccaggcacauuauagcucaugccuguaaucccagcacuuugggaggccaaggcaggagaucucugaggccaggacuucaagacuagccugguuaauacagcaagacuuuaucucuacagaguuguuuuuuuuuuuuuuuaaauuagcuaguugugguggcaugcaccuguaguccgagcuacucuggaagcugaggcaggaaggucacuugagcccaggaguucaaggcugcagugagcauuaggcaguuguauaguccagccugcaacucagaaaagagaacugggcaguaguuaaagagucgucuaaagauauaugauaguagugaaugaaauugcccagggagagccagaagauaagaggagaauauggaguggacccuaggcaguaggaagguggaaauaaaggagccugagaggaacagucaggaggagauccuggacugugguaucaugugggcugaguaaauggagggcuucaggaauaauggaaugguccagaguaauaaaugcugaagacaagucacaaauugagagaaucuaugggcaauuaggagaauaucaguguccuuugccaaagcgguuuagauaguguugugaggcaaaaggcugaagaguaaaugaaaguggagcuuauuaagacuucuaaaaaggaggggaagagguaggacaguaauuaaaauugucuauuuguuaagugaugggagagacaugagcauuuugauaggaugcauaaaauaaacuugaaaagagaaagguugaaaacacaggcgaaagguaauuauaaugaaggaaguuuccugaccuagaguugcaaagagaugggaggguuaauuaucaaaagaagaagaaauggcacuuucuuuggcacugaauggaaagggggaagggaaggauaauguguguguauauauguguguguguguguguguguguguguguguguguguaggaauuugagggagcugaaucucuugauaucagucuuaauuuuuuuuucugugaagcaggaaacaaaguugcugagagaaaacauguaauugaggauggagccuugaggauaaugacgaacauuggcaaugccagcuguggaggauaagugggcaacagacaugauaaauuauagauagguagguagauagaugauagauagauagauagauagauagauagauagauaaauagauaggauuauagccuaggauggcagcaugagaaauaugguuagauugacugcccucaagcuuauguucaagguuuccauuagcaugagagagguuaauacugcagauauuauuagucuuggcucagcccuuaauguagaauguugcucagaaguuaaaccucgguccugggagagagcuacuauucucuaggucucuacuguccaauaugauggccauuagccacauauagcucuccagcaccugaaacauggcugguucuaacugagauguauuauacacaaaauacacacccaggacuugaaaauuuagcauaaauuaagaauguaaaaaagcucauuaauaauuuuuauuaauuaccuacugaaauaguauuuugaauauauaggguuaaauaaauuauuuuguuaaaauuaauuucacuucuuauuaauguggccacuagacaauuuuaaauuacauagguggcucacauuacauuucuuuuugacaacauugcuauugguaauuauaggagaagauuagaugguuucaaaaaaugcucaccuuggucuggaaucuuagcugcuuacugcaacuuuaaagggaaucauagaagacaugcggcaguuuaggaaauuaaccuuuaaagagaguuugccccaagugguuggaucuuuggauauacucuuucuucauugcuggauaggaggucugagacuguccguagaaccaaguuacccauaucuguaaaaggcaaaaacugucugccucgucagcaauugugcugacaaggggauuugugggauuccugugaaauaguacaugcuuuuaaaaacacaaguacuauauaagugccucauuguuagcuaugaguuuauuuauaauacuaugaagacaaugauuauaucuacuaaaugccuccaguuuggccagacaccauuagacauuuuaugggcauuaucuuaauuaauucagccagauaacgcugaagcuaggccuuuaaaggcaccaaaaucuuucuacuaacugcugagacuaauguugcuacucuaggacaaauaaaccuaaauuuuauaaaaucucuauguuauuuuauaaauuggauauaacuguacuaagaucaguuuguuagacccauuguuucuuucuuugacugacaugccuuuuuuuuuuuuuccaacuuuuauuuuaaguucagggguaaauguucauguuacauggguaaauguguuccguggugguuugcugcacagaucaucccaccacccaggaauuaaauccagcauccacuagcuauucuuccugaucuucucccuccucccaccccugguccucugacaggccccaguguguguugcuccccuccuccccuccaugugucccuguguuuucaucauuuagcucucacuuauaaaugagaacaugcggguauuugauuuucuauuccugcguuaguuugcuaaggauaauggccuccagcuccauccauguuucugcaauggacaugaucuuguuccuuuuuauggcugcauaguauuccaugguguauauguacauuuucuuuauccagucuauaauugaugggcauuuagguugauucuaugucuuugcuauugugaauaguguugcaaugaacauacaggugcauaugucuuuauaauagaacaguuuauauuccuuugaguauauacccaguaaugggauugcugggucaaacgguauuucugccucuaggucuuugaggaaucaccacacugucuuccacaaugguugaacuaauuuacauucccaccaacaguguaaaagcauuccuauuucucugcaaccucaccagcaucuguuguuuuuugacuuuuuaauaauagccauucugacuggugugagaugguaucacauugugguuuugauuugcauuucucuaaugaucagugaugcugagcuuuauuucauauguuuuuuggccacauguauuagauccauuauuucugaugguacuuuuauaacuucacugcuauacaagagguuuuaggccaggugcgguggcucaugccuguaaucccagcaccuugggaggccgaggugggcagauuaucugaagucaggaguuugagaccaguuuggccaacauggugaaaccccaucucuacuaaaaauacaaaaauuagccgggugugguggcacaugccuguaaucccagcuacucaggagacugaggcaggagaauuguuucaacccacgagguggagguugcagugagcugagauugugccacugcacuccagccugggugacagagcaagacucugucucaaaaaaaaaaaaaaaaaagaagagguuucagcuagaagucuaauugauuauaggugacuuuggagggagcaauuucaauagagcaguaaagcugaaaaccagauagcaaaaagguacuuacuaagugggaacagggaaaacagcuuucuguagagaugaggaagaaagauggagccucagaauaucacugagaguucagcucaagaaacagaaaccagcuuagggauguuuuuuaaaggaguucgauucaaggaaguagcuauuuacgaacuuaaguuucuuaaguguugcagggccuuaagucaggaguugccacuggagcuauugauuucaagaguaccuucccauaccuagaauccugaaguugcugcugccuccacugcuacuaccauggcagugacuuaggcauugagucugccacaacucaaacacuugugucuccuaccuugucugccuguagcaacauuagcaagaagguagcuucugcuuuguccugucuuccaaaucucauuuaggacuuccacaucgcaagaauucuagccaaaaaugugucuggggaauguaguuuuuagauuucuaauuuccaucuagaaggaggauagaauaaagaguugagagagucacucuguagaaucgaucacaucugauuucuguugcuuauuguaagccauuuguaaggcaauuauuaagaaagaggagaggcugggcacgguggcucacgccuguaaucccagcacuuugggaggccgaggcgggcagauccugagguuaggagaucaagaccauccuggcuaacacggugaaaccucgucucuacuaaaaauacaaaaaaaaauuagcugggugugguggcgggcgccuguaguccuagcugcucaggaggcugaggcaggagaauggugugaaccugggaggcggagcuugcagugagccgcgaucacgccacugcacuccagccugggcgacagagcuagacucugucucaaaaaaaacaaaaaacaaaaaaagagaauugcugagccaagggaaauacuguguguuuucaugcuugagguaggaaagagcuuggugccuuugaaaaguuggaagggguugaugugacuaguuugaaaaguuggaagggguugaugugacuaguucauuucaggugggguuggagaguuaagcaggagccagagcaugcaggacuauagguuauguugagaaguuuuucuuuaagagacagggucuugcuguguuggccacgaugaucuugaacaccuggccucaaaugauccuuccaccuuagccucccaaagugcugggguuauagggaugagccaccacacccagcccaagaauuuugcauuuucucuuaaugaaagcaucagagauucuucggcaggaaagugguaugauucaacuuauguuuuuuuaaagcuuauucuaacugcuuuuuggacaauauguuuacuaggaguagagguaucuaggaaaccagauagaccagcaaguauaaaaucuaaaagcccaauauucuaggcaggagaauauggugcuagaguggauauagaagccgacugauacaggguauauauuaguaguuguauugacaggauuugccaagaauuggauguuagaagugccaagagugggucccagcuauuucauuauuuuauuccuuugaggaaguuucugagcauugaauuguaggauucuuuaaaauaguaaagcaagacuggauaguaauuauguuauagggauggaguagaauguggaacgauucuuuugcggggagauauuaagaaugccucucuugcuuucagguccaggguguuaaaauaaaagaaugccucuuaaauuuuuuaguaguaaugugaguauacauuaaagguuaaaugucuuaaaauguauuuagaaaaaaagaaauaggaaaauauuuaccaaaaaacccaauccucuaugcuaauguuuauguucuuaaauuuuaguuguauaugugaaucuuuguaguuuuugcuaaaauacuaaguaauuuauauaaaagugaguuaagagauuuuucugacucuucuuuuuuaguugagcucauccuucugaagaaugcccaauucuuuuaaaaaagaaccaagagaucauaauuuuuacuuuuaaaaguaacaccugugucaaauaagacuucauuuucacuucagccaguuccuauuguuggcugaaacagcaaacagaucaguaagaggcaauaguuacgaugccauguggucuauugaaaccuaaugaaaaagacaggauugaauuaucuaaauauuucaccugaaauaacauuuaauugugacccucuucagguucuauaaauuuacauuacagcuauuuuuuaucuaaugaaaagugagaugugaagccugucagaguccacaagccugauguuuuagugauuccucauauacaaacaauuuauguauuuuccagugccaauaaguguauuuacugugaaccugcagguggcucacucaaugagauuaguauuauauaaauaaguaguugaguuuaauuuugcaauuacucuuucuaaagccuaugcauagguucuagaaggauccuuagacuuagcagaaaguagccucugggucucucccuggcuuccuuuucuacuuccaauuccuuccccaucuuucauuaucucauuuuaguuugaauucaucugacauugcuuaucucccaggaauauaaaacugcauaacuguauuaguacaaaguugcauacuacugggaaaagcuguuugaugggucaguuuugguaagauauuuuugaagugccggaggagucaagagagcacuuagcaugugcuguuuaguauuacaagacuuguugcagaagaauacuaguaauggauagaaaugaaaauauuugcuguuuuaguuauagugguccccucacuggcauuugauauuaaguuuuauuacccucauugccugugaaaggaggacaaugauuguaacauuguuucacagcuguuuuaggguuacuaggacuugagcuauacuagcuccucuuuuaauguuuauccauauauguauaucacugcuaacauaguuauccuguaguccagagaauauuuuuuuccuuguacuuagauuuuccuggaauuagacuagugaccucgugauaaaccaccauaugcuacucauuacagucaugcacugcauaacaauauuuccaucaacaccugacugcauauaggaugcugaucccauaagauuauaauggagcugaaaaauugcuguugugagauagucacacaaugcauuacucacguguuuguggugauguuggcauaaauaaaccuacugugcugccacuuguauuaaaguauacuacauaaaauuauguauaguacauaauacuugauaaugauaauaaaugacuauguuacugguuuacauauuuacuauacuuuuuaucguuguuuuagaguauacuuuuucuacuuauuagaaaaaaaguuaacuguaaaagagccugaggcagguccuucaggagguauuccagaacaaggcauuuuaucagaggagaugacagcucuauguguguuauugucccuaaagaccuuccagugggacaagauauggagguggaagacagugauuuugaugauucugacccugcauaagccuaggcuaaugcauguguuugugucuuccuuuuuaacagaaagguuucaaaagaaaaaaaacuuaaaaaauagaaaaagcuuauagaauaaugauguaaagaaagaaaagauuuuuguacagcuguacaauguguuuguguuuuaagcuguguuauuacaaaagagucaaaaaaaguuaaaaaauacuuagaaguuuauaaagugaaauaguuacaguaagcuaagguuaauuuacuauugaagaaauaaaaauauuuuuauaaauuuaguguagcccaaguguacaguguuuuauaaagucugcaguaguauacaguaauguccuaggcccucacacucacucaccacucacucacggacucaccuagagcaacugcuaguccuacaagcuccauucaugguaagugcccucuauaggucuacaucauuuuuuaccauauuuuuacuguaccuuuucuguuuagauauguguagauacacaaauauuuaucauuguguuacaguugccuacaauauucaguauagcaacaugcuauacaaguuuauagccuaguagcaaauuauauagccuagauguguaguaggcuauaucaucuagguuuguguaaguacacucuaugauguucacacaaugaggaaaucaccuaaugaugcauuucuuagacuauaucucuguuguuaagcaaugcaugacuguaucugaauauauucuacaguugaucuuuuucuguaauuaguaaauuucauaaaucuuuuucuaguuuaauuuguuucuuaaauagaagggcauuuucaauucuuacauaucucuucuguguuguggagaacugaaacugaguggcuuuauuauggaaguaaguuauucuuuguccagacauauuuuaucaaucugauagaccuauucaauaaacagugacauucuuuacaauaacacagccauagaauaauuaaauaaauauucccuucuuuauuuucaguauuuugccaaucacuauucuauauuuggugcauuuuuuugauaucuuagauuuagaagucauucuauaagucagaauucuuccucccacagcaggauuaccugagcagaauuuuuaguacuuaugaugagcuguaacauagccaagaauuugacuugaugggacucagcaugcaagguuuuaggggaggaugaauaugccuggaauuuuguggaauuugaaagacugcugacccuccaaguacaaauaaguaucgcucuuuaaugagucugauuuucucagcauaaccuguuauuuauaaauacugcaauaacuuuuuaagaauuauuuaugguauuagaugaaauuauauguugguacuuuguguugcuuuuaugaucucauaauugcuucugcuccuugaagggaggggaacuaugcgugguaguauggucuucaccagaguuuaagcagcaagaggaauguaaaucuguuagaaaaaauuagggacaauccaucaggaaauggaggggggaagugcuguuauuauuucacucucacuuuuaguauuuuuuaauauuuuuguauuuuuuaguauuucaauauuuuuuacuuuauaagcauaugugauauuuuauacuaaucaaaacuaaaauuaauuuaucaauaccuuuuuuaaagaggaucuaacaugaaagccuagauuuuaagagcagauaugaagaaaauaccuauuguuuuauaucuuuaaguuucauuguuaucauuuaccuaaauaaaacauuuuauaucaguaaaaauacuucauguuuucugagguuuauuaauggauaauaauaggucauaauuagcuuaugaucuaaucuaaacuuauaccuuuauucuaaaacuaugacgauuacaacucuuaagagauguuauauauuuauuuaaagauaauauaauauuugguuagauuaucuuugauauuugucaaaacauaccuuucugucucuuuaagaauugucuuaaucuccuuaagacagauucuauuuuauccuugucuuacaaauaagaacauuaaagcaggcauagagagguuaaauaaugugguguggucacacaacuguuaaguggcagaggcaaaauucaaauccagagagccuuuuuccacagcccccacccuuauuugcuacuccauccugacacucugaauagaaguacugucauuuuauaucagucaacaaauauuuaccaaacauuuacuguguguucauuaguaagauacagaauauaagggaaguuuuauauuguguucagggauugaaaucuaaugggaucuuacuaaaauaggcucacaaaacaacuauauaaauugcaagucaagaaggccuauauuggaaguguaaacuacuguaggaacauugaagaagcaaggauuacucugauugggaaggcuuaauuugcuuuuauagaggaaacaguguuuucacugggauguguaagcuuucaaggcaggugugagugagguagauuuaggcaagaauggggaggaccuugaaugccacacuggggaguuuagacauuuggccauaggcaauuaugagccuucaaagauuuuuugagcaaguaaauaacaugaucguauuggcauuuagguacaaaauuauagcagcaugaaaaaugaacuaaagaugguuuguuguguuggagaaauagagaaugucaguaagaugaagugucaugaagauggcagaagaccauaugugcccaucauccccuugcuuaccaaguccuuacaggaauuuacaggagauacuguuucacuguguguuguuuuaaagaguaaaucuccagugaugcuggaaaacaaggaagaguacacacauacacauacacacacacacacacacacacacacacacacguauguuuuuguuuuuguggguuuguuuuuuuuuuguuuuuuuuuaguuuuguuacaggccauaaacuucaaaagacucaaagcagauaggauuguaucguugaggaaaaccaacacucuaaaacgugcaggagagaacugcuccagaagggguagggguacugggugggcugcacaucagacauauggaugcaaggcugaggaagggcauggggccuuaagcagggugguuaguuggagggcugcaugaagagcagcagaguaaaucagcgccuucacauuugcuugcuuacauugagcagaaggcaguugauacuuuuagccacagccuaaggcacugaauguggggcuugagcuaaagaggcagagcaaugggaaggcagcuaauaacacucaggaaaaaugguagcacccccuucugaaaggaaggcaaccagaauaccucaucuagcagcaugucccuggcaucuaugacaagcaaauagagaacucauaaaaaaaaagaaaaaaaaaaaaacagccaggaauuaccaaccauuuuuguuguuguuguuguuuuugagauggaaucucgcucuuucacccaggcuggagugcaguggcgugaucucggcucacugcaaccuccgcaccgccggguucaagccauucuucugccucagccccccaaguagcugagacuacaggugcgugccaccaugcccugcuaauuuuuguauuuuuaguagaaacaggguuucaccauguugaucaggcuggucucuaacuccugaccucaggugauccacccgccucggccucccaaagugcugggauuacaggcaugauccaccgcgcuaggccaacacacaugaaccucuucagauuucaagugcugugcauguagcagacacuuauaugaaaguaaucuuuuaaugaauguagugcaaguuaaauaaaauuuucuuuuuuugagacaggguccuacucugucugacaacccaggcuggagugcaguggugucauuuuggcucacugcagccucgaccucacaggcucaagccauccucccacacagccucccaaguagcugggacuacaggcgugcaccacuacaccuggcuaauuuuuguauuuuuuguagcaacggggucucucuguguugccaaggcugcucucaaacuccucccaaagugccgauuauagguaugagccuggccaucaaacaaaauuugauagagaauagguucuaauaaaacaguuuacuggaacugaguaauuuaaaaguguuuuuuucccugaccggaaauaagaaaaagaacguuaguacucacuuuucacaauuucauaaauuacaucuuaugucacaaaaugacagcuucccacuauauaagcagaguaaggcuucugcuuguuuucugagauggagucugaucugucguccaggcuggagugcaaugcacagucucggcucacugcaaccuccaucucccagguucaggugauucuccugccugagccuccuaaauaucugguauuacaggcacgcaccaccaugcccagcuaauuuuuguagagacaggguuucaccauguugagacagggcuucaccauguuagccaggcuggucucgaacuccugaccacaaaugauucacucaccucuaccucugaaaguguugggauuacaggugugggccaccacgcgcagcugaguagguuuuuaauauuggauacuuacuugcuagaaaaauuacggagaacagaaugaaaguaauaaauaugaaauaaaauauaaagacauccuuauuuucuacuuuaucaaaauguuuuuccuaaacauaauacauuuauagcugacauuugauggaacccuggcaaauaaaacuuaaguaauuaaauaaaugcaugucuuuaaaacauccuuaagugauggaaccacaaaugugagugcugcucagaaucuuugcacccuaagcuacaccugucaugauucuuucugauuuccacuuucauagaggugacccacuuacgaccuuggccucucaaucuguuguucuucuuucuucuaacauucuugcccucagacuaaccuuauccaugguuaugccuuaaaacugaucauuaucaaucacuauagcccccucuccucccacccacaguaaucucagucucgaguaucuuuuaacuuuccagcucucuucuucuaacauacagaucucaauaauuaucccauaccacuaggagcucaaauucauugauccaccuuuucauugucaauuaccucuuuauccccuagguccucucuuccugucuuucucaauuuaaauuuuuuuguacaucauuaucauucccuugccucucucuaacccucauuaaauucagggcuauuugugaccauauuuuuucucuuaaagaugaacuaccauuaaguugauacagcuaacauuuuuuuaaaagcuuuugaaaucaauagcaucaaauugguucauuuuaaaucaaaguuguuaagaucucuacugucuuuauaaaauacaagucuuucacaguaaugaacuagcuucacauuuugugugauucccauaaucuauugauaaaaagaaaugcaauuauuauuuuuccccgauguagaugaaagcagacuuuacauugggccacagaaaaacccuuauaagcacugucuauauauaacauguauuucauaaauaaguuagcguuucauauagcuaguguuuuucuuauuuauaccauaugacuaacauuaaucuauaugugaauguauguuuaauaggaaauugcccggcauuuacgcccuggaacucucagagcaaucuuugguaaaacuaagauccagaaugcuguucacuguacugaucugccagaggauggccuauuagagguaagauaaagaagguaaacauccuauuuauauuucaagcucauaaauuaucucaggaguucugauguguaagaaaacuuuuuguuuuauuguuauacuucaaguucuagguuacaugugcagagagugcaguuuuguuacauagguauacacgugcccuggugguuuguugcacccaucaacccaucaccuacauuagguauuucuccuaauguuaucccuccccuaucccccccacccccugacaaguccugguaugugauguuccccuuggaugacucuguuacuuggccaucugaugauuuuggacugcaacuuugaaagaccaaauuguagcaugcugcauagcuuucaaagaauuuagauauuuuuuucugguuggcauacauuuugauuuuaaaauaauuaaauucugugaaauuuguuuuuauaucaggugacuauaccaucaccauaaauugcuagucaugaaaauacauacaguugacccuugaacaauguuugaacugugcugguccacuuauauauucauuuguucaauaaauauauuagaaaguuuggagauuugugacaauuugaaaaaacucuugggugaacuuuguagccuagaaauaucaaaaaaauagaaaaaaauguguauuaugagugcauaacauauauauagauacuagucuauuuauguguuaaucgacuuuuuguuaucgaugaagcucccggucaacagcauuaguaguuaagcuuuuggggaaucaaaaguuauauguagauuuuuccacugugcaggggauagguaccccauaccuccacacuguuuaagggucaacuguuuuccaaugaaauuaagaagucuagccaggcucaguggcaugcaccuggagucccagcaacuugggaggcuuaagugggaggauugcuugaagccaggaguucaaggccacaguaugcuaugauugcauuugugaauagccccugaacuccacccuggacaucauagcgagacuuugccuccaaaaaaggcggggaaggagucuaauauacagugugauaguguuacccauggcaaauucauaugggucugcagcaaccucaguaucugccucuucagaagaaagaauucaacugaggaagcauaaggcagaaggagagacugaggcaaguuuuagagcaggagugaaaguuuacuuaaaagcuuuagagcaggaacaaaagaaaggaaaguacacuuggaagagggccaagcaggugacuugaaagacaaguguauggcuugaccuuuugacuugagguuuuuauaugauggcauaccuccagggucuugcacuacuucugaccacuugcccaacuccugagaucuuauugagaagccgcucgucaccaguuuuagguguuuucuaucuacuaggagaccgccguucccuggcgccagcugugaccaauuauuacuucagagagacaguuaacaaccaccugaccaucaccugauggucucccaacacuccuggugugagguaugggagcccuuuccugcccugcucauacccgacuagcuaccaaguauaacaauagcacucaaagugauagcuaacauuuuggucaccuuuauuaaccagauucuaccaugacacauguguuguauaaaugauuucuuuucauugccauagcaacuccaauaggcugguauucauuauaucuguuuuuuuaggaaacugaaauugagacucagagagguuaaguaacauccccaaaccagacagcuaauaugaaacaaagccauauuugaucucucaucuuuuaaauuaacauaaaauaugaaaugaaaaauucugagaaaauauaagugaaaauggguccaguuuaggguuaagaaaguuauuucuaggccaaaauccaagaaggaaacuguaaauaaauauuuuauuuuuuuaacuucuuauagauuuuaaaauuuuugugucaaaauaagcuaaaugaaauuuaaaaagaaauaauaaauuuaagugauuaaaugaagaaaaaugguugauauccuuaauacacauuuauuuuaaugaguauuauguuuuaugugaucaaaucuauuagucuuuuaaaaaaaaauuauguccuggaaguuguacauagaaaagccuuccccaaauauuuuguuuucauuuucauacauugaaauguucaauccaccuggaauuuauuagacauauagugugagguauggauuuagccagcuaucacaauauuauuaauaauaaacaauuuauuuuauuuaaauggcuaaauccauccauccuuucauuguucuuucucauuuauugaauacuuauauacauccuugccuguuucugaacuuccuauuuuauuccauugaucuguaccagcaaaauacuguuuuuauuauuguagguuauuuauacuuuacaaaaguguucuugguuagucccuaaaauguauuccuccaaaugaacuuuuuauuuauuuauugagagggagucucacucugucgcccaggcuguagugcaguggcacaaucucggcucacugcaaccuccgccuccugaguucaagcauuucuccagccucagccuccugcauagcugggauuacaggugcaugccaccaugcccagcuaauuuuuuguauuucuaguagagaugaaguuucaccauguuggccaggcugucuccugaccucaggugauccacccaccucagccucgaaaaguucugggauuacaggcaugagccaccacgccuggccaaccuccgaaugaacuuuaaaugacuuuuuaccgaggucuuuacuccaccccuacaaaaugcaagugggacuuucagugacauuacaauauguuuauaaauuauauggaaaugucauaucuguaauagugaguuucuccaacuucauaugugguaugccucuccuuuuaugcaagcaguagagucacuuuuuuucauauaguucuuaguaauagucuauuaaauuuaucaccauaaguuucuuuguuguuguuauagaaaaugacuuuguuagcuccauuaagauuuucuguuauaauccaagauauuuguaaaaccuuaucuauuaugcaucuuuguaugaaauuuagacauacuugugaaauguaaaaauguaccaagcuuuauuuuuuaauaaccaaaaagauuaaauguuuauuuuaaauuuuaacuuauuuuauaaauaaauauuuccucacuuucugauagcuuggaccuaucaacuagguuugaauagagacuuuuauuuaaugagacugaaauguuauuaaccaugaaauuuauacccauuaaaaauauuauccaagagggccugaggggaaaaaaaggaaaaaguauuaucuaagguaugccuaugauuuuguucauauuguuugaaauagauuauuacugccuguaguuugcaaagccauuuacuaaaugauugcaauuuuucugaucuaacuucacuggagauuucaguguacauuaaugacugugugguuuagagaauuaaucaaaaaucagaaguuagagcaucaguagcuuccucuuauauggcugauuauuuucuugauaugaacuugaauaagucacauuuucuuuccaugccucacuucuuuuaucaauaaaaugaaauaaagagugcugagauagucaaggaugcccuuaucaauuagcuacuuucagauuauuauuuggcuucagaugauaaaauauuaugaaaauacauaaaggccaaaugagguaucuggcuauaggucuucaaagugaaaauccgagugacacaagacaaguugucugaucagugagcacuuuguuccuaggaucagcucuucauuagggggacauccuuuagaugcagagugaccauaaaauuuauugcccaauuaaacacccuuugaaaggcagcucuaaucagaaaagauguucggacaagaggcauaaaccagaacugucacacgcaaacuagaauauauuguuauccuauuuauauggcaagaagagaaagaggggaacaugcuacuucucuuuaaucuuucccuaaugugauguuuacugagcuaugugucauggguauagagcucagaaaguauggcuucaguuuauauuuugucauuauccauuauuuuauuuauuuauuuauuuauuuauuuauuuuuauagcaaacaauuauagaacauguuuuacuugcuggauugugauaggaucaaacaauucauuucuacuguucuccuagaacucauaguaaguuugagaggucaaagaucuuagcaugaauacagaaauuuguuuucuuugaauauugcuaauugugacccagucaauuuugugauuauaggaauaaauuaugguauuuaugagacauucuagaauguucugucacuguuaauguucucuuauacucugcugguuguaacuacaaugaucuuaaauuuguguguuaaagauagcauugaugguaaaauguucagcugaguaaucaaauacuaguuuucuauuaauggcaaagaacuuuugaaguaauaaugcccacugcuggcaaugcuacaguaaaguagauacccucauauagcuggugacaacuaugggcaaaacauauugaaagccuuggaauauuucuauaacuuuugucccagaauucuacuucuuaggaucuaagcaaaggaagagaguggcagcaggacuacaaaauggaaaguuaucugcacagauguucauggaaggaguauuugugaucauuaacaauggaaauaauacgcauguuuacagauacaucccaccuuaccuccucuaagaaaccuuccauggcacccauagucugcaucaguccguauguguguuuucauagcacuuugccuuccuauacuauagugguguagccaagucaaaauagcucuguacuccugggcaaguuacucaucucacuaugcguagguuuccucacucuguaaaacgaagauaacaguaccugcccuaucaaauaucauugugccuagcaaauaguaauugcucaacaaaugauaguaguuauuauuauuauuacuauuacagcacagugucuguuugcucaugugagacugugaguacacauaguagggaagagauuuuuucuugccuggcauauaaaagcucuucaauaagugauuuuugaaagaaaggaaggaagaguuuaguuaaauaaauuguauuuuuugcacucggugaaaaaguaugucacacuuuauagagaagacucuauaacaguguuuccuagccuugguugcacaucagaaucaccuagccaguuuucuaaauacugacguccagacucacccccagagauucuaauuuuuuuuuuuuuuuuuugagacagagucucgcucuguugcccaggcuggagugcaguggugcagucucgacucacugcaaccucugcuucccggguucaagcuauucuccugccucagccucccgaguagcugggacuacaggugcaugccaccacgcccagcuaauuuuuuguauuuuuaguagagacaggguuuugccauguuagccaggauggucuugaucgccugaccuugugaucugcccgccuuggcuucccaaagugcugggauuacagauguaagcuaccacgccuggccaagauucuaauuuuuuuaaacaacuuuaaacuuuuagaaaaguugcagguacaguacaauaaauuuuuuaugaacauuugagaguaagucaucaacauuaugugcauacuucugaauccuuuaguguguauuuuuaacauaaaagggcauuuuuuuuuacauaaucacauuacaagcauccaaauaaggaaaucaacauucauuuauuacuaccaucuaauccuuagacuccacucagauuucaccaauugucucaauaagguucuuugcuagcaaaaggauccaggucaggaccaugcauugcauuuaguuuucuccuuagucucuuucaaucuggaucaguuucugaauuuuuccuugacuuucaugaccuuaacaccuuuaaagauaacaaguagagauucuaauuuaauugauccauuuaucccuuugcucaucagaaauuuuucuagauggcuuccaccuacaguucuaacaagauacuggcaaauuuauuuugcuguauggcauacguuacucauacgagaugucauuuguuggcucccccuugucuaugaaaaugaaugaugccuuugugauguuaugacucaaccucguguacgccuccccucuucuccacuucaguguuaguugucaucucaugucaccagugauacuugugagaggcaguuuuacuuucuccuugcuuccuucaucuuuccccaggauucguugaaaaacaucuuugggaaucauuguuauguggggaaaauaauaucuacuucuuugccuuucacuuuaccuuuaaacauguggucuuuuccaaggaccuucuuuuucugauuuucucuuacgggaacaaccaaaacuuugcauguacuaaaauugagaaccucaauguugcugaauggguauaugguagaaaauucaaguauguucaaauuuuaauucuguauaccaaaaugauaggucaaucauucauuuagguacuuuuauuauuauuauuauuuugagacaaggucucacccugucuccugggcuggauugcaaugucgugaucauggcucacugcagcuuucaccuccugggcucaagcaauccuccugccucagccuccugagaggcuaggacuauaggcugugugaccaugcccaaauaauuuuuuuuuuguaaagauggggucucaucguguugcccaggcuggucuugaacuccuggauuugagcaauucuccagccuuagccucccaccguuuugggauuauaggugagagucaccaugccuggccuguauuuauauuuuuuaaacauuaaaacacuucacugagaacacagcaguaaacagaauacauguggcucuuaucuucacagagcuuaccuuucaggagacaguuauguauagcaaauauuuuauaggaugaugaaaacauaggucuuuccuguuuuuuuuuuucuaaauguucuguaacuuggugauaccacuuuugugauuauaaaauuuuaagaagcauauaaaauauuuaauuguauguauaaguuuaauugcccaacggguucuuccugcccccugcacagagaaaaucaguucaccaagacugugguauugaaguuaccauuuuaauugacaagaggccgcccacauaagagauggaauuauuacucaaaucagucuccccaaaggaucaaagguuaagguuuuuauggacaauuuggugggcaagggcuaggaaguguguacugcugacugacuggggaugaaaucauagagauguagaaaacgguccucuugugcugagucuaccucuggguggggccacaggaucaguugagucauaagucagggucaaggugagguccaucgguugccggaaugcauaucuaaaaaaaacaucucaaaagaccaaucuuagguuuuacgauagugauguuaccuaugggaucaauuggggagaucacaaaucuugugaccucuggaccacaugaccccugagcaguaaagcauuauagaaccuaggucuacauuuuagcagcauucaggccccucccauaauauuaauauuguggcuuuucauuaguuuuacaaagacaguuuucaguucccuagccaggaagggguuaguucuuguuuucagguuaaacuauagacuaaguuccucucauggugagcuuggcugacacccaggaaugagugaagacagccagucugugaggccagaagcaagauggagucagcuaugcuagacuccucucacugucauaaucuuugcaaagucaguuucauaaguaguugaucaaaucugaauuuggauacauaauuacuucugcauggauucuuauucugguacacucugggggaaaaaauagugaaucaaggauuaaucagaaauaaacauaggugcauggugacuaagaugauuggacaggccccaauuucuuggccgugauuaacgcaggccucugcacauacugacacucauaauuuaucuuuaguuuuagcuucuaucuugaaagaagaagaguugugauuuuuaguaguacauugucaaagagggaacaacuuguacaaauacaaaagcaaacagcuuucucuuagagaucuaaaaauagugcaguaagacuggggcuuugaccaggagguagaaaauggcaagagauaaagcuggaaacaucagcaggggccucguaaagucauauuaagacaacugaacuucaucuugaggccauuagggauccaaauaaauguuuuacucaggggaauagcacaaugauaccuguguuauagaggucacucuggcugcaguauagagaacagaugaaagggcccuggggucaggcagggaaacaaguggguggagucuagggggacagagacuagguagaagucuauuaaguaauucaggagaaaauucugguuuccugaauugcuauggcagaagggauagccagaagcagugagcuucaaaagacauuuagugggguagaacagaaagccucagagacuaauuggaugugaaagguagccugugggaaugaauccagauuaaugccuauccccaagcaaacgugauaguaccaucuuuaucuguguuaccaaaaucuaauaaucuaaaaaugucugaaaaccaaaguuuuuucauaaguuuaaugguaaaaccuaaccugucuuauaucaaguuguguaucauuaaacaguuuuguuucaguagcuugacaaaacauuuaauguauaucauuuuuauuuaaccuauuuagugugacucuucacacugcuguaaaaauauuaauguauuugaugaugagugacuucccagaccccuuggaguauuauauaauauauacuauauauuccagauuauuauuguaaauuccaaaacaucuaguaccaggagucuugaauaagagauaguagacaaaguuugaaguggccauggagaaagugcugaugacagaauauauauuuauggguuguauuuacaauucaguugauuuaggagauuacauguauuaugguguuauuauuuucuggugaacaguuuggcccaggggugagguuuuuacaggaggguacgaugaggaaagauaauugaggauguuagcaacuauaguugaaguuauaaacaaggaaagaugugauggcaggaggugcuugaagaaagggauaaaguagaugggccaagggaccgaaugcuuuucuaagguaccuacagagaccccaggaauaacagggaaagagcugugucacuguacacuucagaaguggagcuuuccaugguaauggaugauaugauucaggguguggccauggaaggagguagccaguguggaguggagaucaguaucagucacuagagauauguaagucuaggaacugagagaagcuuucauguugaguggcauugaaaucaccuaggaucaugguuaggagguaggguggagaagaaaauggugacucaaauucugaagucuuucacaaacuagggaaguuugugaaccaaaggugugacagcaacaaggagaaaagaucuagccagauggcauaagccucaaaaagucaggaguucauauauaaggggaggaggucuuaaaguagcacugggacaaaggauagaacuacuccuacccuccuggccagagauucuuauccugcggacuccaaggaauugaugcccuuaggggauauccaaguuucauuuaaggcuaagaggccuaugaagagauucaaguuucaagggaguuuacaauggcacugaaguucugcagaaagcaauaggaauaguuagagauuggggaagggaagaagaaucucagagccaugugagaauagcaggaucggagaaaagaggugaauauaauggccuccauguugguggguuggggugugacaaauuaauaauuaauuuucuggucacuaguaaauagagaccuuaaaaucaucuuuaaaaaugagaacuuuuauuuuuccgccccauaauuugagaucugaagguaggcaugugggacugguauggcaacuccguaauaccaucagucacccagucuccuccuccuugguaccgucaucaucuuuaguaugugcuuuuugccuuguugccacagaaugguugucagaacucgaguuaucacuucuuuuuuccaggcauaaagaaagaagagugagggcaaaaggcgaagaaugccagcugagcuaacacuuccucccucgcccaccuuuaagcuuuuccaaaaaccagagcccucacccaacagcuucagguuaugauuuuuguuguugcugggauuuaguacuguggccgccccuuuuuagaaaggaagugaguaaauguaguucuguuacuugggaacauugcucccacuagcaaaaaucaagauacuguuagaaggaagaaagggagaaugaauguuggaaagguaaaaagcaguaucuucuccagguggucaagaggcauuuagcuaguaaacaggcuuccaauggaacuggcccuagcuaaucccuagugcagugguucuuauguguccuccccugcuccagaacagcugcaucaccugagaacuuaggggaaaugaaauucucgggguccacuguaggccagcugcuuagcaacucggggauuugacccaggaaucugugcuuuaacaagcccuccaggugcuucugaugcccaugaaauuugagaacuaccguccuagugcagcgguucccaaucaauggcaugcauuaaaaucaccuauagaguuuuuuuuaacuauguaagccuagagcccuauuauagaagauucugguuaaggaggucugguaugagcuccuuauaucuauagaguagagccccguuauucaugguuucacuuuccacagcuucaguuacccauggucaaccauggcccaaaaauauaaaauggaaaauuccagaaauaaacaauuuauaaguuuuaaauuguaugguaccuuaaagagcaggguugcaaaaauuaaaaaauaaaaaguuuuaaauuguaugccguucugaguaguaugaggaaauauuacaguauauuguuauaauuaugcuauuuuauuguuaaucucuuacugugccuaauuuauaaauuaaacuuuaucucucauacauauggaaaaacguaguauagauagaguucgguacuauccacaguuucaggcauccacugggggaacuggaacauauuccccacuuauaagggggcacuacuguauuuuauguugcaggugauucugauauucugauauggcugauaguuaaacuagcauuuagaaaccacugucccagugaguaggggcacaccagacuuuuuuaaaacuuguaaaagaaccuaucaacauaguaaacagacaaccuaucgaaugggagaaaauuugggcaaacugugcaucucacaaaggucuaauauccagcacuuauacaaaacuuaaacaaauuuaccaaaaagauaaaaaaccuccaucaaaaaggacaugaacagacacuucucaaaagaagacauacaccagacuucuucgaagucggcuuugguucugcuuuugaggaaagccuagacccugugagaaggccagcaaagggauuguuuugcuuucaggacuuaacugacaguuggaagcagcagcagccucuuaacuuugaaaggaucaauagccucucuagauggauuuaauuguagccaaggguuguuacacuuccaacggaacuccagucucugaaugggggaaucuguggcuucuguggaaggagccagccaugaccugauugauuacccagauuuuuuggggggaagucucaaugugaaggcugccauuugcccucccagggaggaggagaggccugagauaugugguaugcauguauugcauggaugcugaggguaacaagggcagaggcccuggguuucuugcagcuuaaaauaguuaucugcagguucaucaaaucugcacucaccauuuggcauggucauguggcucagagguguacaggggaccaacucuugucauucucccuguggguuguguaagugccuugaggaccugggcuuauaagggacuuuuguaucuccagcugcuaacauauugcaggcuuuuagucuguugaguaaaugcaugugggaauauaucaugaauggggacagugcaccuccauacccucucucucuuuauguggcggaaaugucucaaugaccugaugagagugagccccacuuucaaguaccacaucucaccauucccuccaccugccaguugccagaaaaguccacugcagcaucccaaaaaugugaacaauuauuauguaucaauuaaaaaggccacguccaccagcaucuucuuucauugcuguuuauucaaguaaaaccugaaauaugugcauguggaaagcgaaugguuugcauggauucuuuucuuccuucucaaaccugauauuucagaagucucuacauucaucguaaaaacaucaugauaauauaagaggccuuaagcuaucaaauuguaauucuuuauggcccaguuaguauuucaucagcauugguuguuuucucagauaaaagaaucuuggauaaggagcaauuucacauucccuccuauaucccgucauaguggggcauaaguucauugcuagauucaaagggaguuacagguucauaggucuuucuguuucucaaguacagugccagcuccaccuuucuucagauaggcugccuucugaaucugaaaaguaacaagcuuaaugacuuaagaacuguauuuaauauaauuuaucccacuuuauauaggcacuuauaaaaucauuugccgaagacucuaggauuauuuuagauuaauuuauuuuguauaaauugguuaauuaauaacuauggaaaauccauauaaaauaaauagacacaaucauuggacuaaaagugaccuuacagggggcauuuaagaaucuccaggcauuuugucucagcacuuuuugcaucuucucuaccuauucccugggaaaugguucucaaacaguagcacaauuccuggauggcuuuuuaauuuuuuuuuuaauuuuuuugagacagagucucacucugucacccaggcuggaauguaguggcaugaucacagcucacugcaaccucgaccucccaggcucaagugaucccuccucagccucccuagcagcuaggaccacaggcaugcaccgucaugccccacuaauuuuuuuuuguagagacagggucccccuguguugcccaggcugcucuagaacuccugggcucaagcaaucgucccaccuuggucucucaaaguguuggaaauuacaggugugagccaccaugccuggcugggcuuuuuaaaaauacggauugcugggcuguaccccccagugucuaguucaguagaccugagauagagccugagaauuugcauucuaacaaguucccaguuagugcugaugcuauugguuuagaguaccacacuuggagagccacuguucugagccaaaaaacacugugcacucuccauuaagucaaguuguucucuugauuaauuuuugucaagcuguugucagauuugacauuucacagaccuggaacauuucaaaaaaaaaaaaaaaacuaaacaguaauaaaacccacuucagggauagacacaaugauaaaguuuuuaaaauuuaacaaaugaagacauuagaaaaauuuguuucccaucaucaucguuuuguuuuaaaaggacauuuaaucaccaacagcauuuuaucacagaauaauggacugucucuucaacugaauaaauucagcuuuaccugaagcucacuuuauugcuauugcaugccaaaggcaugauggucgaagcaguccacuucaggcacaggcaaaacagcauugcaucuucuguagaucauuuuaaaacaauaauagaauccacuaauaguuugucugcuuuuuguuaucaccauaaacaggcaguuccaaacaacgucagugagaaaauacugccccuuccccaggguggacuacuccugccaacccuugcuucaucacugcuuuguugcccucauuuuucccauuuugccagaaagcagugaaaugucauccuagacccucaccaucuggugguugggagcaacugggcuaaguuacacaugcuuauggagucuuugauugauaauuuuauucaaacuugauauggaaaacauauaucacauuucauaggucaaagaggaauguaaacuaguugaguccugcgaguggugauuuuaucuauguuaaagaaaauugggacaggugcugugguaaucccagcacuuugggaggcugaggcagaaggauugcuugagccaaggaguucaagaccagccuggacaacacagcaagacccugucucuaucuuaaaaaaaaauuuuuuuaaauuauacaaauuuuaaaaacauauuuuaaaaauaaagaaaaaauccuuuauaauuauuuggagaaauagaguauucuuuaacacuuauacaugggcacaaauauuuuuaaaaauauuuauuuaacuaggacuaauggacaaagguagaaaauucugauuuuuuuuuuuuuuuuagacagagucuugcucugucgcccagacuggagugcacuggcuugaucucagcucacugcaaccuccacuucccggguucaagcgacucuucugccucagccuccugaguagcugggacugcaggugcacgccaccaugcccaucuaauuuucauguuuuuaguagagacgguguuuuaccauauuggccaggcuggucucgaacuccugaucugcucaccuuggccucccaaagugcugggauuacaggugugagccaccgugcuuggccucugauuuucaaauucaaaauaaaaagccagagauuuuuuuauaauauugaguucuucaauguaacaugaggaauuaaaaauuaauuuuaucuccuuaauccauggcuuaauuuuaaguuaacuaccacauguuauuuuauuuaaauuucauucauucauugauaugaauccgcagucauuucaccagguauuguuuugaagauacacauuucugcccagcacaguggcucacaccuguaaucccaacacuuucggaggcugaggugagagaaucacuugagcccaggaguuugagaccagccugggcaacauggcaagacccagucucuaaagaaauacaaaaauuagccagguguaguggcauguaccuguggucucagcuacuccaaaggcugaggcaggaagauugcuugagccugggaggucaaaguugccaugagcugugaucaugccacuguacuccagcuggaugacagagugagauucuguuucaaaaaauaaaaugugauuaucccuauuugacugggcacaauagcucacaccuguaauuccaacacuuugaaagaccaaggcaagaagaucacuugagcccaggaguucaagaccagucggggcaacagagggagaugucucuacaaaaaauaaaaaaaaaaaaaaaauuagccgagcaugguggcagguguuuaaagucucagcuagucaggaggcugaggugguaggaucucuugaggcugggagguucgagauugcagugagccaugaucacaucacuguacuccagcuugggugacagaacgaaacuuugucucaaagaaaaagaaaaguagaggguuuagauggaaaagauaaaaaaaaauguaaaauuaaauuguaauauaaaauuaaacaccagcauaagagaauguuaccagauaguguaugaugaaguguuagaaacaguaaguaugagaguucaauggagagcaguaugaguguggcugaagggggucaggaaaauuucaugaaauaaauuucaugaauuuaaugaaaugguauuugaagaauaaggcagauuuuuauacacacagaaaaagaacauggcaggcugguuuuaggagacauugaguuccucugguugaaguggaggguuccuuugguagaguaugggagauaaauuuggaaauguaaauuagagcuagauuguggagacuuuggaaagcuuucugauggcaauaaugaacauuaugguaacagugauaaaaauaauaacuuuaauuuacuaagcaauauauaccagguacuaugccaaauuguuuaccugcauuaccuaaaaacucuguugaauaguuucuauuaucuccauuuuauaugcuaagagagugaggcucccauaggugaaaugacuuggccaggaucaccccaccaaugaguggcagagagcugaaauuugaacccaaguuugucuaaguccaaaaccaguguuucuauacagcaaacuaggucaacgaugacaaaaguguuucaauucaagugccaguuuuugauuuauugauaaaacuacaaccaaauagaaaaaaaaaaucaccaugauggauuacugauguuugcuguaaaugcuggaugggaguuucuugguauguaugacacacaguggcuacuuaggcucuagaaaacuggaagccaucaaagguuuuugaacagggaagugacucgauaaagguuccaaaacuuuaaccaagcagcagaguuuaaggugaguagauaauaggaguaauggacgcguauacucugaucauccaguaacaagucuuaaggaccugguagucuaaaauaggaccauucagaaauuuucuucuccuucaagugaucuauuucuacuaucaagguguaauucuuugaagaguaucugucuccuccccuguccucuaugauccaugagaacagugaccuuguguguuuuguucauuccucaauucuccaguggguaggcauucaauauaguuuucuuaaauccaguaauaauaaaagcaaugaugaucauagaaagcacucacuuugugcccagacuggguuaaguacuuucaguacagcaaaugcauauggaaucagacuaccuggguuugaauucuagcucugccacuuacuagcuguccaagcaagcagguuaaacucuugugccugaauugccucaucuuuauggugggaauaauaauaguacuuaccucagagagcagcagcaagaaauagauuaggugauauagguaaaacaauaagaauaggaaguauucaauuaaauauugguuauuauuauuaucuuuuuaaauuauuaucuuuaccauucuauacuuaacuuguccauuagaaaauaaauauaguagagucaaaggaaaggcuauauauaacuucuauggcaggccuguuucgugucaggccuguuaggcucuuuuauaaaugauaucccagcuaaguuaaaacucuaauuucacugucagaacuuacuuaauuaucuuuuuaccaaauauaaaacccacacaaaucuggauuuucuuuucauuucaacugauuaugggcuuuaacaaaucugguuucaaauaauguauuuuuaaagauaaauuggaaauuuaucaugggagggcucccaugaggaugcaaggcaggcugaggaggcaggcuucagaucaggucauguaggggcaaugaacccgagggaggaggcagauggacagaggacauagacagagggagggggucugcagagggaaagagauacugaccgaggucuggaaugaccaucucuaccaagaggcccucugccucccacaggguguccagacacuggugcacacauucuuacccaagggccugggcuggcacagcccucaagaagguggcacccacucuggcagucagugggucuggccugguggaaggaucaucacaggcuucagggggcuggacagccugggggggacuagcggaggucaucucuuccagccuccugcccucaaccaaguccagcucugagcccugggucaccgagggccacccuggauucauuggaaucccuccaccuccaguaggucaaguucuguagaggucugaggaugguggucagcuggggagucaggagcgggugaagagggucacaguucuaccaaagccuuguccagucauccuccauccccucgaggccucuucccugaucucccacuccauccugccacuucacucauuucaucagcugccccugaagcacccgggacucaggacugguuuuaucuuccaaggccuuggugaagggcuggcccaggaucuacagccacaccucauacagcaccagcucugccuucccgccuagagcaaugaggguggagauggcaucagccugggcccccucuccuggaagcccuggggugggacucauacccaagcucuaaugcuccaauccagcagucaaccaauguuagucuaagggcccaucccuugcugccuguuuuugugcggcccaugagcuaagaauggcuuucacauguuuaaaugguugaaaaacaucaaaaguagaauaauauuuugugacacaugaaaaguaugugauaugcaaauuucaauguccauaaauaaaguuuuauaggaacauagcggggaaaaggcuuuuauucuuuuaguguagccuuuuauguuugaagagcaaauuauauugccuugcaagaaauucaaaggucaguacccaggugcuagccucuguaccuaucugaacuugcuccucuuuuuuuuuuuuuuuuccuuuuccagccucucuucucaucauauaaacccucuugucugucaccuggcaguacaauuaaacucauggaugauucccuuuuguagcugaaguuugagaggcaaaaguuagcugguuaauagaaaggaagugagaauacauguuuuuucuagacaaccaaaauaucccuuugccuacuguuuauuaaaaacaaauaaaaucaaaagcuuguuccaucaccacuaagcaaugcuugucucuauuuuguaggccuuuacuaugaugaucuucaguaauguuaauauauuaagugaguuuggccaauucuugaucuuuuaucauaauggagaaauuaagggguuagcaagggcccuugaaauccagagagauacuagcaacuauuuguccauuaaaugcaauguauuuacaauauaccuuaccuuuuuuauaacaaguauacagauagacuagcuugcccuuagacucuuaaauauauuuuucucagcugucuuauagagcacaaaaauauuuguuaugggcuuaauaugcacacacacacauacagacauacagaguaaauuagagacaauauauauacauauuguaaacuagagacagagucucauucugucacccaggcuagaguacaguggugcaaucauagcucaaugcagccuugaauuccugugcucaggcaguccuccacugucagccuccaaguagcugggacuacaggcaugcaccaccaugcccagcuaauaaaauaaguauuuuauaauugaauggaagugauuaagaaucaugaagggacccaaagucauaaacuagaaagauguuaaaagacuggcucauaucagaacuguauaauccgaauucaauaagucaguaucacaguaaucuccccuuauccacaguuuugcuuuccauuggucccaguuacucucaaucaacuguaguucaaaaauauuuaauggaauauuccagaaguaagcaauucguaaguuuuaaauuacacaccauucugaguagcaugaugcaaucucaugcuguucugcuuugacccuucaucaucacaagaaggaugaauacaguacuuaagauguuuuaagugaaagaccacauucacaacauaacuguaauuacagcauauuguuauaacuguucuauuguauuguuacuguuuuugaucccuuaacugugcauaauuuauaaauucaacuuuaucauagguauguuuguauaagaaaaaacauaguauauguaggguuugguacuauaugugguuucagguauccgcuggggguuugggauguauccccuagggauaagggggaaauacuguaauaaccaaauauaauccucuagcaguagagagaaauguguaacuaaaauauuaacuucucuuaguuaaauauuauuuauuuuauuuuuuuauuauuuuugagauggagucuuacucugucacccaggcuggagugcaguggcaggaucuuggcucacugcaaccuccgccucccagguucaagcaaaucuccugccuuggccucccgaguagcugggacuacagguaugcaccaccacacccggcuauuguuuguguuuuugguagagacaggauuucaccauguuagccaggcuggucucaaacuccugaccucaggucauccacccaccucggccucccaaaguaggauuacaggcgucagccacugcgcccugcaaguuaaauauuacuuaaaacuaacaaauagauaugcucacuagugcucuuauuucuaguaaucuugaaguugaaagaacuuccagaagagcauugguauagaauauauuguguguaugggcaucuugugaaagagaaaacugagaaaagaugccaaggacaauacauguauggguacauggcuuugauccacauaucaaguaagggagacaaagugcccuuuuuaaccugugacuuuugugucuacucaccuaagacagcugguauuguguucacauuaccaaccaccaacacuguccagucccuucauuuuccuggcucuggaagacugaggagaaagaugaaaccaauucacucauugugcuuugcucucugcaguuugacccugaacucuugacuuuggucugcucccugccucauuuuucagucagugacuaagcaguuuuugaguuaauaaguaacucuuaggugacugauuaaaaauucuaggaggugacuuagaaaggagucuaaaacaugguugcccuaauagaauucauccuguuuuucauucauaaaauauuacagcuacucccacuuuggcuuuagggugaaaauuguuaaaccuacuacuguucuuuguccuuuagacaguuaugggcuuuccuguuuuaagaggaaacagaagacuagucuaacaggaaaauauuaggcucaauguuuucaagagcacauguauugagaagguuuugcagguuauggaaagcuuuuaaagaaaugaguccgggugcagugguucacaccuguaauccuagcacuuggggaggccaaggcaggucaaucacuugaggucaggaguuugagaccagucuggccaacguggcaaaaucuuggcucuacaaaaaauacaaaaauuagccaggugugguaaugugcaccuguagucccaguuacucaggaggcugagguaggagaaucgcuuaaacccaggagguggagguugcagugagcagagaucaaagcacugcacuccagccugggcaacagagcgagacucugucucaaaaaaaaaauaaaauaaaagaaacuugaaagaaauuuucuuucaagaaauugaaauuauuucuuucaagaaauaauauuguaugagcaauuuucugugagauaauugugaaagaaguuauaacaaucgcuauauccuucucaccuuuaaucugaauguuaauuuagccacaaagauagcaauaagacaacaucuugaaaguaucuuauccacagcaaagucacacuuucuuaagcauagaugaaauccaaacuacuauagucguuacuuuuaaaucucauauugggcaaaugcuuacuugauauaguuacgaauuugauacagucaugcucuugaugaaguuuaaaagauagcucugcuauuaaauuuauuugcauuaacucuuucuuauugcuuauugauuuuuuauuuuuauguauaugguaggaauauuaacuagcuuguagggaguccuggccauaugccaagcauuggucuaaguguuuuauaugcauuaauugacgacuucauuuacagaugaguaacugaaacauagaagaguuaagcaacuuccccagggccacacagcuagaacauaacagagcacagacuugaacccaggcaaucuggguccagaauuuauacucucuaaccucacugccuuucugugugaucuuaaauguaacaaguauuauuucuuuagaguucaugauaggauggggagugagacuagaaaaacuaagcaugagggaagauauaauaggaaauagagucagaauauuuggccucccucaaaaguaauuagaaugauuagauauuuacuuagguuuuauccuuauuaacugauauuuuuauucacaaacuuguccaacucaguuuuagauuaaaaauauaaaguuauuuauuccuuaaaaaauucuuaacuaucaagcugcuguauugucagcagcaagaggccuuugaguucuugagggggaugagagaaggucacgugccccuggaauuccaaaggauuauucugaucucacugugauuucacugugcuuacccaugagaggggcauagucaguauuuguugaaugaccaaguacauaauucucaucucccauucuaauaauaaugugucauaugaggaacaaaaucacaaguacuuucuccucuuuguccccauuguccuuauacauacuucuguuaacauacuugguguauuguuaaauaauuauuuguuucuguguaguucaccccuuagugugaacuccuugagggcaggggccaugucuuaccuuuguaucccaagaaccuagccucuguuuaucaguaacuuaguugauuauugacaaauggcuguggaaggaagggaaggaguaaggcagaccuagagcugauauccuuguguauuuauuuuacauuuauuaaaaggucauuggguuuaaucauuugaggcuuuugaaauauauucaaagaugauauuucuuggauuugauaugacuccucugauuuaaccccugggaagaggucacugggauuuaaagaauauguauguuauagucugucccuuagguacaccaccugauuuuauugcuaaauuaugucauacuccaaagggcuuuggcuguacuuuuggugaguuuaucuguaauuauugauaaauacauucauuuuugcuuaauuuauacagaaugccugugugaaucaccccaaaucacuguagcauuuaaauuuccaucucaugguauagcuauggacuaggaagucugccuuggaaauuagggcuuauucuuugaaaaaccacagauguauuuauuauuugagacaaauguguaguaugggaucuuuucucccuccgauaauauuaaaugcuguguucucacuuguaagugggagccaaacaaugguuacacauggacauacauagggaaauaauagacacuggggacucuaaaagcggggagagugagaagaggaugaagauugaaaaauugccuauugaguacaaucuucacuauuaugguuacagguaugcuagaagcccaaaccucaccaucacacaauauaucuauguaacagaccuacacauguacccucugaaucaauaaaaauaauaugaaaugcuguaucucuccacuuuuuacuuucuucuucaggcccacuauacucucauauuauaccacauuuagcucacaucucuugugguaugcacugugcacucacaauugugcuggaugcuguuuuuguuucuagggguuauaacaauucgauuuuccuccauaauucuauuucuuguuuuuaaauucgggucaacauacauugugaauuccaucuuuguuguaagcacacccuuauuuacugcuuuuacugaccuugucaucuuacagaauagucuacucuaucagugagugauaucucccauucugucauuaccacuauggucugagcaagaguaggggcuggaaagaggcuacaaugaggcuaucuauggauuuucaguggguaauuuuaaaaacugugccuccauggaagcuucugauaaugcuucuguccucaccuccaccccgccucccacugugcuucuauaacuggccuuaugacaacaaaugaaucuggcauaagagagaagagcaccagaguaagugaaacagaauugagugaauuagccgucucguuggauucuacccaaucacacugugaaaguccauuaugcauuaugcuuauauuccauuguguaaugaaugguaauucuucuaaugauaaauacugguccccuuugguaccaaccuuagaguuagaaauagcuuaaucuguugaguaaaugaauaaaaaccgcaaguugaaaacagcaaaaauaauuucuuugcuuggaauaucaguguacauaucuuuccgugcaaaguucuccacuuuucucauuacccauuaacuuguuuguuacucuacaaucuccaucugagagcuaaaaucugcugcuuacuauucacaaggcagagagaauuauaaaacguuauacaauaguagcacacagcauagcuuugaaucuuuccauaaagucaucauaaugguacguuuucugaguauugccuucaguuuguuuuaauaaagaauucauuguucuaguguuuacaugaugauuuucuguaacagaaacugauacugacauugauaccuuaggcuaaugcaauuuuuagucauuuuacugggguaaaaauaacuuuguuguauaauaaacaaauugcugaagcaauccuccugcuucagcuuccaguaauugggauggcaggugcacgccacagugccuggcuucuucucacauugauaauuuugguccuucucagguuaacauacauuuauugaaggccuguuugugccauucacuguucuaggcacuacggcuaaauaagacacacuccucauucucaaagaauuuaacauucuccaggaaaaauuguuaucgaaauugacaucagaaaguaaaugcuaggagauugauccuuccuggguuucaugaaagccccuaucaggaaguaaaugcuaggagguugauccuuauuggguuucagcacaagaaucagaugagccuccuguuagauaugaaaucugcuccaaguauuggaggauauguuaaaaaaaacaaaacauagaauaguauuccaggcugaagaaauaguguguauguuguauaauauauucucuuguaauggccuuuguggauaauuacacauugcaaguauucaauuuuauuugcuaguauuccaguuugucuucucauuugagggauauuauguauccauucucuuagcucuuuaccuugguuuuuuauuuuugucuuuguuuccugagauggagucucacuauguugcccaggcuacaguguaguagcuacucacaggagcaaucccuaauuccauguagggaaacuacauggaauuugauauagcauagcuuaaaaagacauuagagaauugcagaugagcauggaaagguagcuaaggcucaagucauauaauuauuuuaugccaaauuuaggaguuugaaauuuauucauaggguuaguccauggacugacuggcugaaauuguuugcaaaauguuguggauguauucauucugggggggaaaugguccguagcuuauuagaucucaaaguuguccacaauaaaaaaaaauuguugagaauauuugcagugaaaaguuuaaguaaaugcccauacuguucacuaauuagagugaaguaaggcauaaccauauccauguuucauauuacaagaaaugugauguacagagcugucagugcaaugaauggaaguugccaggaagacuucuguagccaaaacuaaaccguaaauucauucauugaacauuucacugaacuuuuccuauacaccagaaauugguaagcacugaggagacaguaaugaacaagagcuccuauucagacacacauuccauucagggcucauagucuaaugaggaaggcagacauuaaucagauaaucacaaaaggaaauggacaaguauaaauucugauuauugcuguguagugaaagacaggaugaguuguaaucggggaaccugguguagaugggggauuaagaaagguuuccuuuagcaaauggcauuugaacugaggccugaaaugagugucagcugaggaaaaagguaguugacuccaggccgagaaaauagcacuugcuaaagcccuuaugcggggaauugguugguguguuuuagaaaaggaaagaagaaauauaaaaugcaaaaaaaaaaaaaaaaaagccugaggugacacuggagaaauagagauugggccaugcagggcuuugugggcuauuuuaagaauauggaucuuuauccucaaaacaucaggaggcaacccuugaggggaaugggcguugacauaaucagguuuauaguuuuuaagaggucucuccaguuaccauguggaaaauggacugaagggggucagguugggauagauuuguuaaauaauaguauaacaacugaaaauacauugauaccauguacuuuaauuuauggguuguuauaaauucauaaaaugugucuaggcauuaguuucuccauguggaaaaugaugaggcugaacuuguaauucucaaagcuuggacuccccuacaaaugagcugaauaauugauccucugagaccuggaggcagcagcuccaauccuuaaccacuuccugugccggcuccaggaugccaugcgagaaugagcauuuucuaggugcaccaugaggugacaaagauugagaggcccuccucuaaaccccuuuccugcacuaacauuccaugauucuagguuuugaggaaaucaaauucuaauccgacaccuugguuuuaccauugaggaauguguugcccaaagaaggaaaauggcucaccuaaaauugcauggcuuaguguauagaacauuacucuccuaacuaguaauccuggguuuuucuaguuugccauacugucucuguauccuuuguaagcaguauaaugaauuauuauaauuaucaaauugcaggugcuucuuuuucuuuccucuauuuaugaacagaaguacaguuuauucuuuuuugauuaccaguuaagaauuuauugcuguaagucaucaagcaucguuuuacuaaaacuugaagacuagaaauggagaaauuaauuccuaggaaaacaacacaucuuaucuuauucuggcuuagcugaaaauauugcaagacuagcauuucuauuucaaaaucagcccaaaggcugugagcauacagaagugaugaauagaaagauguuagcugagcucuuaaugacuuuuacuugauuugaacuugaguucaaagguaaaucaaaaguuuaaaguugaacuugaaucuuacuaugccauauaggcuuuccuuagccuucuggaaaaucuaaaguauaagggagguccaggaguauagugauucugggcacagacucuggagucagguggucugaguucaaauccccagcuucuccuccuaccaacuucaugacuuaggaaaaauuaccuuucucagacucauuuuaucuacuugaagaguagaaauaaugacauuucacaguaaaaauuaaaugaagcaauauaugaaguaauuuucucuuaaaucuuaaauuaccucagcauaugcuuucacaauuucuuuccaauuuuaagugacaaaguccaucccagcuauucacuucauuaucucaugaauucugauuauguauucucucagcuuuuauccaaucuaagagcuuuuucacuuuucucaucuguccuuauaaaaaaaaaggcauuccaucuucuaaaaaauuuuuauuucuauuuucuaacucuauuauuuuugucuuggagcuuuucuaacugaaauguguaugaaguauagcaauaggaacuucccaagaaauaaaauauucugugguuuguuuuucuuguaaagaguacuguaauuccuuggguuuaauugacaacauccuuuaugaggacacucagcauaucagcauugauggccucguagacagcagucuuggcccaaguauucagggaaugacgaggacauacuccaagauccuuuucccgaaucacuguuuauuguuuauaaaacucaucuuguaagccugcuuuauuuccuuaucaauacccaagguaauccuguugaaguuuacucugcuuuucugcccauauuccccacuucaucuuuugaggccuaccugucuccuuggcacauuauccauguuaagugccuccaagguacuguggauacuaguaaaugccaaauuaagugagggguuuuauucuuuccccagaucacauauaaugauaucagaugggcuugguuugggcucugauuucggaggcaccuacuuugacuaacuaucuaggacaguaguuuucuuuuuuuuucuucauccagaaacuuuauuguaaaucauuugucaacaagaucugcauuucuaauuucaguuugucauuccucugaggcacagagaaaggaaaagaugagauuaggguuaauguuuauugagcacuauguauaaaggaucuuauuuaguccuuauaaacaauacuagggcaguggcuuucaaccccaguggacaucagaagugucugugaagcucuuugaaaauguggacgucuaggaccuacccaagaccuaaugaaucagacucuccaggguggggguguaagcaucuacuuuuugguucuuuaaagauccauagggugauugugauguacaaccaaguugaaaaucaccaaucuugagaacuggucuuuauaucuacaauuucuuuuauuugaaaucuuuuuuuuuuuuuuuuaaggauagacuguucccugucaaaaucuuuucuucucugggagccacaaaaugaauuucuaagaggaagugucaaggucaccugaguuuuuccccucugcuugcuuggcauucauaacugagaaaacccaucccugaagcuuuacuguagcugauuuguagcagagcccauccugggcuacuaguuucagagugggaacauggggccauauguccuuuuuaaaaaaguauuauuuguauaaugugcuacaacuuuauaaauucacccagaaacuuacaugcccacuaaauccaaugagguagguuuuauuaucuucaauuuuuagauuaggagacaggcucagagagucuaaaugauuugccuaagagcacuaggaaauaguggcuagaauaaaacucaauucuuccaacuccaaaucuaguacucuuucuguucuuucuacugauuaauauuuuuaucauuccauuuugaaauaauuucagacuuauagaaaaguuuaaaaaaauacuuuccacaagcccuuuaccuauauuugccaaauguuaauauuuuaccauguuaaucauccuuucuucugucuuucuguacauaugaauuuaauuauuuauaauauuuaacaguauguuauagauguaauuccccuuuaucucucaauacuucaguguauauuuccuaaaaacacugauauuaucuacagucaccacagaaagugauugcgaaucaagaaguuaacauuaauacgauacuauuaucaagguacagaccuucauuuuuuacccacaaaugucuucuguggcaaaagaagaaaaauaguuucugguucaggauccagucagggaucacauauugcauuugguucucacgucuguuuacuaucuuaguuuucaaaguuuucuuagucugccucugcuguucaugacuugaauaauuauguaugcuaucaucugauaagcuggaauugacaguucuggcugucagcacuugauggaguuauucagagauacuuggguucagugacauacagcaggaugggccauaacauuaggagaauauuuggaaaccaauaauagugauauuuauuaugcaauauuuaugcuggacacuauuuuaaaugucuuccauauaauuccucauuuaaacuucacaacaaaccuacauaguagguauuguuacauuauagauguggaaucugaggaacaaagaaguuaaguaacuugcucaagguuaccuggccaggagauggcagggcuaggagucaaauuccaacagccaggcuacaucccuagugugagcucugaaccagcacaggcugaaccagagacauuuaacaaagugauaugucuuuaggcaaauuauuagcucaaaaaacuugagucucaugaacugaaaaugggacuaauaauaccaaugucauaaaggugguuguaaggauuacacacaauaaucuguuaaagcauuugguauguagcaagaacuucauuuuuuaagaguaaaauuuaaaauauaaauauggaaaaauugaccgauaagcauaucugaagaagauacuguuaugacuaagaagauacuguuaugacuaagaaguuacuguuaugacuaaguucacacugagaugagaaaacucucagagaauaccuuuuuaaucauuacagguagggaggagaagggaacagaagcaacaaacaucuguucauauuuugagagacuggggagauaccaguuacaaccaaaaccaucuucgaggcaaaaggggcuagauaaugaugagucaugaaacacaauuuuaugaugaauuuauggaaaguuguagccuuuaguuauauuagcaaagaagguaaauauuuuccauaaagagaaaagucagcaccacucuacucugggcugagauauaauuaccuuccagcuuuuaaaagggaauuuucuccuuaguggguggcagucagaggaaucaagagguuuuuaucuuuugaguuuuuaauuucauauauacauaucuauauauauuuuagagagugggucuugcucugucacccaggcuggagugcacuggcaugaucuuagcucauuacauccucgacuucccaggcucaagugauccccucaccucagccucccaagcggcugggacuacaggugugcaccaccacacccagcuaauuuuuuuuguuguuaauuuuuuuguagagacagagucuuucuauguugcccaggcuaguuucgaacuccugggcucaagugauccuccugccuuggccucccaaaaugcugggauuacaggugugagccacugcaccuggccuugagguuuuuaaaagagaacucugaagacauuggguuuccagaauuagaaaaauguauagucauuuuaaugugacauuuucauuuagucuuuuuuuuauuuuuauuuauuuauuuuuuugaggagucucgcccugucacccagguuggagugcaguggcacaaucucagcucacugcaaccuccacccccgggguucaagcaauucuccugccucagccucccuaguagcugggauuacaagcaugcaguaccacgcacagcuaauuuuuguauuuuuaguagaaacgagguuucgccauguuggccaggcuggucucaaacuccugaccucaggugauccacccgccuaggccucccaaagugcugggauuacaggcaugagccacugcacccggcucauuuagucuuaaaacauuucaaauaugucaacuaaaccuacggagaagauaagcauaucugaagaagacacuguuaugauuaaguucaacuuaauuuuuuaauuagaccauaaauagauuugugggggguacaucugcagcccaagggcuuuugggguucuauagcuacaacaauaggcaaggauggauuuuucaucuccuuucuaucaagguuugaauguuuccucugagucuuuccacccagagaacccuagacuucuuucaguuaccacuccuuuccucacuauugaccacuucugagccccauauuuugggagcugaaaaguaaguagugccuuggagagggaagacaaaaagggaaagggagcccagcaaagguucauucaaggcucacaugugcauccccuacugguagcugccucuugccauccccacagcauaagcccuccccuccucaccccugcccaaggcugcagagcgccaucacagggccucuguuccaugcccgcugagucugccagcucacaccuuccauaaucugccucacccugcaccuuccccaacccgcccaacucucaaccaucgaucuguucauugcuuauuuuaaaagcagccuuuucaaccacauuuuucauucagucauuaggacaaccaugcuaaagcaacccuacaguagacgcccuuggcuuuaagcagaacuggugcagaauaaaaaugucaggccuuuuuuucaaaauucauuaagaauuucaagacagcagcagcagagcauuaaaccaaacacaaggcucuucuaggcauguggccccgugcacagacugcaggcccaugcagccagccuuggcuguaaggggcccaagugaguugaaaguuggucaucuacuaaauacacugauauauuuaaaacucaguaucauauuauuggaacacuaacaaaauugcacuucaaucaaacugacuagauuuuauccaaaaaucuaguguagugacacaggcacacauauuuuaauuuggugcuggaauuccacaacugugcgauagauucucuaaguguucaagcacaucuguacucuuauuuaaaagaaaauauaacuccauaggcauuucugauacucaaucaacauuaaaaaccauuggaaaauagaugccugcauuccaccucuaaagugucugauacacuaaugaaagaauaacaagcuucacaaagcuauugggaaggaaaugagauuuauaugugaaauuagacuaugcacuauaaaguaguaaauaaauguaagcuauuguucuuauuuaaauuuaauggugauaaagacagaacgagccuucaacuuaaucuuauagguagucaaguaucauuauccguuggauauguugaauauguuacaugaauggcagaagaaggaggggaaggaagugguaucgaugagaauaguuuagaccauguaagacguuuagaaguacaaaaguaaaaauuucaugaggaccuaguguguuuggacacuccccugugacccccuaccucuaccccaccccaacauuucauugucagugcuggguacauagcagguggcucaggagaaauuugcaaaugaaagaaaagaaaggccugcucuaggcaaagguuucaaacguuuaugguaggcauggacuucuccaucuauuauguuucauuuucugcaguauaaccugaguuguauuauacuauuauacuauucucuugcugucuagaggcuccaaagcagacucaucagaaccuccccaaggccuaaucuuuaccugcugguuauuucagaaccccugcuccuuaucaaaaggaaaggauccuauguccuauuccugcaggauuguuccauacuccuugaagcacuccaaaagacagaccaaguaaugacuauaucgggcacuggcugugcccgauauauguggcuggcuguuuuaaauuaacccgugucaccuccugccuggucuguauagggucaacacuaagggggaauguaugugucuccuuggaaaagauagcccuagaggccgccuaugauuuuaugaaauccaaguuuuguaaaggcuuugugauaaagcuagcuacagauaguaugcuuuacuacaauaugggcauucucuuagggucuaggaugccuuugugacuaaaugaaagagcugaauucuguagucaauaagagucaacaccuuaguaagauacuuaaucccucagaaaggacugaugcugaaagucccucagagaaaaauagagaauuaaagcaugaaccaagauacccgccuuguuucaccccuuuguuucacaugacuaggauaugggugcucauuggaaccaucgguuggaagaauaacaggcuuaucuauuucuugaucaucuuucucaguguagagcccaggggacuacagauaacaugucugguuaacaguagcccccucuuaaagaaaaaaggagaaagucauguuuucucaguugaauuugaaaccaagaucacuuuauucacucaauuaaaacugcuauugucuguuccuuggauaguuucccucuguauucauaaggucccuuaguccuagauuuucaagguaauguuauuugguucuccucugugagccaaauauacacagauaucaaaguguuacuaauccuuuaagaagccaggaguuuaagcuauuacugagcuuugaaagguucucauaacggaacuuuuguuucugaucacugauaauguuuuuaauuuggaguuggagcaguucccucugguauuaggugcagcuggagcagacagggcaugcuauuguucuaaaguagauagguucuggguaaugccguuuuugguuguuuuuuuuguuuuuguuuuucaagacagggucucacucuguugcccaggcuuaccgaagccuugaagacuugaaccuccuggacucaagcuguccuaccaccccagacguccaaguagcugagaucacaggcguguaccaccaugcucggcuauuuuuuuuuuuuuuuuuuuuuuuuuuuguagagacggggggaucuccuuauguugucuaggcugaucuugaacuccugggcucaagugauccuccaaccucagacucuuaaaguguuaggauacaggcaugagccacugugccuggccuaaaaugcuauacugucaagcagaguccuaaauuuuagccaaccauuuaucacuuccaugcuuuuuaucauauuuaccaccugaaauuuuacuauuuuucuuuaaauccauucagugcuauacuugaacaaauuuauuuuacugcuauaaauggaaaacuacuuguuuuaaacuauucuuaauugaagguaauaaaauacaaugaaaaccaguuuaaaaauccuagcuagguaacaucuuauggcaaagcuucugacaccaaggccugucccucuuuguuugcaagggaaauuaaccaggguugaggacauacuaacucgguauuucaguuuuccuuccgagaauaugaaggguugaaaagagaauccuuuuucucucuucaguauuuaaaugcuuuucauuccaaguagucagccuaucuuugaaaaacucaaucccuuuauauuguguaaggaauuaaguauuugacaggacuugugugaaaacccauuucuugaauguaagaacaccccaagggagauagauggcacugucccuacacccaugaaauaugucaucuacugagggucagaauaaacugauuaaaaagaaauaauaaauguauugaagagucugagaaauaugcaaaugguuaacacuagaauaugagcagcagaggaaaaaagauggaguuuugucuguuuuguucacugauagaucucucacuagcuguuagaagaaugcuuggcauaugguagguaucuguugagucuaagaacacaaaccacauuccccagucuccuaguggugauauaacacuaaagaucaggagugggaaauagguuggcacaaucuggagaaauuaagagaagcaagauuuggagagaaucuuggagaaaguuacagacacacacaauggcuuagaacagaaaguacacaauacauacgaaaacagguuaagucucaccaaggucgugaccuuauagcagccuuaaaaaugcaaaauacccuccaguuugaaugaaugcuccccuuuccucagaccuaaagccccauucccuuauucacaagcaucacaaauuuaaauaucacauacaccuuacaaaaugagcugauguuucugcaagacaaacuucuauuuccauaaauguggguuacuuugagaaacucaguuucauguagguauguuaguuugaggauuuuucugugucauuucaacuacugaagucuccuaaagacuucaacuauuaaaguuaagcaguugugccauuuuucauaguucccuugcuauuuuuuuguuaaguggagucauuguuccucugguacuaauuucgcaucacacaauuuguugcucuagaaauagcaaaacgagaaauagauuacugugauuauaaauaugaagcaguagguggaaacugaagcuguuucuggcauuucucaccaaaacggccauggccuccagaucugucucucuguaagagggcagcaccccugaagacacagugccacgucaaggaugugugugagcuccucugccugcacaggcuuugcgaaagguuuccguuucagaaauacaaugcccugauuuuagugugggcauuucccauguuaguuaagugauacuaaaucuuuaauaauuauagcuggaaaauguuuuuuggaaagcuuuuuuaucuucuuucacacuaaggcuaauuuuuaaauacagcuaaauaaggacuuaggccaaucccugaaccaaaaagcaagguaugaaccuuaauuuacugaaccacaaaccuaaccucauuuuuuaaaaacugaagugcuaacaacuuuuuuuuuuaacacauaugucuagugaagcaauagcaggaaccaacacuucauguuuucuaaacugagugaaguagcaguagcacugcaagaugauuuuuuuaaauggaacuucaaacuggagcuucaucgauucucugccucugauugauugauuaacuuuuagugucuuugggaagggguaugccagugucugaaguccugaccaaccucuuggacucuguuaaguggaaaagaccaaaauuugucugaacuaagaaauuauguguuucuccguuucagguucaauacuucuucaagaucuuggauaauuagugguguggaaaguaaagaagucacagguugggacauuuagacaagagugaaucacacacgaggaauguguucauucuuuuauuguccguuguuuuaaccugacugaauacaagaucaacaagagcacuguacuccuggcaauuauuacauauguuagaacauggauuuugcacuguagacaacauuuaacaccagucuaugggguacugcauugcuuuuuauaaaguucaaaauaaagauuuauuuucaaacaa

SEQ ID NO: 191158 - RNA, 20395 nt, Homo sapiens
uuaggagaccccgcacagaagagguuuuaaugaaaaggaagugaaacaccaagcucacauaaauuuuuaauaaacuuuuuugugucuaugucauauuucauaauguuuuuccuaaaugcuuaaccuaggaaacacaugugugcacacccaugccaaacacacaaaugaauuuaacagugugguuuaugaaaugaaagcaauaauaguuugacucuucagaaccucuucauuguggccuaugucaagcucucuaaucuuuucuccucaaugguaggccaugguuaagggacagaugauaaaguacaagguuuucaauugcuaacugccaaauuuucauagguuauaguauuacucaaaaaguuguuuugucucauuucuucaaauuuugaaauaacuugcuuugcugacucaucugacuauauuuuuaaugaggacuggcuuuauuagcacuuuuagaaaaaaagcucugcacuccacacugaaagucaaaucaaauagauaguuaauuauuuguagcguggaguaauguaugcucagucucuccucacaacggagccaaaggucacaaacauuuacagaaaaccuacuuaugucccagguacucugcuagguacuuuccuaacuugucuaaagucacagcauaggcuggguaugguggcucaugccuguauuccagcacuuugacaggacgaggcgggcagaucaccugagcccaggaguucgagaccagccugggcaacaugacaaaacccuaccucuacaaaaauacaaaaauuagcugggugugguggugugugccuguagucccagcugcucgggaggcugaggcaggaggaucacuugagcccaggagguaggguuugcagugagccgagauugugccacugcacuccagccugggccacagagcgagacccugucucaaaaaaaaaaaaaaaaaaaaagucacaacagauaagucauagagcugggauucaaauucaggucugucugaauauagaguauuuucugcuacauuaucaguuacugaggguaauugaaaaauuuaacacuuaucauggaccaggcacuauguuaaaacauuaucucauuaaucuuuacaaugauccuauuuaaaaaucuguagcuguaaaagaauuuuauacaacauuuauacaaaaaucaucaagauucuucauggcaaguuaaaauguuuuuaaauaguuugaggucaucuugauagucauuccacuacccauuucucagucucuucagcaaaauuuccuuucacuuauagcuagcuaccugaccauccuacacuaaauaagcagauaauuuaaucuuccaacuucuugaauuuguguguucuuuuauguacauauguuggcugacuggaacagaaggaggcaggggguauauacgagcaaguaugguuuauuacggacaaaugguagaaaaauguuacuaauauccauagauaaguuccuuaagucauguagagagacuguuauuaaaaguuugcugcauuuuucuauugaaucaagaacuagcuaccaguuacagugccuucuaaacacacaguuagcuuugcuuuaucaauaaccaaauaauaaacuaggucccaaugguuuuguccacaucuagauuguucaggugaucaggaacucuuuuauuugugugcuuuagcuuuuaguucuugguuauaucuauaaagaaaacagaaagaaaaauaaucaucaauaauaauagacaaauuuaugguaaggagagaaugggaagcauacuccauuucuucuuucuugguggucaaguagcuauacaguuguaaacagaaucuucccggagggcuuacagguagaaacaggcagaaaggaaaggauucaaagaguucauuugcaucuggauuuuguuucagauaauaagagcacaacugccaaaaacuuuuuuuuuuuuuuuuugagauggagucucacucugucgcccaggcuggaguguaguggugugaucucggcucgcugcaagcucugccucccggguucacgccauucuccugccucagccccccgaguagcugggacuacaggcgcccgccaccacuucuggcuaauuuuuuguauuuuuaguagagaugguguuucaccguguuagccaggauggucucgaucuccugaccuuguggucugccugccucggccucccaaagugcugggauuacaggagugagccaccaugcccggccugccaaaaacuuuuaacagcuuagcugacauauaguuuccugugcaaaaguauuauuuuaauaaaaauauucucauucuggaauucuacaagaacgugacaaacuugugaacauauguauaaaauuuaguaaaauguggucaccuagaauuuuaaaauuuauacucgcaaagcaccuuuccuaagaauaagaucaacagguaaaguaaaauauacuaaaguaaucacuaaaguaaaauauacuucuaaccacuaagguaaaauauacuucugugaugcaggcaggcuauuggguuaacagccuguaaacacuuaaguucacaaacgcuaaggaccauuuccucaauucucaauccaaagaaguaaccacagagccauagucuuuccuucccuucuaccauaccuugggcuucauuuacuauuccuccuagcuuauaauggaauggagaguaguauaaaagcauaagaaggaacuuauuccaugaagccaaccauaccuccuagguuucucaaaagauccugauuucaaauauuugaucauaaugucauuaucauaaaucacugacaauauuaacuacugaguaaauaguuuaaaaauuuccagugcucauggaacacuuuccaaugaaagcaaagaccucacucuacguaucauuuccaauacuacauaacaauacacuuaaguuccaauuuauuauauacaauugaaagugauaaaagguuuacauaagaaauuaauaaaucauaaacuguauauguugucuuaauaaaagagauuaugugagaugguuaaccaucuaaaugaugcacaguuaaaucuaaaaacuagguaacauacugcuuaacugauuuuagucaguuaacuaguuaacugguuaacuuauuuguaaaccccuagacuuuucuagaaauguuaaauuucuacuuuagauacuucuugucuuagcauuauauaugaaucuuuuaaaaaaauuagugccaucuccagccugggcaacagagcgagaccccgucucaaaaaaaaaaaaaauuagugccaucuaaguagcuuuugcaacaguuuuaaaaauaucucugguaggcuuaccuccaaauacgaaaaagcugagaggcuccugcugcccccacaaagaaauuaacagcaaacagacuccaauuuuuuggaauaauuacaagugaguaucuugaccaaauaaacccuguugaaacaaaauguuacuuuaaaaagaauacauacugcuucaauaacuucagugaauacuuaauauugaguaaaguaauuacaacaauaauguaggaugagggacaaagaaaugcuauacucugaauuuucaauguuucuguaacuuagugucacagaaaauacucaauucuuacaugaaagaggaaucuuuaaagugacuauuaacuguaauuuucuucccacuuauaaaaauauguucauggcaaaaaccugaaaagcaaaagcccauucagauacuuauucuuucugugacuccuccauccauaacuuaauaacuuccuagacauaauacuguuaauuccuuuguguguggguguauuucaaacacuaagccacuaaauaaacugauauaaaagaaaacaaaaaucauuuauguucuacaagaaacacagaagauauuuauuuaauuuaccuguagccaucaaaacagcagauugagcugugcuaaguuuuucugcaggucuggccauaucagccaauccagcacacaccaaccccuacacauuaacgcauagaaagaaaaaaaguaucacaaauguggaguaauaguuuuaacuuuaaaucaagcacaagacauuuuugagauuuccguaaguuagcagcuauaauuuuaguguccauucauuaagaaaauguagauuacaacaaaaaaaaagcacaaugaauuaaaaaacugcuuuuugaacuaauuuuauuuuguuagguacacuaagcagucucacauaucugaaagucaguaguacauauauagauaagauguauauguaugcauuacacguacauauauauuuuggguuuuuuuuggucuaccuauuucacauaugaauuuauauacucuuuauauaugucaggaaccacuaaccacuagcauggaagauaccuaaaagcuguuaaggucauuuguauagauucuuccuuugauguuuucugccaauguuaucauuuuuaaauuaaauuaaauuuuagauuugggguauaugugcagguuuguuacauggguauauugugugaugcugagguuugggcuucuaaugaauuauuuuuuaaaaguauaaauaucagaaaaacuuauaauuuuaguuuuuugguuagaucauuuuuuuuuuuuuagacagucucacucugucacccagguuagagagcaauggugcgaucuaggcucacugcaaccuccaccucccaguuucaagcaauucucaugccucagcccccaaguagcuggaauuacaggcgugugccaauaugccuggcuaauuuuuguauuuuuaauagagacgggguuucaccauguuggccaggcuggucucaaacuccugaccgcaggugauccgcccgccucaaccucccaaagugcugggauuacaggugugagccaccaugcccggccuuggcuguuacgccauuuuucuuuaacaucagcauauacauggccauuucucuucuguguuuuuaacacugucucuauugcacucaugcguuuuugcucccaccagaugagcuguauuuuuaccaagucacuauguuuguccccaaucuauuuaugccaguuuuacuuguuaauguaauuuacaugauuuaauaaauuguuuuuuuuuaaaaaaacuaagcuggaaauuauauaggaugcacuguaguguaauuuauccaggauagaaaauguggagcucagaaauccauacacaaauaaaagauuuagcuuuaaaaaagacugauugucaaugaauauauauuuauauccuuuagguuaaaauaaaauauuuaagguacauagguuuuuguuuuuaggauuauccacuuugaccuuuaugauuaguuaugugguuucaacuaaagugguuacaaaggacucuacuacaguuauauguuugaaggcauauggucugagagucuucauguuauagaacauauguggcuugcagaagcaacuguuaugugucauguauagaauucuacagauuaauuaucaaauacucugggauaguaaaacacaguaagagguauauaagguaaguaucuaauagaagaagucuccccaccagagaacaaaacacagaaguuucuauugcuaugcugucaucuggagacuauguaugauuucaacauguacuuaaaauagauguucuuaaagagacagauagucaagaaggcauuuaugaguauauaaugcugucaauaucucacaacaguaaugaaccaguucaaauaaaccccaaagcuauugauaaaaucaauaaacuccuaaacugugguaaauuugagaucaaagaggccccuaaauuuauugugaauagaugaaaucacucaaacucuuuuaaugauugaauacuucagcaaucaauuccacuauaaagauauauuauuacuauguaauuuuaaguguagguagggagagaagaaggaaaugguaauguaacuuccauuaguauaggggguuuuaggaucuuuucucaauauguagauaugaaaaaaaaaaccugcucccuagaucucuguaaaauacagcucccgaaugacuuauauucuaaucuugucacuuuauaguugaagagacaaaaugacaaagagacuaaacuugcccaaggccauaagauugagucauagccaauuccaacucuaacauucucaaccacuugaauuuacaacugaguuucugaauuguucuaaccauuuuaaaaguacauuuaagagaauuacaacagcccaucacucaacaacaacaaaaaacaccuugauuaaauuaaaaaacaggcaaaggacuugaauaaauauuucuccaaagaauauacacaacugaccaauaaguacaauaaguauauguucagcaugacuaaucauuagggaagugcaaauaaaaacaaagauaucuaacacccauuaggugccuaucauaaaaacaaaaacaaaaaugcucccccaucaaaaguaacaaguguuggugaggauguggagaaauuagaacacuuaugaauugcugguagaaauguaaaauaauguaguugcugaggaaaacaaaaaauauuaagcagaauuaucauaugaucuagcaauucaacuucuggguguauacuaagaagaauuaaaaguauugacuuaaacagauucuuguacaucaauguucaugguagcauuauucacaacagcaaaaauguggaagcaaaccaauuguccaaucaacauauagaagaauaaacaaaaugugguaaauacauacaauggaaugcuauucagcauuaaaaagaaaggaaagugacacaugugacaacguuaauguaccuuguggacauuaugcuaggggaaauaagccaacuacaaaaagacaaauacauuuugauuccauuuacaugagguacuuagaguagugaaauucauagagacagaagguagaauggugguugccagggacugggagaaggagaauggggaauuauggguacagagacuugcuuuuacaagauaaaaaggguucuggagauugguuaacaaugauguaaauguacuuaacgcuacugaacuguacacuuugaaaaugguucagauaguaaguuuuauauguauuuuaccacauuaaaaaaaaaaaagccuacagaccagugguuuucaaacuuuagagggcauuagagaaucauccgaagagguuaugaaaacagagcucacuggacuccacaucuagaguuucagauuuaguaggucugugauggggccuaacaaguucucaaaugaugccacugcagguccagagagaugacacuuugagaagcacaguuauagacccaaacuggcccuuucaacauaaaaucaaugauuugcuacaaacagccaccacaauuguuucuuuucagcuaaguaagaacuuuaagaaagaaaacuuuggggaagaguaaaagcacugggcuuggagucagaaguccuagguucucucauuuaccaaaugcuaauauuuauauucgaauaaauccaucuacuuuuugagaguaacuuuccucaccuauauuuuggugauaguaccuucaguucucauacuaaauuaauaauaaaaguuaacuuggggguucuaacuagcuuaauguuuuacuuaguaauaacauuuuagaaugaaauuucauguccauguggugcacaauuguaaguuuuuugauaacaaguauguucccagaaggccucuuaucuaaagaguucagaaaaacuaaaguagauaguugcuuuauguagaaaacgauaugucugagaauauuugccaugaaaucaucuagaggcauaccaagaauacucuaaaguauauccuucauaaaaguuacuucaaauuaguaaauuccuauuaaggaauuugucuuucaguagcuuccguaaaaacucaagacuuacccauuucauaauuggagcccagaagaaaacuguucugggaccugaaaaaaaaaagaaaagaaaaauucaggaauaaaccaaauauauuauacacgucuuuuaacagcugucaccaaauuuuaaaaaccaaaggauuuaucaaccuauuuuuaaccacuuuuacuaugcuuuuugcauacuuuguauuucaguuaacauuuagagaggcaccacaguaucacaguacaguugacccuugaauaacacagguuugaacugauagguucaacuguaugcaaauuuuuuucaguaaauauacugccauauaaaaauauuuuagggaaccuugauucuaauguacuuucauacuaguuuuacacucaaguaacacucucaucccaaaugaaaaugaacccagugauaacaccccauuuuugugcauuuuggcugaauuacuauaacaaauaguuggguaaucuuaacauuaagcagcaaaauuugaaaaauguaaaaauggcaguugcuucccuccaauuuuugcuuaguaugcagguuuugaaaaguaucaccagauagugcaaacuacuugccuuuagccuuaagugaugguaaugcuacacauucugucuuccacaauuuaacauaguccuugauauuuuugucccucucgaauucacaguauucuuacagcaaaauucauuaauucaaugucauuuuaaaaucuaccacaguacauuuuacauauuuuacuccaguuauuuguaaaucuauguaccuaucaagauuaugacuuucucgaagcuaguggcucaauacuauucauacuuguaccccuauuaccuaauagaauguagaauaauaaauaaaaaggaaaguuagccaguagaguuggaagcaguuuauacuaacauuuauuacccuaauauauauguauguguauauauaauauacagauauacauauacacauauauauauauauauauauauauauauauauacauauacauauacacacacauauauauauacacauacaaacaacguuuuuuuuuuuugguuuuuuuuuugguuuuuuuuguuuuuuuuugagacagagucucacucuguugcccaggcuggagugcaauggcacaaucucggcucacugcaaccuccaccucccggguucaagugauucucuugccuuagccucccaaguagcugggauuacaggcgccugccaccacacccggcuaauuuuuuuguaucuuuaauagagacaggguuucaccauguuggccaggcuggucucaaacuccugaccuugugaucugcccgccucagccucccaaaaugcugggauuacaggcgugagccaccgugcccggccacaaauaacuuuuaaaguacuuuaaaaucauaaguuguuuuuaucagccugauacuuaaauauugauaagucugucuuaugcuuuuaauaguuuuaaaauauguuugcugauuuucuaauuuaauccuaaaguccuacagcaaucuaaguuucauuuucucauucuucagagaagcuggguaucauuagaauaauucuucaaacacuagaaagaagaucacggcacaaacccugugguuccuugugggacuacucagcccauuauaauguuaaacuuuauuuucucacauacaucugguaucuaaccauuuuuacauuuucuuguguacguucgaauuuuccguauuuuaaguuguagaauaaaucuaaaaacagugcugaaacagcuggugagagaauuuaaacuaucaaggaguucuaaauuuugauguucuuacaacugagugaaaaaccuaucuauauucaguuucuguuauccaguucucuaagcaguauuguucugggcacagccaccacacacauagaacucuagccacaucuuuuucucucuacaagauagaaaauaauuuaguuucuucuuugguuaagguuggaauugaagacauuuuuacgaagggaaaaaggggaauauaaaagaaaacaugaagccacugaguuucagaauauauaauccuaauuuaacuaaauauuagccaagucagcgguucucaaccaggaguguccccccaggggcauuuuuaguugccccaacuguggugccccaacugcugcagaugcugcugcugcugccgcugcugcugccgucuaguggguagaggccugggaugcuguuaaacauccuccaaugcgcaggacagccgcucccagaaaguagaggguuaagaaauccuggccuagggcgacugauaagcuaggcaaacauucaacuaguuucaugcuauuuuauggcucuucaguucaugcugucccuucucaauauccugcuuagucuuuaccuaacuccuauccaucagaaacucaucucagguugcaucuccucaaggaagccuuaaaaaacaaacaaaaaaacuccagguuaggcuaaauugcuccuucucuuaacuaccaaagcagccuguauauucuucuaucauuuucuguuaaaaugauuauuuaugcaucugucacauuaacccgaagacaagguccuuuucuuaaucuuccuugacaaauaauagguaugugccaacagaacugaauuggauccaccauguucaggauagaugcuaaucaaagauauucaaacuuucugucugacccagauuugccucgacacugcuucauccucaaggcuggaauuugcuguuuucucaucucuagggacaucagguucccuuuaugccaaggauauauuagauuucacucauuaguuacucuacucuuagaccacagcucucuuccccugagucugaugccauaaugcauuaauccuauaagucagucuucucaaacucucuggaaauuuagggugagauucugggauuccuaucauuacaccugguucauuuuucuuugucauacacagugucucuggcucauacacaguaucaauuacuaaguuuaguuuuuauccucgcauggaguuucgcuucaucaaucaagagucaguccauguauuguuuuagucucuggcugaauggguguucauuuuuacucugaacucuucagcagacuucucuuguucuauuugaaagcugaaguuucugucaccccaaaauuguuuucugaguaaagccucuagauucugguuucaagcuuaaauggcugacaggcuuaaaugguugauccuuugggguuaauagucgaucuuuucaguagguuugccugguaacuaauuuacuaaacugccuagagcuagguaauaguuuuacaauauuaacaacagcccuuccccaccaaaccaaacaacugaaaaaacuucaaacaucaaauuaugguugcuagaaccuggaccaagagagguauuuuagugagugaauaauuuuaaacuaugaaaacaagcucuaauuuuaguuuaacaacugcuauguacuaaacagaaaaauagcaguagccaauacauaaggccuucuaaauugcuaauuuuucugagauacuaaaagauguggacaagugacaaaaaaaucaguuuaauaucuauaacugcaaacaguguuuucuuaacuguuaaaaaaaaaggucggccgggcgcgguggcucaugccuguaaucccagcacuuugugaggccgagaugggcggaucacgaggucagaagaucgagaccauccuggcuaacacggugaaacccugucucuacuaaaaauacaaaaaauuagcugcgcgugguggcaggcggcuguagucccagcuacucgggaggcugaggcaggagaauggcgugaagccgggagguggagcuugcagugagccgagaucgcaccacugcacuccagaaaaaaaaaaaaaaaagucacacaauggguuaacaaaauuuuaaagaaaacuuaacccuuucauuguagcuaauuaacauucaauuaacauuucuuagcuuuuuuuuccuguaagaguaaauaauaugucaaauaaagcuagacagguaaauuuagacauauauaaaacagauacagaggcugucuuccagaaaacagcaauugaucaacaguggauaugguagcgaaaaaacauuccaacuuacuucaacauuucuaaacauaaaguuuugacaaaacaaagcauuuagaaauagguaucacucaaauagugacaauacaaugucacaugugucauucuagaccuggaaaacacaggcuuauguucuguacaaugacacagcuauucucauaggagagcauaaaaauagauaauuaugacacgugaagugauuauaauaccuuaauauuagaauaagcagaaguauaaacuaacagauaccuggcuaacauccauuaugauaaaugaaauaacuugauuagguggaaaauuugaacugcugaaaauauacugaagaaaaaucuccucauaagacauuaauuuauagcccaagaugaaagaaauuguccacaucaaacauacuauauauucuuuuagaaaaagaauuaauacauuuucaucuuguuucuuugaacaguacuacuggauguugaagaaggccuccaaugcugacaauuuagaaacauuaaacaaguauuuaaaaugucuauacauuuaggccgggcgugguggcucaugccuguaaucccagccguuugggaggcggaggugggcggaucaccagagguggggaguuugagacuagccugaccaacauggagaaaccccaucucuacuaaaaauacaaaauuagccgggcgugguggugcaugccuguaaucccagcuacuugggaagguugaggcaggggaaucgcuagaacccaggaggcagagguugcagugagccgagauugcaccauugcacuccagccugggcaauaagagcgaaacuccgucucgaaaaaagaaaaaaaaaagucuacacauuuuaaacuaugaacuauguucaagaaugaaaaauacugacuauaaguuauuuuguguuuuauugccuuauuuuuaaagugaaacucauguuuuuaaauucuaacuuuucauagaauuugagaaauucuacaagugaauaucauaagcaaauaauaacagacauaaauuuucaaauaaacaaauuuaguugccuugaacuucaaugaaccuauuaauaaacugacauaaacuuacuuccuaauuuccuuauuugagagaaauuacuguuaauaaaauauuauaugaauccuacccagaaaguaggccaccuaucguauauaugauucccucccuaaguaaagacuaacuuuuuggaacagaauagguaauuuuuacucucaagcacauauacacacuuacaaauacuggauugagguauucacuauaucccucugugaaaaauaaaguuucuuacugaaugcuaagaggucauaaaaucacuacauuucccuaccucuucccaucccuuucaugccacuccuuuaugguuuguuacuuuuuaacaccccucuuaauuccuuacauuacacaaguucaccuguuugcuaucaugugacaaacuagauacaaauccuuagaauauguaaagguuaaucuuugacauggauacugacggccaaaaaaucauucauuuuuauuugugccaaagcuaguucugauuuaacacuaagaacaugacuaagcuaccauuuuagagccauauaauuuuaauauuuuccacaaugccuuggaaauagcuaucacuaaaauaguacccaaaacaucauggguagauaauguuuuuaaaaauguugacugaaaauacacuuugguuugaaauuccagaguaaagaacagguaaagagacuaaaauagcuaagaugcauuguagggaugauacguuuuaaauuuacuuauuucuucagguacaaagaaucaguuacuuuuagauuuagaaagacuguugaaaucaucuacuguaggcacucauaaaucaggcaaaugaggcccaguaaacaaauuacuuguuuaaaauaaauaauccaacaaggauaaaaaacuagaucccuaaauccuaaucuaacaauaauuauaugacuuuccccaaugaaaucugaguuuccugaagguucugaauguaagaaaaguccuaagagaauaccaaauuauagauuauuagcuggaaaagacuuuaaggaaaguccaagcucccucauuuuuauaaaugaaaaagaugaggcacuuacaaguuaaguaauuugucuuacacucaggagaguucuggauagagcaacgacuagaacacaguuucuuugauccuaguccucuuucuacuguaccauacagcacuuuaaacauauuucauucucuguuauaagcaaaauuaauauuuuuacaugaccuggaaaugauaaacuauuuauagcuuagggcuuucuucuccuuuagcacaucugcauaaacaguucuaauuucuuaaaguuaguuuaaaagcaggauagcacacaaaaaauauguuaaguguugaacaacugcaucaaggaugauaaucugcucuguugcccaggcuggauugagugcaguggcacgaucuuggcucacugcaaccuccaucuucuggguucaagcaauucuccugccucacccuccagaguagcugggauuacaggugugcaccaccaugcccagcuaaauuucguauuuuuaguagagacaggguaucaccauguuggccaggcuggucucgaacuccugauuucaggugauccacacgccucggccucccaaagugcugggauuacaggugugagcuaccgcgcccagcugauauuccuuuuuaugaauucuucugagaauacaaacucuguguggguggguuucguuauuuuauccacugcuuuauccugagugccagaacagugucuaauauacaauaggcccucaauaaauauugaauaauucaaccuucuugguagcugauuguuugaagauauucuauuuuucaccaauauuuuacaauuguauuugaaauucuaaucuuacaucuauuuuaguuaucucuuaacuuuaaauaaguuauuacuuuaaaaaauaauauauguauauuuaguguauuuaaacuuaauauauuaaauauacacuuaagaauauauauggacauauauuaauaucuuagacuggcauuaagauucuucacugacaaucuguggcaacaaaauaaguucuaacagagaugcuaaagaacuguguaauucaaacuauguagguacguacacucauuauuugauccauauuagauuuuauuuacauauaauagaacaauauauauuugcacuaaguuguauuuaaccaucuauuguaacaucaauucucuuagcauugaauauaaaauuuuuaugauacagauauuuccuuauaaacacugauaacauugguucauuuaguuuauuuuuauuuaaaaagaaauauccucuaggucuuuaaaauuaaacaagcuaauuaucuaggaaaaaugcaaauauuauucuuauuuagacuuuaaaguaacuuuucccaugagucuucagagggaacccauguaauguuaagaaugauauucucagcaccagcacauuaagcacugcaacaaguuucacagaacuauuuuuucaaaagcucuuccauguaagccaaaauguaauucaguaaaaggagagcuauaaugcguuaaaaugauaugguucagauagcuguuuuugggacuaacuucaccaaaggauaguuuuuagacucuuuagagcuguggucuuccagcuccucuugaacauaugcccuaucaguaaaaaacaauuugaguauacauccuguuuauaaaucauuuauauauuuauaaauuauauagaauuacugcaauaauauauuuuuguauuacagaauguauacacaaugaaaaauuuaaguggaugaaauaacaguaaacguuacuggaaguucuauaauuuucuuccuacauuccaguguuucauugugugcaccccuugggaugacuuaccccauuuuggaacucacaaauacaaauaaaugacacuccuccacugauaauuuuuuuguuuuccuuaacuaagcuuuuaagaaaacauugggccgggugugguugcucacaccuguaaucccagcacuuugggaggccaaggcagguggaucaccugaggucaggaguuugagaccagccuggccaacauggggaaaccccaucucuacuaaaaacacaaaaauuagcugagcaugguggcacaugccuguaaucccagcuacucaggaggcugaggcaggagaaucgcuugaacccaggaggccaagguugcagugagcccagaucacaccacugcacuccaaccuagggaacagagcaagacucugucucaaaaaaaaaaaaaaaaaaagaaaagaaaagaaaagaaaaaauaacacugggcaacauaacuucaagauuauuucuuugacaaacacuggaguacagcuaugcaacuggcuaggguggagucacauauuuuuauagucaggugggggauaaugcggggacugacauccuuuuuugugaguugaggaacuugaccaggacacacauuuggcuagaacucuauuccuucucuacaguggcagaucaugacaugccagcaaaaacacauaggcaaauggauaaugagagccucaaaauucuggcucacaggucagagaugcaauacuguaacuaaaauauguaucuauacauaaaaacacauuaguuuuuuuuuuuuuuuuugagacagaaccucgcucuguugccaggcuggagugcaauggcacgaucuuggcuaacugcaaccuccaccuccugguuucaagugauucucccgccucagccucccaaguagcugagauuacuggcacccgccacuacacccggcuaauuuuuguauuuuaguagagauaggguuucaucauguuggucaggcuggucucaaacuccugaccucaggugauccacccaccucagccucccaaagugcugggauuacaggugugagccaccgugccuggcuaaaaacacauucuuguuaccugucgagacauacagugucagugauaaaauuaaaucucaaaaaucuagaaucagcaauguaugauuuccaacuguuaauauuguagcauuucauaucauuuaauaaacuccuuguaggugaaucuagaaaaauguuucaaugacaauucaauaacaaauacuguuaggcaaaauaguaugcaaaauccuugaauauucacucuggauaaacucuuaagacaauaaucaguguuuccuuagauuuuauucaauacucaucagucaacguauuuuucaagcuccuccauuucuacacuggugugccuccaacuugucgaucauaaauaauucugcuguaauagauauccuuacucuguauguugcucaaauuuuagaacugacaguuauugagagucuaagugcaaacgcugugcuacauguuuuagagacauuagaucaucugauuuucacaacaauccugaaaugauuacaauuacucccauuuuauagaugagauaacuaaggcaggaauuuagggucaaggucacacagccaagacugaaacguaggucuauuucccuucaaagccuagcuccuuuuacuacacugaaaaaggggguuaaaauaacugaacgaauccaaggauuuucaggugaaaugcacauccugcaagugaaagguaaucccucuucauucugaaagcugaguaguauuuuaagcaguaauuacagguggcuaaaaacuaaaggcuuggaaaggaucaagguaagacuacccuccaauuuuguauuauuuuaaguaguuuaaaauuacucuuacucugucaugcccuuauccuacagcuaaaacacaaagcuuaugaaggucaggguugacuucacauucaguugacucuguaaagcccagauuauuacaaaaagcauagcucaacccuccuucccgaaaaucuuugccacaaaacacagcauaauuccaaaaaaauugaauguuaaaagaacuaaaaggcaaauaaacaaaaacuuuuuaaaucaguaacaaacuguccuuaaugaucaguuuuauaauggguucaauguugcaguaaauaauauuaaggguuagaguauaauccagauguucaauucauuccauuaucaaacuggaaaucagauuuaguaaccaguucagacuccagagagcugguucauaaucagauaaugggggaacuagacaacuuuccuaaugauaccaacuacagaauacagauuuuaacuauguaggagaauaaaagccacuuuucggguagcacuucagucuuucaauuuacaacacauuuucuaguuugccaagucuuaggcuugaaacagaccucagaauauaucugauguuagccccuagcaaauaaguauuauuacaacucacuuuauagaagagguaacagaauucuagaucuuuaauaaagggauuggaaucuuucaguuucuuacaguuuuuuuuuucaaccacaagaacacaguuuuccaguaggcaaagagagauguaacguuuacugagcauuuacaaagagucaagcacauauguuaucugucauucucauagaccgcguauuacacaaacagagaucuaggcuuuugcucaaggucacaacuauaagugguagaagagaaugauauccaggucuguccacacaaaaagcucuggguagagcuuguucaacaauuucauaaauaaggauagacuuaaaaaaacacacuggaccuaugggaugagaaaugacacugacucaagccuggaugaaguaaagcaugcaguuugggggagggcucagucugcaggccucugccagcagcagcugaagaaagugaccuuuacuccaaacccuacagugcgacaaaccacccauccagcucugccuagaguggguuaauaugccacaauucgaaaagagaaagagaaugaguguuucaugguggccccagacaguuugguggccgcagaaguugagaaggcucaaaucuggagaucagguuuggguuggagucgugcguaagggagcggaugucacauagguggggaagggagcugacuugagauacguuggcuuaggaagagauguugcaggagagagggugaaaugcacaggcuaggagaguagacggcuucacuugaagggaagggauuggggcuguggaugccucuagaggcaguugucagagggccucuaaaagguccauuuuagaggaagcgagaaggaaggucucgauaaggagccauucaggguccauuaccugcuggaugguuguacaacggccucaauuucucgggcagcaucagcuccacuuuaucgaggagccggugguagguggcccgcaggccucgggcaccggcggccgacaucgccgccgagggaucguuggcagccgggugggagcguggcuguguucucgucccuggcugacaacgaaggggagcuagucacuuuuccugccacgacgacucgcguccgccucucgccuggaguacccuucccgcggcuuucccugcccgcugugaaccgaaaagcugcggcccgcgccccgcgaagguugagggggcggaggcugccgacugccagcccccgguccgccuccggcccccggcaggagagagggaggagccauggcaacaggugccaaaauaaucaccucaccaagucugcgcugcgcccugcuggcagcgcgcuugcgcaggccgagcugcccgccaugauuggcccgccccgaggcgcgggcggggucgagcggaaaccuccuccuucuccccaugcccucgaggccauguuggagaagggaaagugaagcugcgcugguucuacugcccuuucacuuugauuaagcaggcccguaguuaaaauggguuuuugggccuucagugccuaaagaugaugccgcacaauucucuugcuucuuuucacuggagacucgugagcgagagacuacagaauugaguagcuucucucucuacucgucuuuuaucccuagcgacuuaaggaucugguuagaguggcccgaaugcauucuuccagggugagggcagccgcagcacacaccagccucaguccccaggguggucgucaucucgcgagaaaggguuggcggggaggguauccaggacgaggagagggaggagucgccaucgccuccgccuccgccuccuccuguuggaggggggcugagggaggagacuguugcugaucuuuggauguucugguuagucuaagaaggagaguaugaggcgagcuccggcccgggugcggccgggcuucaggggcccaggcgccgcugcugccaccgccaucuaacgcugcgcccuggaggcccggcgcgcggauggugccggugcggcucggguguugaaacggguguccccucccccuccuccccucccccacgcgguggucuccccucccacccggcucaggcagagccaugucucgggguggcuccuacccacaccuguugugggacgugaggaaaaggucccucgggcuggaggacccgucccggcugcggagucgauaccugggugagcgggggccccggggcggaggcgcugaggucgccgccuagagugggggagggggcac

SEQ ID NO: 191159 - RNA, 84124 nt, Homo sapiens
gccuuuuugucugucuuuauuuacagcaaaguacauaauauguggucacuuuguaaccacuaacaauaaagguagggugguaaaaagaaaagggagaggagcaagcaucuuaaaaggggggaaaaaaaagccuaagucuguauuuagcuacucacccugcuccugaggcaggacuggguaggcacucccugccucuaagaccacagccaagcugaccuggaaugccaguccccgguaugaggaaggcagcagaacgcccagagacaaaagauuaaaggggacugagcucuggaugcauccacuuaugcuuugccagacaguucccuuccuuguuuuguuugaaugcuucccccaccccgcccugagcaaaguguaaagggcaacggugguacagaaguacaggcagucccuuccagaagcaguccugaaccgcauaacccaccuaccuagcugcuccucagccugccgaguucuuggcccuggaaucuuuaacaggcacauaggagauuccagggcaggggaaaauauuucccugcaagaggcuacuucccuccaacagcugugagggccagugcaggucaagguugcuaaaucaaggaaagugcacaagggcaagagaggucauauacaaaccaaccaggcuuccggcccuccugcugcccgacugcuccgagguguacacaagccuccagcccgacccagcggccuaaugaaacucuggcaaccuauccugggcguggccacaaguauccagcuccaagcccaagugaggcggggagucaacuuccccaugauugccaaguggccaagaccagaagcagggaugauuaggcuaguucugcggcaaggugaacuggagacccugucucugcccuccuucccuggccugucccacagacaucccguuguuuaacccacugccuuugcaaggaccugcucuguccacuccaaaucaaaggauacuugcauccuucuuacacagacucccaucucucugcucauaguggucccaggcugcccgagaaaaagaaacuugggucaguagaaggcucauuagugugaaggagugagaggccaggccuuccugugacauaaugcuucuaugcuuguuuccuaaacacuugguccacacacaauaccugggcaggaagagagaaccaagcaccacuggauggcucuggagccaggggacuucuaugcacauacaaccaacaucaccccacucugcucaucugugccuccacccugaacagcagaguaccuagauggcaaaugucaugguuucugguccacuaauucuacuccugacucuccauggaaucagagacccagaggcucuuaaaaaacuaagaccauuguuuguuccauagaaagcucaaguucagauacagaguuggccaaaugcugggcugccacggagggguagagccuuccaucccuuccuuguuccagaaacagugugucacagaccccagcagacacuguucauuguccccagccaagccaccaagaauuggugaucauuugacaaggggcagggcagcccuuauagcuguuuccaagcuaggagugggcuauucagagauauuggaggcuuggucccaacaccacagguagaugaggaagcagcuagguaaaggcucagagaugagaggaguccaucuuccaaggcagugggauaaacagccaaggcacuaaaugguuuggcaccugggagcuucaaguaaaguugagcaugcugcccacugaaaagccaaggcucucccagacacgggugggcuucaccugagcacagcccagugccaucaaggccaggggcccuguguccucaggauacuaacccaggccugcauucccugcuucaucucagaacugaucaaggcaugacuacaaggauaaugauugauccugaacugaucuuggugagcaccggcuuucaaaggaggcaucuugggagccuucccuugcuccaaguaggcggcugcugugacugggagcucccuucagagccugcacggucuccugaaagucuccggguggcaagcucugcuggggaccagguuugacuuuuuaaaauagcaaaacagauuuagagucaaacugagcccagaaacggggaaucagacuggauggugcugagucugggggaaaaucuggugugaccagguaauaauggagaccaauuuaccugaauggcucgaacaggcucugagagcaaugggaagaaaagguucuccaaaauguuucuggcaauggcagccacagugggauagcuaagggcacaguccaccaagcacuaggguggucaacaaugaaaugaacaucucuggcucuucugcagucagaaacugaggcucgggacucuauaaucagaacuccuucaggcucacuugggcuccccuccacccagaaugucaggaaucuguacuuccagagaaaacacuaccaccaagcagcagcucucaggaaagcuagaaaucuccaccccaaauauuucaaccucaggcuccaacuuagguaccuaugauuuaaauacucuccuuuuaaauacuuuguaaaaacugcuuuuccgagccccuuuuaugcucugcaguugccauauccacuaggugguauugcaaauaaguaaagcauccuggccaugacgcugcuagugagaaucccugaccaaaguuacucuccucaccucacugcaaaccuccaggaagcggaaacuacuaccccuccacagacagagcuccccugccacuccaugaggcgcugcugccggcaucaguuaccgaagcccucacccacacccagccugcaaugguccacucuauauuccacaauacaggaaaaagcccaaggagucagaucaguuacgccccugggaugcagaaagaaccagugauucuucagauaugacagcaggcaaaguucugcccucuccuucccaucuucuaucaggaagcgaucccauaaaaucucuuccagggaaggaaagaggcagcucuggcuucuuggagagacagagaagcaggagggugaggaaggagucaccaagcuauccaagcagccagaggcgagaaggugggagcagggcaggaagaaaaugcagaagacuuguucuccucagugggccucuucccugaguuugauuuuugaguugagauuuuaccuaauuucaacucaaaaaaaaaaaagaaaagaaaaaaaaaaaagacaagaguaucucucauugacauaucacuaagcuccagcuccaagaguggcaugugacagaggaggcaaucaagguuuuccaaccccauucccaucaaguuccacggggcacucaaaagcaacuggaccuuagccacccucccugucucucacagaugcccgagccuccccacccugggacacaacaggcaauuuccccuuggugaaauuccagcuccaguccuaaaacacucaaguacagacccuccugcaaaauacuuauggcaaacagcuuuacaguauuuguacauuuacacaaaaauagauccuuuuuuauauauauauguauuuauaacugguuacacguuggauucauaauuaggcaucaccaguaguaguuggcacaguuuuguuauuuaagcucagggucaaguucuguuucauuuugucguuccaaaguacaaaaagaaaaaaaaaaucaaaggcauuucaucuccaugguguuuucuuaaauacaguaaugucauaggaaacaguauguacagaugagcagugccuccugaccccuccucugucucuuggagauaggggcugggguccgauggagacgggucaaugcggccugcugcuggacuccgaugccugccucuugcgugaagggguguagccguugagacagccauuggucugccguuuggagggcccuccauucaggauguccuggaugugcugcacgaugagguugauggccacuguggggcagagaccagcagagcguuacgggugcaggcaugggugcaggggugagugugggagucugucugggggaagggcaugcaggaaccacaguagaaagacuuccagggaaguggcucugccacuugcaggcaagucauccaacuucccaguggcucugccugagcuaauaugauccuccuccuucacaggagggcucuaaggaguaagauagacaaugccuaccacagaguaagcccuuaaugaaugggcuucuuaucaggagaugaucagucaccacuggaugaagcacucgggccaaagucugcagacgugguaaccagccaugguucugacacgucaauuagcuaugagaccuuuccaccagggaaccuuccaguuuuccauccuaagacagagcaucccuauggaaggcccucuuucccuccaaaaaauauaaugcagagagcuaucuuuuauuagcauuagaaauaaauuauauaccucaaccaagaggucaauuuaacaucaccaaaaauggaauacacaucaaaugcuuucugaugugauacacaaagaggaccacgccacaucucuccugggauaauuccuucagacuguauaagcucaugaaaccaaucauaagaaaauaaaagacaaacccaaauugaggaccauucuaccaaacaaugggccuguacgccucaaaaaugucuuaaaaaacaaaagauagggaacaucuccagguuaaaagaggucauaucaaugguaaaugucuugaauuuaaugacugcauucugcugaugaauaagaaugccuuuguucuuaaaaaauacaggguuaaauauuuauugcuauaacuuacucccaaacagcucaagaaauaaucuuuuuaaauggagggaaaauuaaauaaauucuaaagagaaugaagaaaccagguccuauuuuacagaucaacucugccacacuacgccuaguccagagacauucauacuuccuagacaggccaaaaaaauaaauaaaacaauggggccaggugcuauggcucacgccuguaauccuaacacuuugggaggcugagauggaagggucgcuugagguaggaguuuuagaccagcuuaggcaacauaaugaaaccaucucuacaaaaacacuuuuuuaaaauuaguggaccgugguggugcaagccuguagucccagcuaccgggaggcugggcccaggaauuggaggcugcaaaugagcugugacugugcuacugcacuuccaucuuggugacagagcaagaccucgucucuaaaguaaaauaaaauaaaaugaaaaauaaguacaauaaugguagcaaccagcucccuuuagaaagggcuaccgugauggcaggucauucuaaauuagaucaaggagggaaucugcuuuugcuaaaagguggccucagaagcaaaguacccaagugucaucauugggaagugauaguaaaagguaaucuacagcccucuauucugccagagaagcacaagugcaugucuguccccguaacacaugggugccuacacccagggaccuguuccugaggccagacguguagguggaaagguucugcuggcucacaaucacagacaagcagggcagccaugucugcagagcccuguagggucaccacauccugccccaaauuaugacugacaaagggcagacauuauacuccaggaugacacucugcagggacucacccagauuaucugcaccucuagggaugaucacaucagcauacuucuuugucuguggagaaagacaguuaauaugcauuaauacaguuaagagacaacuggcccgagacccucuccaagggaauauggggaaagggcagcauucauacuagcgagcccagaagagcaccuuuuaaggcuucaaauauaauauuguuuacaacuucacagugaaugcaucuauuaauagaaauuuggggaaaccuaaggaagugccuuguuuagcugaaaugugaaugaaagaagauaagcagggaaugaggaaaaugagaaagaaggauugaagacuuucaugcaucagugagggaaaaugguccagacugagugguuaauccaaaaccaguucauaauucgauugauaacuaucuaccauggauuuuuauccacuuuaucuacauuacaagaauuuagcuuuuauucaaauucucucucacucucucuuuuuuuuuuaagacagcgucucacucugucacccaggcuggagugcagcggcaucaucacagcucacugcagccuugacuuccugaguuggggagaucaucccaccucagccuccugaguagcugggacuacaggcacccgccaccacacccagcuaauuuuuguuauuuuuuauagagaggggguaucgccauguugcccaggcuggucucaaacuccugggcucaagcgauccacccaccugggccucccaaagucccaggauuacaggcgugagccacugcacccaaccaaguucucauuucuaacgcugaacacuguuucagcuuaugaccuaugcagagaacauggucuuugaagccaaacacuuaauugccucuauuccacuaggacaaauaugaacuagaaaaacccaaacuuuccaggggacugguucaccuuggacuuuuacacauagucugaaacaugacacuguucacuccuagcacaggguaaaaccagaaaaaguauucuucacugaugaccaguucauagguucuauuauuacccaauuuuuaaagaaagaaagucaggccacaaagaggcauauuucuuuuuucuuuuucuuuuuuguugguccaaauuuacugagauuuuguagaccauucuacaaguaacugcauccuggcauacaaacuaagucuagcauaagaacacauaaaccacaccucaagcaugugggcaucuuacucugugcagccucugcccuaggauugcugaaaggcaacggugucagccccaaacccaacuugaacugagcagacauuuaucagguccaaguuccuggcuuacaggggaaugagcugaucuucccugagcaaagaguggcuggacaguggaagcaagcagaaauaacccagaaaacgucugcagaauuuuuagcuuuguuacaacuaaguuaaacguagaaaacugacaguuaaauaugacugauauccaauaauaaauucauuuuguguucuuauuaagucaaaaauaacaggagagguccucagauagauaacuggguggaaagaaguucacagcuccucagcccccucuggucucuuuccaguaaccuacucuuguaacucaauagucuccagggcaauggauagggcaucaauguuacucaguuggcucaaaaaguccaccugucccgcauuuaaaccaaagucaaguauggguugcuguaaaagcuaguaacauccuuaaagaaacaaagacaguuugagauauuuucccagaagaaaaagaaugaaguuuauuguuagaauaaauagggaaauuccaauacccagccuuacucuaaaucuucaaugucuucagagauuccagccuucccaguguaucucaaccaagaccagguuaagucccaagcucuuccuucccuuccucccggucucagagcuuaacuauaaauaauucaggagccagaccaugguuuggccaagcuggagaagacucauugacucaguaggauucuccugaguuaaauacuucuccuucugcagccccagcacaccacaccucuugucucugguagccuucccucaacaugccccuuccugucuuuccugggcugagggccaacucucuguguucuuccuucucugaaagccaccucacuagagaauuccuagcugccacaggaaggacuggugagucugcaagggugaagggaaggaagcuuauuccaguaaggcaugacagucuccaaaugggagcuaaagacaagcucaaagcagggcucaguggugauggcaggagaggcucagaggggaacaucucggggcacagcacccagugcauccauacgucacccauugcagacccuucagagauccaaauggcugaggacucuccuuggauaugauacacccucaguaaacggucucacaccaugaccccaccaagcaagaaaccuagaacuagcugggaauuaaaugaccugccuaaggacuggcaggacccuacagggcuacccaaagaaagaacagcaggacagggcuccuggagaacacagaggacacaaggaccaagggcugcccucucuuaggacuucaggacagaggaucacucagagagaggagugagauucaggcaggggagcuccacaaacuugcacaccuucguuuauaucaucaaauuuuaaauucuacauucaacaaaaacaaaccaagaacacaacucacuggcaagcagaauuccucaaaggcaggcuugacgaacguaauguacugagauaaaaucugcucaagaucccugccucucucgcugaugucccuuaauacuguaagagaagggaaaacaagaaucaaaaaacgguguaggagccagcacacacccgcccuucaugggguggaccuagcucccacaggcuccacaauuacucuagaugauucucaagcuggaauccugagaggcuugaccaagagcagaucagcagcggcuucggaaaagacaaguuacauucugacaucuuacaauggucaaacuuggcaaugacacaaugcucuuugaaacaaaaggcuguccauggaggccaacagccuucuuguuucaagcaacauuugcuccaaacaaaauuucagugugaauuuuuuaaaaaagcagggcacuccuggagagcucacuguuaacaagaagcaaucugggccccgagagggcugggcugcacgcugccuccuugcaugcacuuaccugcguucagaaguccagcgacccacugaucaggcaucagcucacugcucccagcucccacccaugcccccucugcagcauggagcccaggccaggcugaggacccagccaugguuaaccauuuccaccuaccucaugcacagagguuugccaaaaaaaaaaaaaaaaaaaaaaaaaaaucacucagugaaagauaagaaaaccauggccuagagaauggugggcuggggcugagaugaagcccaaauugacaacaaacucaccaucuucugucuucuaccuucuucccccggucaguuuuauccaggggcuuuuaccauucuuuuuuuuuuuucuuuaaaaaauuuuuuuuucuuuuaauacaaggugucuugcucugucacacagguuguagugcaguagcacagucauagcucacuacagccucaaccuccugggcuugagcaagugauccucccaccucaacuucccaaguagcugggacuacaggcacacaccaccucaauggacuaauuuuuuguuuguuuguuuuugagacagagucucaucacucugucacccaggcuggagugcaguggcgcgaucucagcucacuacaaccucugccucugggguucaagcgauucuccugccucagccucccgaguagcugagacuacaggcaccugccaccacgccuggcuaauuuuuuguauuuuuaguagagauggggguuucaccguguuagccaggauggucucgaucuccugacuuccugauccacccgccucagccucccaaagugcugggaauuacaggugugagccuuuuuuuuuuuuuuuuuugguagacacggggucuugcuuuguugcccaggcuagucuugaauucuugggcucaagugauccuucugccucggccucccaaagugcuggaauuauaggcagcccauacacucuuuauuaaauagagucuucugucaauaaauagaaagaagacugaucacccucauucugccgcuguacaugagccuuaguuuccccaugaguagggaguuuggaaguagauucucuuaauuaaaacugccucucuuugcagaugucauuuuaaaugcuaucuuaaucuaaccuuaucaucugagcugcuaaaucuuucaccccaaaaaguuaccacauccaucuacaaucauuugcaguggcucuucagcuccuucccaaccauuucucaguaaauagacucaaauguugggugaaacucacuguaaacgaacaugggguauaucugugacggaacuucugaaagccauuugucuaaauaauucugucuuuauacacacaugcacaggugcaugcacagagaggccagggaacggggaggcugucauggcuaugauccaggcugacaggaaaucuauaagaugagaaggugagaaaacugucaggaaauccacauuuccagaaagcugggcacuaaugaugcugccauucgacuuuuguaacagcuccucgauuuacgaaguguuuucuccaugggagaccugguaauaaaacaguuggcugaucgcuaaugugucaggacuugcccacccagcccagcagcagccuucuccagccaggaaaugguuuuccccaccccugcaacgcuggaccugggcuccugcugccgaccugcugcucuggcagaucugcugggagacucgcuaagaaggagcccuaaggagcugccacguggcucaccccccagaaguccccagagcuccggcacacauggcuaaccagaguagcaccgccaaaacacacagccagcgcggccuccaauucuucacacgucuccagauaaagcccaaagaaaaaaggaaaccagaucaaaaggguaucagagcuagggaaaaaacaaacacacccgugcuugggcagcuuuuacuuaaagcccugcaaacgccugaugcuggauuguuuugcaacacaugcuuuucauacaauugcugaaggcuuuagcacuggaggaagcuuuguccuucucccagcacacacacacacacacgugcacacacacaaacacacaugcacacaaacgcacgcacgcacacacagugcacguccacacccugucacguaguccuccuaacugcccucagccugggccuucagcccccuuccuucuguagaucugguggcuucagcuguuuugucacuggagagaggaaacuggucgugcagaaaguaggaggaggagguaaaucacagugaagcugcucuguagcccaaaagcugcuucuuguucuaccucuaugggcucuggggggaaaacugcccuggaccugaauccuaaccccaauaacuccuaccucugugaacuucgacaagugacuuuaaccucuuugaaucuuaaguuccuuaacuauaaaacagggacaauaaugguaccuuccucauacaguuacuauucaggaauacagagaugugcauaaaacucuucagcaccauagcuggcaccuuagcacauguucaauaagcauguguucuaugaugauuacgaccacaacagaaccugaggacgcguugggagggcagugccucccugacagagcagcucaacaccgugggagcgcgggaaccucgaauucagguaagcaggucagacccagcugagcgggggcagcaaagggaaaaaggagucccgcagggcagcuggaaaggcagguugccacgcgggaagggagagcaggacacaagcacauaggacaacauacgugaggaaggaaaaaaagcaaggaagauagggaauagucccacuacagcuuccacgcuggaaaagcaaauggggaaugggucagaauguugcccagacacugggaacaugcaacaucauaaggccuugcccaccucugcuccccaagaaccuccgauagaacuaucaccucaggcagacugugccucccugagccaaggacaacagagggccagccaguucccugcacugaaaggcccuucuccucaggcagagucaggaaacagggccgcgccaaggacugaguccaaacaaggucuuggcacaaccuggaaaccccaggggcucaaaaccagccccuccaucacugcucugaccccagcacauuugcugggccaggacaggccuuuucagaggacaggguacagggcaggaagcuacaagucugcccacauucccugcugggcuuccacgucagcccuuccaaacccagacuugcucuuucugguuagccaaaagccaagaaagaaacuuagagggacccaaaauaaagauaauuccucaauggugaagucaaucacuuuaaaaaucugaugaggaaaugugcuacucuauaguaaaagaaugggcugaaucccccaaggcccagugcagcccuaauucuaugagaaccagagaaugauggaugaggaagaugaggggucagccauccugaaucucccugccccaccuccucccuguccccguauucagagcuggguggugguaaagagcacagagggaauaugaaggcaaaugaggcuagaaaccaaucccgagaagaucaaggguuuccaucaggaaggagguaguuuccagggcugcuucacucaaacacagaucucucucccacaugagggucaacucagaaucuggaggucacaugcccaggagggugugacagauggguaaaaucauggagcuaacucaagucuccaggaauguucaagcucacucaacagcugcuucugacuaaccagccucccuaccccagcacccccgcacuccacaaagcacaugccaagcauguuuuuuguccuacguggagagagaaugaauuuguagaaauagcaugcagaaaagucccaugaauccaucaggaaagugacucggcaguaggugacaugugaaguuagcagaucugaaaugagaaagcagagcccugcccaggcagccuguucagagaaggcggagaggcagagcuggcccuaagaaacccccagagggccagcaccauuguaggaauugcuccuauuucacauaagaaucccaugcaagaaaggaagggaaaauguucuguugaaaccacaccgugaugaucuguuugaauuagacacuaggaugcacuuuauuuccagcgucuugcugcugcucaaaacuugguucuaaucuccugugcugguuccugcacucccugcugcgaggccucccucggcagcacugcaucccugagacugaguaccacugcuggacuagugauggcaucaguccgggcaucacuagcuccugaggacaugaccggagcagauccccuuggaggaucuaaccagucuugucagaaaauucagaaaacgaacagcaccgaccccuucagcagaagcagauuucugaucugccacauagauauuuauugacuaaugcaccaccaggcauuuuaccugcacuaccucucaucuucacaacuaucccagaaguaccaaucauaagaccacauucuaauaggaaaaugagauacaaaaaaguuaaaacacaauuugccaauuugcacaauuugccacacaucuaguaagugguaaaaccaggaucucagcccaauucgcuggacucuaaaauuuaucugucccuguguaucacacugccucucuaauuugacaagcugacauggacacugagcagaucaaccaaagcagggccggaguuuguggauuaaggugacaagccaggcccuggggcagaagcaugagggguugucaggcucaggguucaauuaucuauccaaaaugaccaugcaacucuuacccagccagagucgugacacuaaaagcaggccugucuccccuguauuauccauaaagaaacccaagccggggugucgcaagagccuagucacaaagcuagcugggaagggcucugcuagaacuaaaagucuccucccauuccauucuuuuuuccaucacacaaaacuaacugucccucaccccaccugggagcaagauguagcucccacugacuuaauagcauauguaucuauuacuacuuagaagggcaaagcucaggacuuguuucuguagguucuacuggucucaugaauaguucuuacaauuacggugcuaaaugggauaaacuacagaucuguuucaugaaccgaaaagagaaaauuacccagacuuugaagucagagggcccugggauacagcuuauaauaucugaaacugucaauaauguguccugugacuaggagcuaaccucgucauuuccugugucucccugccucugucacacaacggagacucaaaccuucucaccuuucauuccucuauucagucgccuccacccacugcccuugcuggguccuggucgauucuaacucugcuaauacucuucucaucucaacucugcucccucucccacccaucuaaggaccacagcccugccucucgucuagaucagcagagcagucuccaaagagcugcuccagcuacaggcuucacuuacauuuccuuugucagaaccaguguccaacacagaacaguggccacuucacuugccucgcucagaaccucacaguggcucucccuugcccaccgagaaccagacuagagaucucagucucuaaaaccagaccccaaccuacuuuguagugucucuucguacaacccucuguacacuccagguuccugccacucucggaacaagccacugucuguacaucucugccgugcaccuucauggguugccuauagcgucacccuaccccaccacauccaagucccaacccuucuuccuccaugaagccucccaaucucuccugguggaagcgaacucucugcugaauacccuguagagcucaguucacaggcugggcuccucuaccaaggggcacugcugugccuucagcacacaagcacagggacuuagcacaggcaggcccacacuuaguagggccugcggagggcacagcugacuucccuccugagcugacuggaaagagugauaaugccuccauaaagccugcuggaaaauaaagggcuagagaagcaggcuaacaggaugagcugcccaguacuucaggcacaggggauccuauccucggggguccuacaguuaguuccccaaaucagagcaucuucauuuugaugucuuauaaacaaauugcaaggaacuaagcauuuaaucaaacuuuuccaggcaaaaccagaugucagugucuuauuuagucucugugaccucacaagccuuucguuaucccaaacaguaagugacuaaucccuucucaaauguuaccaagugucugggcagcaggauauccuggggcuggacugacgcagccgggcuggaccaugcgacacacagcugccucagggaaggcaugggcuucagacucaggcgggugggguccugucacaggcucccagcucccccgcccucaagguggccaccaacagggccaccugaggcuuuuagaacgcaccucugcgugagagccggguguccgcaucuguauccacaaaaagcuucaucuggaacaggucucguaccuccugggaguagaaggccaggaucccuucaaagagcaccacgucugcgggauagacaguaacugucuccuccuuccugcaaagcacagagcagauaaugggccaagccaggcaggggcuagcaagggacagagaacaagggccagaacaucuggcugggcuggguucuggguuccuugcccccacagacuucaagcgggggcuaaagacuuggcuaauauggucuuacagagcccucggaccaccaccaaagagccaagggugaucacggccgggacaaaggucuccuuugaccacuucugagcuuucaccaugaaacagaaauacacggcagacauccuucuccuuggaauuaaaaaaaccugcuguugaaugaagaauaaaggcagacaaaaacagaugugauuucuuuuuuucucugaaggcgucuccaggaaugcucucauggccuggcauuuauggaaccuaacacucugaacuuuaaaaacagaaacucacaguuuucucucaacaacuccauccccuccccgccaguccugaggcaauugaaaggagggaggaaaggacagaaggggaagggaaggagggaaaauaaagaaaaguuuugggaaagaggauacagacgagaaagcauuugugaggaaguacagaaucccgacgucugucuggucuggcucuaccccaaaccaacaaaguggccacaggucaauccugagcucccuagagcugcucuuccuuaucaauaaagcagaaauaugcaugaccucauccacccaacccacaugguuggguagccuagggcaggcacuaauuguaaacaugacuuuucuuucuuuuucuuguuuuuggagacagggucucacuuugucacccaggaggcuggagugcagcggcgcaaucuuggacucacugcagccucaacuucccaggcucaggcgauccucccgccucagcccccuaagugucuaggacuacagaugcacaccaccaccccaggcuaauuuuuguauuuuugguagaaacgggguuuuaccauauugcccaggcuggucuauaacuccuggacucaugcaacccacccaccucagccucccaaagugcuaggauuacaggcaugagcuaccaagcucaaccaacaugacuuuucaaaaagcaagaagggugaaacauugcuaaacgguuaggcgacgggcugucacagauggccuugcuugugcucagcuuugccuugcugcagcuuucacuguguuuugucuuuugauucuguccuaugcccaccuuauaugucaccaacugccucuugcucaaaauucacugaaaauagagaaauaaucaucauugcaagguuuccacucacccugacuagcacacuggcaaaccaaauaaaacaaagucucuuaaaacaguaguuccaucugugcaaacauaaggaggucaguaucaacggccagcucaagagggugccguuggaacuccuucccauaaacacuuccugaugccuucucagcuuggaccaacaggcuugugucugaguuuuaaggcaggcacugcuaggguagcuagcaaguggcagaacggggcagggaagacgggaaaaaaggacuaggauuaggaaaugcccuagaauugugguguaucugagaugcauaucagaaccaucugggaagcuuauaaaaauaucccuaccuggauccuacccccaaggagcucugauuuaaugagucugaaguggagcuagaacuucaacacuauuuagaagcucccaagauauuucuaacaugcagccaggguagagaagcaccagucuagaggaaugucagcugccagaaaauggugugcccauugucauugugcauaagaaggcaaccuagagaaguucagaaaacagaaccaauggguaagugaaauagugagccacucucuaggcaacuccccuacaccaaggagagugugggaaggcuuuguccaaaaauaaagugaauguaugugcaagaguccacuugaacacacuaacagagaacacaauggcugcacuaaguuuacauauccagguuaaguaucccuuauaugaaaugcuuagguguuuagaauuuuugaauuuuggauuuuuuucagauuuuggaauaucugcauuauauuuagggcaucccuaauauggcagggggagagaggaucuacaaugagccucccuaacaugaaaauccaaaaucugaaaugcuccaaugagcauuuccuuugaacgucacacuggcacucaaaaaguuucagauuuuggagcauuucacauuuuggguuuuuagauuagggauguucaaucuguacugacacuagauauuaagagcauuuuaggaugccuaacugauaaauacuaaaaaggaaaagugguuuuccuucggaaggagaaaauuaacugccuaauuuguugguggugccuuaagaaguuagaauuaaucauuucccaaguccaaacgcaggucuaaaaacugucauaacagcucagaguuuuuaaaaaacaacaacaaauuuauugagcaacuacuagcccagaaugugcaaggagucauaccuggcauaauauaccacuuaggaauuuagagucuggcugggaagccccagaaagaaacuagccaauuagaucaucugagauaacccagucuaaccaucucauuuggcuuauggggaaaaggaugcucagagaaauguaauugcaacaaguaaaugucuucuucauuuuagcccaacaaauuuuuguuuguaccaaacgcccaugggugggauggaaucaguuaacccugaauggcucgauguccaauuaaguggcccuuaagauuugcaaggagguaggaaagggguggauaugggucuagggugaucagugaaaguuucuaagacaugagcuuugagccacuaaaggauaagguuuuaaaauauaagguaugagauaaaucaggaggaaacgugaaacaugucugcacugggaauucuaccaggauuuucuuuuguuggcauaucaacuugauggaacucaugaugcacgaggucuucaacuucccuccuccacuccuagacugcacuggucaggcccuggcuccugucaaccaugcucaguuccacugcuuucuuucaggcccuuaucagacucucacuggggcuguuccaaaggcuucuucacaaauggcauugcagauccucucuccuccugccaccacaaugaccuuuccacuacaacaauagacccgucuguagcucccuauugccaaaaugucugugcuccuggcccugccgccuauggcccuucaugaccugaggucugccugccuucccacacacccacucccauuccuccacaccucuccacugccaugccccaaccaagcugauccaugccuagcucugaaaugcuucccuacccagcaccuuggaaaucccuuucccaaacaacuucuuauccuuuccuaucuaaagcuuaaauaucaccuccuccauacaaccugcucugaauccccugcucuuccucccuccuuuacauucuucugcaggcccuugccuuagccaucaugcugcauuuuaauucuuuacuugggaaguggugggcuggaaugucucuugucaacgugacaccaccaccacuucccccuaagggagaacuacaauucucagaaucccuugccccacaugcuuccagguuacuacgccaacaagagacuucgaaggugagagugaagcaaaauccacaauauucaggagaucauaauacugagacagggaaacuuugcaaacaguccauaagcucccagauugaggcugcaaacccagacauggugguuucuuggacuuuuccaugaaccccagcuucugcuccagugccucaggcuagagucaguggggacuauuuugucugauucucugacuauaaacuuccaggccuucacucucccagccuugauguucguguaagcuccaaauccuauacgaaaugccuucauucauuccuccaugaucugcagugguuggguuaggaaaacagagugacacgggaggcgugaggaugguauccugaucuuucacucuccucucuccuacacagaagaaccuggcccauagaaggaaguguuucagaagauucuggugaggcauggagguaagcaccaaaacagcccccucuacaccucaacgcacacacaugcaugcucauucucucucucucucucucucaucuuccuccugcaaccaaaucgucaccaugcucucuaguucagacucaugggaagauguguguguucuacauucaggucugagacgcucugaaggagccuggggucuggccagcaggagugcaaucuucuaggagcccauucccaucacucaaagggaaggaggaugagguggaaguguggccacuccucuauuccuaaucaggagcacuaaaauugaggcuucacuggaaaggacugguuugauuccacugagaagcuuucuggagggcuugguuaauucugagaucacgaucuggugaccucaugccucuccacauuguccaaucccaaguaaaccaggacagcagaaaaaacaguuuucuuugcucuucuuccugcccuuccucuaccccuccccuuacaucuuguuccaggaacagcagcacuggaauguggaucagaaugcacaugcagucccucaagcugaaaucacuaucccauccuucagaguuaaggaaucgugacaacaggacuguuccagggagcgcucagaugaacuccccaaccucuacaaucccacagcacacacugcugccaccacccacuccacugaccagcuggaauggcauuaggcagggguaggacagaggucugaagugcgagagguaaggaaggaggucucagugcagaccagggaugcucugcggagcagugggugccaucccuggcccagaacagcucacuuaccgggaaugggagacaaagucauacacggggaucuggacuguuuucccuucagugauuucuuugaguguuuugagaaugaguucauugucaaaggcaucugaaaaauaccaaauuguuaaaauguuucuuaauuuuaaaauaggaucuccuauaaucauacacaaggcauccucauaaacauguauaugggcacaucacacuuuaaagguaaucauacugcucccuaaaaagcuggauuuuuacccaaagcagaauggaugcucccuguaucucaaaauaggguguauaaaugaguucugacaaauagauuucuuuuuucucuccuuugacauuccaucccugacuucagucaguucuuuccccucuccaaguuuagcuguuaucauccuaggauuggcacaugcuaaacugaccuggaaagcaaacccaugacugggggaguacacacaauaggcaccaugcccagguuugcuucuaacaauuauaagaaacccaagccagcuaaaggagcagugugcugaucuagggcuguagggcaaaaaccacucuggcagccacccugccccuccaucucccucucugccagacaguggguugaacacacauguacaccugaggaggagggucugacgagggcugccucagaucagaggcagcaggacuagcucuguauguucgaccucaugucuggcccaucuugagucccaggcucauacaaaaucaccuuuguucagauacagauucaaucaguauuuaaugagccaagcacuacuugaagcauuugaaaauuccuucuuucacauaagccccacaauaacacugcaagguaguuaucaagucccuacguucuagauagaaacaagauuccgagagguuaagcaacuuccucaugagcaaaauaaaacuauuccccccaacacaccaauacagauacauacccccuucaaugcccgacucacccggguggucaaaguugaacuggcccuucagggcuuuggccuucugcuccgagguaaggacacgguagaagcuauccuggcucaggaugaccaccugcuucuggcgauaguccaccucauucugccccaggagcugcacgaucuuagcacacacggaagacugugaggagagaagagagcacccaggaauaagagaaagggcacgugugguacagaggaagucccgagaguaaccaagcugaugcacaccuuccaagaaggggcucuggaaggaagaauccaaaggcagcuaucgugcaugaugaguuaaagggcuaagggaugcagccauaaaaagaauaagaucacgucucaugugggaacauggauggagcuagaggacacuauccuuagcaaacuaacacaggaacagaaaaccaaauacugcauguucccacuuguaagugggagcuaaaugaugagaaugcauggacacagggaggggaacaacacacacuggggccugcuggagguggcgggugggaggaagcagaggauaaggaaaaauaacuaauggguacuaggcuuaauaccugggugaugaaauaaucuguauaacaaaccucugugacacaaguuuaccuauguaacaaaccccugaacuuaaaaguuaaauuaaaaaaaaaaaaaaaaaaaggcuaacggagaagaguccgccuuacacgccugugacagagaagucuuaggauccccaaaguuccuuccucccuucccuuaacacagcuuacuacugucagguacuugcagugauggugggggaaggagggcagcacacaccaccuccuccuccagaagagccuuucccagagccacugauaaagguagggcuaccugauccugucugcuugugcccugguauagacagacaaaaaaggcagcagaaaguagaaugaaggcauggugaugaugugcugaggggcuacagggccuuggaaucacaaggugacugcacauccauggaaugccacucagccccugcacaucucuuuauaucaacggaaccaaaaaccauggccagagagcucagcuaguuagcaagaaggcuaugcucacagcguuaauccuacuucuguugguuacuuuugcuccaguccacagccaugacuucacaucuacaguaaaccagguggccuuuucacaaacgugugucaccacagacagggugacaaggaacacaaacaccaccaacaucuaaaacaacuuaggaguaucccaaacaagaguggagaagccaacuccaaaugaacucaaaccuacaugcuuuguguguuguuguuaguaauacauguauccuaaaauuuaaaaaaaagaaaaacagauaguaauacaugugucugccccuuuuucccuucaauauacucuucguaaaaggaacauuaugaaacaagugcauucaauagaaugagauagugaaggauuguauuuaucaaauaacugauuucuuuuuucauuucauacaaagacuaauguaaaaauaaaaaugucuguauuacacaagcuguaggagacauaacccaagucuucuaaugaaacugauugaccugccgggcacgguggcccaugccuguaaucccauaacuuugggaggcugaaggggguggauugcuugaggucaggaauucgagaccagccugggcaacacagugagaccccaucucaaaaaaaaaaaaaaaaaaaaaaaagaagaagaaagaaacuggucaaccgaauaaauagaaaggaaaaacagcauauuuaggccaggcaggguagcucacaccuauaaucccacaguuuaagaggccaagguggguggaucaccugaagucaguuugagacuagccuggccaacauggugaaacccugccucuacuaaaaauacaaaaauuagccaggcaugguggcacaugccuguagucccagcuacucgggaggcugagccaggaaaaucgccugaacccaagacacaaagguugcagucagcugagaucgugccauguacuccaaccugggcaacagagugagacugcaucaaaaaaaaagaaaaaagagaaaagaacagaacagaacagaacagaaaaacagcauauuuagagguuugaugacucaaaucuuagaaguuuuacuauugaauuuauuucaucaacgauuuuaacaacaacaacaacaaaaauaugaaaucuuuuaaaguuacaauucuuauaaaguuguguuugauugcccugagcguaaggaaaacuggccauuccuguugcacaagucagugcaaacuaaacagcucugcaaaauacguccuguuauacaagcugugacacacgacuaaguaaggaucuuuggaggaacaauaauauuuugacucaauuauuugcaaacaauuuauuucgccuucaugauacuuuugcauauuaacacagaaaaacauuuaaaacuacucuggacuuugggaccacagauccucccaugccccaaaauaucacagaacaguaaaacuuucauaugauaaacuagauucaaaagugaaaauguuacaaaaccaaggcucucugggugcuacagauggauggguggggggggaaaucaaaggcucuaagcaauuauaaacuauagguuuuuaaacaccuguaggcccucaauuuccuuuuccucccaggcaucuaucuuaggacguuucuuacguccuaagguuguaggaagauaaagucugcagccuuuauuaguagauagaauuccuccuagaauuccaaagaacaaaaacaaaaaagugauucacgaagccaaauguauauuaucuaguuauucaaauugugauauuuuuauuuauauuuaaaacccauaaaauguuuuuaauguaaauagcaaucccaucaccaucaaaaaagcauauuaaaaaguuacacuaccuaauuuugcagauaaacuacuguuucccuuaacccagcacaaucuaggacagaaccuguacaauggccaguaaaaugggauaaugaacauacaguaggugcaauucuagaaaaucagcgcucaucccaacccuugaucaaugauacaguaugacuaauuguguugaucccccgcugcauguuucaguccuguguuuucaaggaccuggcuggugacccuucccuuccacaaacacacuaccacugcuaacaguguaaaugauuacuuauuaggcagcagucccugugccaaacacuccauuaugaccaccuuuagaagccacaugugcucuccuacauggaugaggaaaccaaguuaaguaaugugguuucauagaguccuggcucuuuaccucaaccuuagauaguaagaagucccaaggcagaagaagcccuuuaucaggaaggagauaaauaaaauugcacaaauaagcaaagaaacaccugccucuagguuaaucuagauuguucaggcauuuucuuccuccugggccauauuacaaaugggcccuaaaaaauccggauaacuguugaaucuggcugacauguacauaggguuugguuauaucauccucucuauuguuguguagguuugaauuuuuaccugguagggaagaaggcagggagggaaggaggagucccacaaagagacucuacucugcccugaauaaaugcucuuucgcuuacuuaacacucaccucuguaucucuuucacuaucaucucuguguucuccuuuugccuaauccugccccucucuucaaaaggaugaaauggagcucugaggugucaucuuguuccuuaagaauaauucagcugggcacaguggcgugcaccuauaaucccagugacuugagaagcuagggcaggaggaucacuugagcccaggaguucaagcccagggugggcaacacugugagaccccaccucuacacaaauucagaaauuaucuaggcaugguguuugugccuguagucccagcuacguguggcaggcuaaggcaggaggacugcuugagcccaggagaucaaggcugcagugagccaugaucaugccacugcacuccagccugggcaacagagcaagacucuaucucuaaaaaaauaagagagaaaaaaagaaaagaaagagaaauaauccaccaauaaccaggguuugagaaggcaggcaauccugagccuauagaaaucuaaaaugggaaaggguacaacuguuacagugggcuaagacuuaacaauuauauuaauagucacaaaaagacaaauaccauaggauuucacuaugcaaagugaaaugcacuaugcaaagucaaauucauagaaacggaaaguuaaauggugguugccaggggcugaggggaggggaaaaugaagaguuguugaauggauuuuauauaaugaaaggguucuggaauuuggucauccaauaaugugaauauacucaacaccacugagauguacacuuaaagacgguuacgaugguaaauuuuauguuauguguauuuuaccacaauuaaaaauuauuaucacuauaauaaaagccccauuucuuucuauaugcuagguacugggcucagcacuuuaaaaugaucucauuugcauaccacaagcuuaugugaugggaauuauuaucauauccacaccacugauggcaaacauagaggcaaagagagguugaauggagccaggauucccacucuagccguccaucuccagugccuagacacuuaguggcugcagcugcauagcgcugucucacaggcaaacugacacugcccacuggagcgugaguucagcuucauuuuguauaauaucucuauauuuagugaaugaauccagaauauauucugucccugccacuucuaacacauuacugaaauuggagucgggaggguuaaaggucugcuaggacuguuggguguuguccaaauacaaaguuaggugaaggucaauacaagguauuuuaagaaaggaaaaaacaaaaucuauggaacaaaucagugaaggugauucacaauuucuuuacuuacauggcauucugaagacauuaucucauuuaauuccauuacaacaaguauuacuuugucuucuuuuuuccuaaugaggaaacuggagcuuagaaaauugaucacgugaaaugauuugcucagucccaaagcugagucucaaaccauaggucuaacuccaacugcacaauucuuuucacuauuuuagaacauaagccgcuuuggcauucaccccgauguucuccauaaauguacuuuaccucuggaaaacaaugacaggggaagggagacagggagggaacugaugagaaauauaauacuguuuugucccacugcaucacuaaagucaacauuuauguugaacuucauagaacuaaaggcaggcaagugaugugccuauuaaaaggaagcuaaaagcucaccaagaaaaccuguucuagaaauguuuauuauguucaaaagaauccagcuguuaggagccaggguccacuagacaugcugaacaaugaacuccuuuagcagagacuucccauuugggaagccccaguggcaguaaacagcucaucaacaggccccuucggcuggcaguuuccaaaagggcagcuguugagccagcauagguuccuguauugcuacacaaaggauauuucucuaaaaucguucucacccuggagguggcucugacagccuaaacacaaucuuacuauguuaguucuagugugugucuuccaggagcuaauccauaaaauccucuugcccaguuccaagaccacugaauaaauaaaagaaaacaagcaggguaaucagcucugucgccucuuugucauauacccuccacuacacuucagugcucagaaccugacauagcccaagccuggacagcucagaacaauucagcccuugggagggcgucggguuaggugugucccuacgggaaugggcuggcacaccucacagucauccuuacagaagaagaccagauaaccaugcugcccaacauuuuugaaucccaucaagaugucuguuguaacacuccgaaugagcugcuucagaaucacagggagggcugcucagagggaagaaaacuuagcaaccacagccaaucggcuccagguugaggcacacugauugaucauuuccucccugcuuuucaggacgggaaacaacaucacagcagagaagaaugcuugaaggccagacgcuuggccuccucaggcaggaagaucccaucuagcuccuuggcucugggacuaugugugggucacaucaauuacucuuggcaguagcuuucccugucacuaucauaaaguaaguaucaccacuagcuuauaugguauccaucucaaaggaaaaaaccauugcagcccccagacauuacaucacuccuuugcggguagggguugcuccccacauggcucagaagcucuaauuuacaggcauuagaaaaccaaagcaccaguaauuugcccugguuuaaaacuaagaacaagguucaaaccugcuggcucaacuuccaauccaacugauuaaguggcacaauagagaggugucacucaaaugcuucccuggaauaucugcaaagccaucuauucuuuucuuuuuucagcagcaagauuuauugugaagaacgaaagaacaaagcuuccacagcauggaaggggacccaaguggguugcccuaggccaucuauucuugaagucaugcauggccccagagcccaugcauugcugacuaggagcuccuagcuacaauacaaucaccaccacccacccaugccaccacauacaggaucuaaauuaaaaacucacuaaauuacuaauaagguucuucaguaccaaaaagcagccaugggucaaucaaauaacugaagagcuuuuggagcacaaggaccaauagugugacuaaguuuuuauucucaggcaccuggacuggggggugggggugugucucccaaaugucuguuaaauagaaaugucaaaauuuaucagaagucuuuuuugaagucguaacaucuuagcucacugcagccucgaacuccuggacucaagccaucaguccuugaauuuuagcugggcacacagacugcauuuuucagccaccuuugcaguuccucaugacuaugcaacuguucccucuuuugacauuccuuccuguugacucaaaugaagaccugauagcugaagcucaagcagccaccuugcagcacugcuaucauucuaacuaaggaugggagagcagcuaaauaaaagcccaagauucaaauaauuagagcugagagccauuaagagugagugcuucacacccguaaucccagcacuuugagaggccgagucaggcagaucacgaggucaagagaucaagaccauccuggccaacauggugaaacccggucucuacuaaaaauacaaaaaauuagcugggugugguggcacgcgccuguagucccagcuacuugggaggccgaggcaggaggaucgcuugaacccgggaggcagagguuacagugagcugagaucaugccacugcacuccagccucgugacagagcgagacugugucucaaaaaaaaacaaaagagugaguguuaaggucugaauguguccccccaaaauucacacgcugaaaugcugaaacuuaacugcugaugugauuguacuagaagguaggccuauaggaggugaugagggcccuuaugaaagggcuugagggaguggauucauucucuucugcucuucugccaugagaggacacugcauuaguccccucuagaggauucagcaaccaguugcauccuuggaagcagacagcggcccucaccagacaccaacccugccaguaccuugauguugaacuucccagccucuggaauugugagaaauaaauuucuguucuucaugaaucacacagugucagguauuuuguuacagcagcacaaacauucugaaauaaugagguacacuaucuuuaaacccuguuuuagagguuuucugucacuuucaacagaagugauacuaauacugaggucaacacucacauaaccagcacaccuuaguauauggcucuugguagaaacguucucuugaaagcugaggaaauccuuuguccugguccaacaggcugccuuaauuaucacaggaaccacaaguaacuuaucagccaagucauuuccaugugaguuuuaaaggguagggugaugaacauacaccugaaccaguguccccagaccacugcucugucaccugccgaccuccagauauuuacccagagguguuucuucccccuuucggcaccuguuugugccacagaccaagcucuccguagagaaaguaguacccaggagagggaaacccacaaggcuauuaacaguagaagaugaaagauuccccacaacagaagcucccaguuuuaauuccugauccaucuguuggugccgcaaagguaguccagccuagaaagaugcagauguuagacugcgucugagagaucuucuggcugaucaacagucaccaacauaaacaaguuccuaggacuuuucccugaagugccaaucucauuaagcucuauuacuagaaaagacauuugaaaaauucacuucuggguuuauguaauuacauguuuggcucugcucuuuagacucaccagcacuuggaaauuaagugguucaaaauuaacugagugaugauaauaauagcuaacacacagaacaugcuauaugucaggaacuauucuaaaagcuuuacauauacuugguuauauuuaauccucaaaucaacucuaugaaguggguauucuuauuaccccuauuuuacuuuacauaagaagaaacugagucagagaagcagauuaagugacucggaccaaagucaaacgucugaaaaacaguugagccugucuucaaagucagaugggcuggcuucaagaugcaugcucuucgccaccacacaguagaguaagcaguagaguaagaaucaacauuucuacccucaugccaaguaacaaacuuacagugaaauugaucaagauagaaaacaaacaaacaaacaaaaaaaaacccugaguaaguacauaugaggacaggggagaauauaguacaaauacucugacuauaaccauguaaaagauauagguaaacaugacagagaaaaucuggaaggcaaacuggccaaaaaugagaacuaugguucuucuacaucaucucuuuuuuuuuuuuuuuuuuuuuuuuaaguuuuauugagacagagucuuacucugucgcccaggcuggaguacaguggcgugaucucagcucacugcaaccucugccucccagguucaaacaauucgucugccucagcuuaacgaguagcugggacuauaggugugcaccaccacacccagcaaauuuuuuguauuuuuaguagagacgggguuucaacauguuggccaggcuggucucgaacuccugacccaaagugauccacacgccucggccucccauggugcugggauuacaggcaugagccaccacgcccagccugcuacaucaucuuaaacaaaaaggcagagagguaucuacacugcucaugugagaccaaguucuaggcucacccagagccugguuaacagcuaccaccaagcaaagacaaaacagggcuaugcuugagauucaaggggcaauguaucccucgcaacugaauuaagauuauuccauauagaauagugauuaauuucagucuuuauucuaagccugaauauggagucuauggauccuacuuuguauuuguccccacaggacaaacacaaaagacaucacacacacacacacacacacacacacacacacacacacacacacacacccccaaaaaaaacugaauggaucuaggcuuguugcuaacuuuggugaacugcugcuuaugaugcccucuccaagaagcagaaacaaagaggagaccugcuggaagacuaauuauuacugacuugugggugcaagugaggcugggucuauuucuuuccccuuuuacuugagcguuaagaggcaaguugggauagugaaaaacaacaaacugggccccuuguccugggugacacaccaaaacccacccacuugcuagggaccuguuuacugagcaaagauaauaugcuuauuacagaaauuauggacugaaagaaagaacugaaguccuucuggguaugagacacaaaacgaaagcugacuuuccuccguucuuaaaaaacugaauagaucaagagagcacaaugugccaguuggauccucugccgaaucuuuccaaauugcaggccgcacaugaguaaacauuuaauguggauguaacagcacaacagugcuuuguuguacaaaguauauuuuaguuaacuccuccauccaguaauccuuaucuaaacuggaaaaucagaaaucagacugucuaguuaucaagauuuuuaacauuuucuucuuaauuucuccuccagcacccacaucuaaugcccaaauacagagcaacaggggaaggaaagagaaagcaaugccaagcacccacuuccguuccuuuuucagagucucuuucacaucuuugaaaacuaaucuuauuauuuauucuucauagcauuugaagaaagggguucaaguccucuauuggcugucucaauucccucgacuguucccuucuaaguuuugcugaauucgucauucaucacuaccaucuccagggccccaaaacuccaagaaucaaaaaagagaaaagagaaaagaacucccaaagccacauagaccacguuacuguauaaggaggaguaaguucaucacacuggaagucaucauaaauuuucagggcuaaucuacuacugacaaaauaauaauaauaauaauaauaauaaaaagcaaacauccuuugaauauaaugauuuucuuuuauuaauuugugaaacuggcagaacuaucaguagauaugggccaaacucuuauuucagacccacgcaaauaugaauaacugauaugacaaagaugcaaaugcaauucaguggaggaaggacagccuuuucaagaaguggugcugaagcaacugaauggauauccaucgaccaaaaaaaugaaccucaagccaagcaugguggucugcucugcaaaagauccugacaagagaaugacaacaagauacaggcugggagaauacauuugcaaaaggcaugccugauaagagguuguuauccaaaauauaacaaaaaauaaaaacacaaaacucuuaaaauucgacaauaagaaacaaaccuaacaaaaaauggucuaaagaccuuaacagacacuucaccaaagaagacauauagaugacauauaagcauauggaaagauguuccacaucuauugucaucagggaaaugcaaauuaaaacaagguaccacuacauaccuauuaaaauggccaaaauguagaacacugacaacaccaagugcuaacaaggauguggagcaacaggaacucucacucauugcugguagggcugcaaaaugguauagccacuuuggaagacaauuuggcaguuuccugugaaacuaaacagucuuaccauacaauccagcacccauguuccuugguauuuacccaaaggaguuuaaaauguauguucacacaaaaacuugcgcaugguauuuauagaagcuuuauucauaauugccaaaacuuggaagcaagcaaccaagauguacuaaaguaggugaaugaauaaacugugguacagcuagacaauggaaugugauucagugcuaaaaagaaauaagcuggcagccgggcacgguggcuuacgccuguaaucccagcacuuugggaggccaaggugggcagaugacgaguuuaggagaucaagaccacucuggccaacauggccagaggggguuucaccaaaccccgucuccacuaaaaauacaaaaauuagcugggcaugguggcacgcaccuguagucccaguuacucaggaggcuaaggcaggagaaucgcuugaacccagaagguggagacuacagugagccgagauugcgccauugcacuccagcccgggugacagagcaagacucugucucaaaaaaaaaaaaagaaagaaagaaaugagcuggcaagccaugaaaagacacugagaaaccuuaaaugcauauugcuaagugaaagaagcuaaucugaaaaggucacauaauguaugauuucaacuacaguauaugacauucuuaaaaaggcaaaacuaugaggacaacaaaaagaucagugguugccagggguuaggggaaaggcagggaugaaugggcagagcacaggggauuuuuuagggaagugaaacuauucuguaugaugcuauaaugguggauaacauguuaucauacauuuguccaaacccacucaauguacaacagcaaaagugaacccuaaugucaacuauuaacuuguugauaaggaugugacaauguagguucaugacugugaccaacguaccucucugaugggggguguugauaauaggggagguugugcauguguugggccaaggggaaucagagaaaucucuaucuuuuccucaauuuugcuaggaaccuaaaacugcucuuuaaaaaaagcauauuaaagaagauaauaaacaugcaacuaaacuaccauaugaucaggcaauuguacugaucccacagaaaugaaaacauagucacacaaaaauacauacacaaauguucauagaagcuuuguuagagccaaaaauuagaagccacccagauggccuucauuacgccgaugguuaaacuacgguauauccauacaauggacuauuacucagcaauaaaaacgaaugacugcugauacaacaaccugcacgaaucuccagagaauugugcugaguaaaaaagggcaauuccaaaagguuacauacaguaugguuauauuuguauaaaauuguggaacgauuagugguggaccacgguuagggacagggagcaguggaggggcgggaaauccggggcagguaauaaacagcaaaacagcaguagcgauggaaguguucuguaucuucacuguaucaacgucaacaucccggugucuuuuguaauaugggaucucucuguauuauuucuuauguguuugugaaccuacaacuaucucaaaacaaaauguuuaucuaaaaaaaagauuagcgacuauccaucuucugccauuugucuuuuuauuuaucccagagguauagcuucucacuuuucaaaauucuuaauuuuuccucacaaagcaguguuaauaauuaauugggaugagaugaaugcauucugcacacaggacaaauuuugggggggucaguggaccauuuauaagugaguuacauuguugccccccaaaaucuacgaucauauucuaacucccccaaccucaaaauaugaccuuauuuggaaaaaaggucuuugcacauguaauuaaguuaaauaucuugagaugagaucauccugaauuagggugggcccuaaaccccaugacauguguccuucuaagaaacagaaaaggugaagacacggagacaugagggaaagccauauaaaggugaaaguagagacuggggugauacaagaaauggcagcagaagcugggagacaggacggaggcaugggucuccuucagaucuuccagaagaggccaacacugcccacaccuaaauuucagucuuacagccuccagcacuauaagagaaugaaucugucauuuuaagucaucaagauuguaguaauuuguuacuauagccauagaaaacuaauacaccugucacuuuuuuaauggguauauugaauuucuuuuuuuaaaucacagaggauguacuuucuucaacuuuuauuuauguacacuccuguacauacauuguuuuuaucuccuuacagaggauauaugucauaaagauguaucauugcauuuuacaaacuuguccugcagaauuuuuccugguguuuucuguuugcucuaaugguaaacuguugcuaucuggaauauaggcaugucuaccuaaucaaauauccugguuaauaauuuaucauacuuacuaaauacucagaaguaaaacuauacugagcacaggacuuaaucuacuguuuccuuggugacgaagaugucacuuccagauccaguggugugcuucagggucuucaaaaugaguagcaauuacuaggcugcagaugugugaaacugccauuuaagagagguguuguguuuccauagaaaugcccaauaaacuucugggcaagauagauuuuaaaaagcaagaggaugaaaacuacccaccuacuacaauguccuaaaaagcaaaauauagguccuugugguguuaugauuuauaaugguuuucaaccagguuccugguccauaacucccacagcccuuguuacagucuuuugugauaauguugggucaggaaacagaaucucuuuccugccuuccuuucaccuggcccgaggcaggaaucuaaucuuuccccaccuuucagauugugggucucaaacccuccccugagagggcuaagcacuguaggaaggaacguuuccaaaaaacccaagaaagcuggguacagggaguuuccggauagcugaacaccuggagguuccuggaggguggcacacaagggagggguuggaaacuccgcaccucuuuccccaugccuugcccugugcgucucuucaucuguguccuuugcaaaauauccuuuauaauaaaccaguaaacauaaguguuucccugaguucugugagccacuccagcaaauuaaucaaacccuaagaggggguuaugggaaccucgacuugaagucaaucaaucagaaguuccagaggcucagguuugcaugucugcagggggcaggggcaguuuuagagacuugaguuuccaaccugugggauuugacacuaucuccagguaaauaguguagcaaguaaauuggaggacacucaacuggugucugugccuugcugugugaggaaauccccccucucucaccacaaucggucacagaagucuuccguguuaacuguuguggugugagaguaaaggaaaaaugugguuucagagaguuucccuacauaguccuuuaaagucaggcugggcagggcacacaggaccuggcuugauuccugacucuaacauaccagugauaucucgggcaacucaaccucuuagaacacuggcauccuuguuuuaaacugcagguaaccauaccuguuccacaaaugggccauaaguguuaauaagcuacaugccuaagauaguggcuagcacaaacuauauguucaauaaaaauuauucucuucuuuaagauccaccaaauuuucauuuagacaaaucuuuccaggaaaguccauuaggaagcuuuuuuuuuuuuuuuuugguaacucaguugaaaacuucaucaauucaugcccauuaguuuuauuuucuucacgucuauaaaacggcacaaaacuacauuaucauacuauuaaaccacacuacacaaugaaaacaacacacuaguguucauacauuauguaccaggaaagaaaaagcauccauuuccuuaagaguuaguguuccugccacagccaccuaagaaaacaccagggcaaaggacagcacccucuucuagaaugcccaagcaacugcaaugccuuucauguccucgguaaaacaaaucuuccauuuuaacaaccuauagauggaagaaaaggaauucuuacguuaaaaaaaaaaucuuccuguuuuauggcagaggcaccugauagccauaacugaagcauauccuaagaaugagaagaguguugguuuggaguuccaggcuaagaaaucugagaguggccaaccuggagauucagucuuugucuauuaaagacauccaaaucccugcccuaucccuuuuaacgcaggggauggagaccuuuguuuugggaggcugccagggggaggaugcuaaaugaaaaugcuauaugagcuacauguuuuuuacaaaagguagcagcaugcuuccugccaagcccgcugccacuggacggcucuguacgugagucccccaaauaaacccuaugucucauuugauaccuccgggucuuuucuucagucucucaaacauggugucaucccuauuggagucaacaggggucuagcauaacaucuauaaacaaucaaaucacaaagcauucccucaagaagcaggcuggguggcccaggaaauggcccaggugauuguggagcccagagaaucagugcuuaugagggcagcaucaaguucccaucuaccccugucucuuuuguuuuuaaaauaaaaguaguagagaaguaaauucauaaaauagaagguuguccucagaggaugggaugcaugaaauuaagguuauggaggacugcaauuacugguaaugauaaggucuaagguagagggagacaauggcuaaagucauuaccuauguuuacacugaaauugccaagaacuaaaggaagcagugauacuggaaagaaagagacaauaagguaggagauaaaaucacagagaaauagcucaggaguagugaguggcucuggugaugugagauccaaagcugguguuuuaggcaggagggagggagggagaaugguuugaaagaaauaggaaguaagaaggaagcaccaccccccacgucucggcacuaaggcccaaagauaagcagcaugugggaaaagcuucuccugaggcuuggcaggaaaaacagggaaaucaggaaagagcaaguuuuugacagaaaagguaaaggacacucaaaagaaaggguugagaauauggagguuuuacugaugaugaacuacgacagcccaacgggagaaaggguuuucacacugcaagaagugaaaaaagagaaggucaggaagauauaaagaaucacacagaaaugggaagcuucacuuuuucucauuauuaaaaaaugaacguaauaaucuuuuucuaaaaaguacaaguagguaaaacaaagacagaaaugauuggcuaaguccuacugcuagaaauaaauguagcuaccauuuuggcaagcauuuuuccguguuuauaugcaugcaugguagcuuguguccaagacgguggccaucaguuucuucccucccuaugugggcaagauauuccuccagugaggggugaagucuauucaaucaauugcauacugacuucuuuuaagauaacuacauuuuauuguaucucgcuauucucuaucucagaauucuauaaucugucccuucuucauuauuaaauuguggcaaccuaaaaccagacaugaaauucuggggguuuuuuugguuuucuuuucuguucguugguuuguuuuucgguaguuccuacccuggucuuucuacuuacuuuacuuuuuauaauuaacauugcgcugaauaaauaucuuacuccacuugaucucgacugcccuuuucaagguaguugcuuuuugcaucuccaacgugaugcaaaauucacaggguacaaaauaguauaaggcacaaagccugucuccuuccuacucuaucucccagccggauugcugaucacuucucuggcagcuacuguuuucaguuucguguacaucccuucagaggcagucccuacauauaaaaccaugugugaaugauuuuuuucaaacacagacacuaauacacgcugucugcaccuucguucacuuauauaucucaaagauuauacugucaauacuuuuaagacugccuccuuuuuaagggcuucaagguauuccacuauaugaaggaacugcagcuaguccuccauugacagacauaaauuaugucucaacuuuuucuaaaaugaacuuaauguauggauauacauauauauuuguagaauagauuuccaguaguggauuugcuagggcaaagaaucugcauuuuuuaaaauuuccauauauaugcccagcuagcccccaccaucaacaauuuauauauaauguacuauuucccccucacucuuaaugauauuuaaccuuuggucuguuuaauuugcuguccuauuuuaagugaggguaaacaucuuuuauaugccuaaaagacggccaggcaugguggcucacaccuguaaucccagcacuuugagaggccaaggcgggcagaucacuugacaucaggaguucaagaccagccuggccaacauggcaaaaccccgucucuacuaaaaauacaaaaauuagcugggcauaguggcacacaccuaugaucccagcuacuucggaggcugaggcaggagaaucgcuugaaccuggaaggugguguuugcagugagcugagauugcaccacuguacuccagccugugugacaagagcaagacccugucucaaagaaauaaaaauaaaaaauaaguaaacuggcuagagcagccggcaaaaagagaaaaaaaaaaaagacuauguauaugccuaaaaggcuucuguucuucuggaacugguuuguugauauccuguccucacuucucuguugauuuauuggucuuuuauuucuuauugauuuauaaaagcucuuuauauauuaaggaaacuggccauuucucauuugccucacaaauucuuucuaguuaacugucuuuuuaaguaguguuuugcaaagaaauucuuuauugaugcaguuaaacugauuaaccuaaacugauuuuaucauguuauauucagaaacaauuuccucaaccaaagauuuuuuuuuuuaacuucccucuguuaucuucucaacuucaugucuuccuuacuccucgguagcucacuuguccuuucuuugccuucagcucccaagaucccaaccacaucaaaggcagaccacaagagggcaccaauccagcagcuccuugaacccugaaaaggcaggccaggcugacacccagagaccacagagggcaaauaaccgaagaggaaaugagaucuaacagaguggguuguaagggacuuccugugcauauacagagcguuacaaaagaccugcagcugugucccuguggaguucaccaggaaagagacacaggaccugcuuucaacccucuagcccacagcugcacacaugcuaagggaucaggccuguggcacaauuggaaaagcaugaagcagcagcaagucuggaguacaacccagaugaaagccauuuguuaaacuauuuuucuuuaaaacacgagguauauuuucccaccuugugcaggguauccuguuaagaguaugaaauccuguuuuuuuccauaccaugagaaauggguacaauaagcaaacgcacacgcacacacaaaaaauucacucccccuacacaaaaagaaaccauacuaaacacuaacaggggccaggcgagguggcucaccccuguaaucccagcacuuugggaggggcaacgcuggcagaucacuugaggucaggaggucaagaccagccuggccaacauggugaaacuccucuacuaaaaauacaaaaauuagccaagcaugguggcacaugccuguaaucccagcuacuugggaggcugaggcaggagaauggcuugaaccuggacggcggagguugcaaugagccaagaucgugccacugcaccccagccggggcaacagagcaaaacuccuucucgaaaaaaaagacuaacaaggaauuuuuguccaaugaagccuucuguaaaauaauaacacauauauaacugaagacuggauaguaagcagcauaauaaauacauguuucuaauccuaccuugauaaccuccuuccacgucacuugaaaugguuccuacagauuucuaggaaacaguacacagaaaguucccucagggaagcucccuguagugugcugucuacccauaauggagcaagaggcuugaaucucuuccuccuacauauuaaagcagaacccuguagccagacacugaggcucaaaaacuccugugagcagaaguaucuucauucacauauuaaaauugucauccagcaaaugguacugggaaaacuggacauucaaaugagaacccuguagccagacacugaggcucaaaaacuccugugagcagaaguaucuucauucacauauuaaaauugucauccagcaaaugguacugggaaaacuggacauucaaaugagaacccuguagccagacacugaggcucaaaaacuccugugagcaaaaguaucuucauucacauauuaaaauuaucguccagcuaaugguauugggaaaacuggacauucauaugcaaaaaaaaaaaaaaaaaaaugaaguuagaccuuuccuuacuuuacaccauacaaaaaaagaaacaaacaacaacaacaaaagaaaccaccaccucaaaacagaucaaauaccuaaacuuaagggcuaaaacuguaagucuuaggagaaaauauaaaaauaaagcacuuugacauuggauuuggcaaugauuucuuacauguaauacugaaagcacaggcaacaaaagaaaaaaauaaguaagauggacuucaucaaaauuuaaaacuuuugccaggcacaguggcucaaccuauuaauauaauuaauauaauuccugugcuuugggaagauugcuugaggcugagagcucaagaauagccugggcaacacugcaagacguccacaaaaaaguuuuuaaaaauuagcuggugguggcucacgccuauaaucccagcacuuuggaaggcugaagcagaggaucgcuugagccugcagugagcuaugaucacgacacacugcacuccagcgugagugacagagcaagacccccaucucuuuaaaaaaaaaaaaaaaaaaaaaaaggcccaugaugagauucucuuucauacccauuaggauggcaauuuuuuuuuuaagaaagaaacuagaaagaacaaauguuagcaagcaugcgaggaaaaggaauucuugugcacugcuggcaggaaugugaacuuguauagccacuguagaaaacaguauaggaacuccucaaaaaacuaaauauagaauuaccguaugacccagcaauaccauuuguggggauguacccaaaagaacuuaaaguugaaacucaaguagauacaggcauacuucauuuuauugugcuucacagauacuacguuuuuuuuacaaauugaagguuuguggcaacacugugugaagcaagucuuguuaauaccauuuuuccaauagcauguguucacuuuguaucucugugucacauguugguaauucucacaauaucucaaacauuuucauuauuuuauuauauguuauggugaucugugaucagugaucuuugacauuacuauuguaauuauuucggggugccaccaaccacgcccauauaaaauggcaaauugaauccauuaauguacauguucugacuguuccacugacuggggcauuccacugucucucucccucuucuugggccucccuaugauuuccugcgacagaacaauauugaaguuaggccaauuaauacccuacaauggccucuaaguguucaaguaaaagagucacaugucucuaacuguagaucaauggauagaaauaauuaagcuuagugaggaaggcaugucgaaagccaagacaggucaaaagcuaggccucuuaugccaaggagucagccaagaugugaaugcaaaggaaaaguucaugacggcaauuaaaaguaccacuccagugaacacaugaaugauaagaaagcaaaacagccuuauuacugauacgaagaaaguuuggucuggauagaauaucaaaccagccauaacauucccuugaaccaaagccuaauccagagcaaggcccuaacucucuucaauccuaugaaggcugagaaagaugaggaagccacacaagaaaaguuugaagcuaacagaggcuggaucaugaggcuuaaguuaagaaaccauaucccuaacauauugugcuagaugaagcggcaagugcugauguagaagcuguagcaaguuauccagaagaucuagcuaaaauaacugaugaagguagcuacacuaaagauuuuuucaauguagaaaaaacagccuucuauuaaaauaguaugccaucuaagacuuucgcagcuagagaagucaaugccugacuucaaagcuucaaaggacaggaugacucucuuguuagaggcuaaugcaacuggugacuuuaaauugaagucaaugcucauuuaccauuccaaaaauccuaaggcccuuguaugcuccaucuacucugccugugcucuguaaauggaacaacaaagccaguauggcagcauaucucauuacagcaugauuuacugaauauuugaaucccacuguugagaccuauugcucauaaaaaaagauuccuuucaaaauauuacugcucaucagcaaugcaccuagucacccaagagcucugauggagauguacaaggagauuaauguuauucucaugccugccuacacaacaucccuucugcagcccauggaucagagugauuuugacuuucaaguuauuauuuaagaaauacauuucguaaggcuacagcugccauagugaugcuucugguggauccgggcaaaguaaacugaaaaccuucuagaaaggauucaccauucuagaugccauuaacaacauuugugauucauuggaggaggugaaaauaucaacauuaacaagaguuuggaagaaguagauuccaagccucaugcaugauguugagggguucaagacuucaguggaguaagucacugcagauguaguggaaacagcaagagaacuagaauuagaaguggaaccugaagaugugacugaauuguugcaaucucauaauaaaaugugaacaaauaaggaguuucuuaugaugaacaaguuucuucuuacgaaaguaguuucuugagauggaaucuaaugcugaaaaugcugugggcauuguugaaaugcuaacaaaggauuuagaauauuccauaagcuuaguugauaaagcaguggcaagguuuaagaggacugacuuuaauuuuuuuuaaauuuuuuauuuuuugauugcugggucgaaagguaaaauugacucccacuuugaaagaaguuugacuaugggcaaaaugccaucaaacagcaucacauaaaacagagaaaucuuucaugaaggaaagagucaaucaacguggcaaacuucauuguugacuuuaagaaauugcaauagccacccuagccuuccggcaucacuaucgaggcaagacacuccaccagcaaaaagauuacaacuugcugaaggcucagaugaccauuagcaauaaagcauuuuaaacuuaagguaucuacgauuuuuaguaauaaagcauuuuaaaauuaaggucucugcaauuuuuuuagacauaaugcuacugcauauucaauugacuauaguauaguguaaacauaacuuuuacgugcacuggaaaagaaacaaaaaauugugugacacuuuacuaugauauucacuuuauugccguggucugcaacugaaaccacaauaucuccgagguauguguauauuuguacacucauguucauaacagcauuauucacaacagucaaaaggugaaaguaacccagugccuauugaugaauaaauugauauauacauacaaugauacguagccuuaaaaagacaauucugacauacaauacaguacgaugagucuugaggaauuauauuaaguaaaaucagccaaucacaaaaaggcaaaugcugugugauuccacuuaacuaaaguaccuagaauaguccaauucugagucagaaaguagaauggugguugccagggccuggggaugaggaagaauuauuauuuaacagauacagaguuuaaguuagagaagaugaaacagcuugggaaauaaaugguggugacgguuguauaacaacaugagcaugucacagaacuguaaacuugaaaauaaauuuuacguuauguauauuuugccagaauaauaaaauuaucuauuuauauuauuauuccucucacugccacuaaacugaauauaucaagggcagggaucuuauguuaucaaucugugaacacuuauuccagugccaagcccucaauaaaaguacaaugaaccuaaguuacauuuuucagguagagucucuaaaaccaagauguccuccagguucaaaguggugaaaaguagcaucugaaaccacaauugggcaggggaaacguuguccuacagccauuuucacaguuauagaaaccaauucacucuuaacaaauacuuucaaaaaaaaucaauagcuugcauuacuaacugucaacuucaagccagccuccuaagagguguuuacuucccgguauauaugcuaagagcacagccuauacuccagucucccaguuaacuuccucuuccaggaagacuuaaaauacugcucccugaaaguaccuuugcucccugcuccuccccuucuuccucucccuauuccccguacuaccuagcccaccacucaguuuuaggcagcccuucuucuguuuccagccacacaacaaauaacugguuugggaaagcggaucagaucuuucugcuuagcaggugguaagcauuggguuugaucuccuaccuuuuuagaaucaaaagaacuggccugaguucugucacuguugaugaaagcaaagucucauugugcgaguguucuucuguaauuggucguuacgacugugguuauccuaguuagcuuaccccagacccuggcuuccaagcucugucaucagagugcuuggcuggugaucggggcauguucauuucagaccuccuuuacugucuccucaagguaccggcuuuguuugaagagcguccuagugcaacggaauggacagucugucgguagcucucuuuuuugugugggaaagauguuuaaaaaggcaauauaauauaggaagucuaucuucguacauuaaaaaaagaaagaaauaugauugaauugacaaagaacaucaauuguccccccuaaaaaauggggaaaaaagcaaugucaaaagaugaugggaaugacugucuuccugguuuuugccaccgcagaucuugcugcugcacuugccaugcuuugcaggggguggagggccuuucaguacugucaccccugcaacacacuacaucugggaaacuacucacagugcuaccaacagcaagcaccaagaauucugcacaccaguuuggcaggaguauaacaaaugucuagccuuuuaaccaaugaauuccacuucuaggaauuuauccuaaggaaauaauuaaagaacaacaaaaaauuaacuuaggaagaugcccgucauugcacaaaaguggauuaacaaacuacauggucaccaauaauggggguuguuaaguuuuaguacacuacacauaugaugugauguguacagcuaccaaaggacauuugaaaagaauauuugguaauaugggagauguucaguauacauuaaguuaccaaaagugugugugugcauguguguguguguaaaaucucaauuuuggccagacacaguggcuaacaccuguaaucccaauacuuugggagcugggaugggaggcucaauugaggccaggaguucaagaccaaccugggcaacacauugagaaccucaucucuacaaaaaguagaaaaaauaaaaauuagccaggcaugguggcucaccccuguaguccuggacacucaggaggcuaaggugggaggaucacuuaaguccaggaggucggggcugcagugagcuaugaucaugccaaugaacuccagccugagugaaagaguaagacugugucucuaaaaaauaaaaauuaaaauaaauaaaacuaaaaucucaauuuuauccaaaaccuuuuugucuaaaaccuuacuuauauauguaaguuccauacauacauuuuaagaaguuuagaaagaaauguaacaguguuaacuauuaguuaaugguuagguuugggucaugaaaguuuuuucuucuuuauacuauucuauucuaauuacuuuuuguauacccaauaaucaggcugaagcauaaugaggugaaauccuaaaccccauacacaauauacugauaccuauaaaaauaauuaauaaaacauuuguuucugaaauaucauuuaaaaaaaaacuguucucacuuggcacccugggugugaccaucacaaaagccaaagaaggcacaaagagguggcagaccuaggaccugguggagucauguaccuggauauugaaaaauaaggcaggacccggcugggcgcgguggcucaugccuguaaucccagcaauuugggaggccaaggcggguggaucaccugaggucaagaguucgagaccagccugaccaacauggugaaagccugucucuacuaaaaauacaaaaauuagccaggcauggugguaggugccuguaaucccagcuacuuggaaagcugaggcagaagaaucacuugaacacgggagguggagguuacagugagccaagauggcagagcaaaacuccgucuuaaaagaaaagaaggaaaaaaaauaaggcaggaacuacuaaaaaacuacaugacuuuuuauaaaacacauaaggugacugccauauuuaacaaauacguuauauaagugauauauaauacaugcuuucuauauaaauuucagagaauguaauuuucaucacaaaccaaaucagucuguaaacucuccaucagaaaccacuagaugaccuccaugagucuacuacuaauauucuguauugcuagagcacccugcuagagguuauuucagcucaacuguacuaagguaaaaucaaaacuaauuucaagcaugcuuuuuuagcaugugguuccaaugacaacucccuuuaucucucagaagcccuugguuugaaaagaauguucucuucuuuacaaaaugcccuacaggcaguccccaacuuacaaacacacugccaucaaaaaguucacucacugugcaacacggaaacacauuuucccagacaaacgggugaggauuagguucccagcauagcuucuaaugccaacuuaacccauacugcugaugaaauacugaagaucugcuuaacaaaaucaggaaacaauaauacugcugcaaaucuaaaacugaaguaaaaaagaacaccaaaaaugcuggugcuugcagauccagaaaagucuauguuucugaagcauuuuuccucacgccauucacaacaaauggccaacauggcuuguucuccaacacacaagcugcccacucugugcagacaucuuuacuccaaacuuuugccuugcuaauuuuccaugugucuccagagaugagcccucaagugcauaaauccuuauggggucaaucugcaaaguagaucuucagcacaccuggcaccuggcacgggagaagacaguguccucugauagacaucacaauagcugucuaucucuuuucucuggacccauuggcucgcacauaauagguuuccuauguuccccaucuggcuggggacaguugagaacaagaccaucagaacgaucucuaaguaggcaaaugccuaacaaaaucccuaaaaaauaaaguuuuucuuuucuacacagggaaguccuauuauuuauuauuucuacacacagaucugacaagcuucuuuuccaaauuucaaaaaccauaaacagggaagugaaagggaagguauccaacauuuauugauggccucucucucugugucgggaacuuuuuaaaauucucauuuacaagaggaaacuaaggguuuaagugucuuguaaaggucccucggcaacaacauaagaccugugggcugaaacuagaacucacuuggcuggcucuaaagucaguggaggcuggguugcagccagcugccaccugauguacuacuauacggaagucaaaaacugacaucagacucagccugcaacgggccauucacucacuguuccuuaaggacacaaagcagugcuugaaauacuucccaaacaucucucuuguaaguuuucccaagugcuggcacuucagacgggcugugaaacacugcuaauccugaagcuccaggcagaugggguuuuuacaccaaaggaccucccaugaucuucauucgccucugccuugugccuacaucaagcgugggccagacuacacccuauggauguuuucugaucuggaagcagcacuguccugaaccuggcugcccuaccaagagcaacuuugcucuucacuuguuuagaaugcagcaugaagagacacuccagggcagcagugaagaaauuagcuucagagaaguuuaucaucugagacuacgguacucuaaagaaagggaaaacagagauuaagagccugugcauaugaacaaagagauugaugagagccaaacgagaugacugaugguuuccgucaaguauuuagcaaggaugauuuagcacccuucuaccaagggugacgagaggacuuauggcuuccauuucaguaagcaaggaccuucaaguggaagucaugaaagaauaaaaaacgaugagggcuuccaucagaacuccuucuaccuuccaaggacugccagcuaauuaucaguuaauugaaaaugauaacauaauuugcugaaauuaaaagugguaucaugaaaucugcguguauuuugcuagaggcaggacuggcauggugaagagaaaaauaagcuuaagucacacaagcugaugucugaauccagaugugcugucugaccuuggacaagguuguuaaccuccuuuaaccugaguuccuucaucuguaaaauggccagguagggaaugccuaucuuagcaggcauguaauaaacagucaauaaaccagagcuauugaguuuuacuguuguuuuuuuuuguuuuuuuuuuuuuuuuuuuuuugagacggagucucgcucugucgcccaggcuggagugcgguggcgggaucucggcucacugcaagcuccgccuccuggguucacgccauucuccugccucagcuucccaaguagcugggacuacaggcgcccgccacuacgcccggcuaauuuuuuguauuuuuaguagagacgggguuucaccguuuuagccgggauggucucgauguccggaccucgugauccgcccgccucggccucccaaagugcugggauuacaggcgugagccaccgcgcccggccgaguuuuacuguuuuuaggauacaaauuauaugaaaaguugcugcuaagguuggcaugccugugucccccuaaaaugccuguguugaaacuuaauccacguaucaauagcguuaagaggugggaccucugggaggugauuaggucaugaaggcucagcccucaugaauggaauuagcgcccuuuuaaaagagacuugggggauaccuuuugcccuuuccaucaagugaagaccauaaaaggcacuaacuaugaagcagagaaugggccccccaccagacacugaaucuacuggugccuugaacuugggccucauagacuccagaauugugagcuauaaauuccuguuguuuauaaauuacccagucuaagcuauuuuauuauaguagacuggacagaugcuuucuuuuauuuuucucaacaaagcaguuucaaguauuauacuuacucccaguaaaguaucaaguauuuuaggcaaaucaugcagacuugguuccuacucucuuggaguugaccaccacggcucuaaggauuauaauagaaacaagggagucaagaauagcgaauagauaugagauaagguuaagaauucacucuggggcggggcgcuguggcucacaccuguaaucccagaauuuugggaggcugaggcguaugaaucacuugagcucaggaguuccagaccagccugaccaacauguugaaacucugucucuacuaaaaauacaaaacauuagccaggugugguggugugcaccuguagucccagcuacuugggaggcugaggugggagaaucaccugagccugggaggucgaagcugcagugagcugcaauugcaccacugcacucccgccugggcaacuggagugaggcccgucucaaaaagugagacccugucucaaaaaaaaaagaauucacucugcacaaacaucaugcacaacugcagggagaugaauuauaacccuaggucacaguccccucuacuuuugucaacaguagaaaagcaauuggaaaagcaaggaaggcuucaacaggaagagggcagcuucaaaggugugguauguggccuucaagacaaggcuguggaggguggggacaaagguggauacaaagaacuaagaaggugauccugaaaggcagcaggcaggugugaucaacacagccugaaaacaagcagugggacacagggugagcaucuugaaucugccccgcagugcaacugcgugcacaggguuaagguggggacagaggacugaucaauguccagcagucuggacuauagcaaaauaugaugguggcuugaaccuccuucaaagcugugagcccugacgcaaacagcaacccaaagaagaguaaagacuggucccgcacaaggagacuaguggggaggguuauugcaguggaacgggaggccugcugugaugggcaaagcaggguggacaaggugggcaggggagggccagagaaggcaagagcuucuuccccagaguugaguuugggaagggacuuucacuuccaacccauugaucuuauugagacagggucucacucaugacuuaguucagccuugaacuccugggcucaagugauucucuccuaccucagcuucccccuacuccuccccacccaguagcuaggaccacaggcaugcaccaccacacccugcuaauuuuuuguggguuuuuuuguagagacaagaauuuuaccauguugccuaggauguucucaaacucccgggcucaaagugauccacccacccuggccucccaaagugcuaggauuacagacgugagccacagcucccggccccacugaucuuucugacagggugcuauuuaggucugaaaugcagggaaggguucagggaucugggcccagagggcagaaugucacuucacugagagcuggaauacauguaacaagaaaaguucaguuaagggguucaguuaagguuaaccaacucagacaccagcggaggaccagcagcgagucuccaacacaggaaggagaccacagcucuggacuggugcauggaggggcggggcgcaggaaggggguccuccucuagacauccagaaacuucagggguaacaaaugguguuaaccuccauucccagguugccagcagccuccuccgcagggggaaaugagaugaugcacccacccacucagaacaccugccccaaguucaaaguacacuuggaaaacauggccuuuuuauguagauuuaauuacaguccuccauucccugugucauaaacguugcaacucagugaacugucuuaucuuuuucauucuucaaaacacacgguuauucaacauguuguagcaaucccagcagaagauuuauccagcagaugccaaucuacagaauuugauuucugguuuacgcagcccuuucaacacuuauguagcuaacaaaauagucccugaaggccucagaaugaugaauauauaaaacaggacccgcucccacagucauugucacugcuuugaacacagcuggaaugccuggcuucccugucacccuugccccaucagcauuccauuuucuuucuugcagugacccuggccaggucacugugaacaucuucucagagauugggaaggggaaguuccuauggcucaggguccagaaguugcugcaacucucccuccucccauggggccucuccugggcuaagggacgaguaccaugcagggagucaacacaggggcccuacagaaagggcuaugaagugggcacugcuggcucagcagacugugugacauguccagacacuucugcuucaugaccuggcauaaccuuccuggacuugggcauucucuccggggacaaguucccaggccuaucagagcagcugguugcuuguuuguucaccugucagcaaaucgagcuaauguaggcaaggcucccaaggggguggacugggaaccacagccauucugcaggacacccagggcaguagugacagacccaccuacacacauaggaggcacagggcaugaagagguuggccagcccacaugugaauccuugguuccauaucuuacugguggagcaacuucaggcagguuacuuaaccucucugagccucuacucucuccccuaugacagagguccaguaccucacaccucgggauaaaagugcacagacuaucaaucuuuaagaugcaucuugcacaguggcuguaaacucaacacaugcuaguggggucuucaaacauccaccuuauucacacaacugauacauccugaacucaugaguuuuuguaauggucugaaaggaaaaaaaccuuuuuccaauccuaauaccaugcuuacucccucuuucucagagugcuaauucuagaugucaugauccacaaaacuccuucuguaccaauucucucaaucccuccagcagauacagacagucucuccuaguagucagaucaggccuggugggaggaucuaaccuuuuauggggugcaguaaacacugacagccuaaagcaaacguugagagggguaaaagggagaaaguaaggccaacaggaguaggguagaaugacagaugucagccaaagcugcaggggaaggacaugugguauacagugguaaugagacaucauucaaaugcuucgcuucgcacacagggcugucaagccucaaacugcuguuccugccucucacuccugcuacguaccaggugugagcacacacugcuguuccaagcccuccgauuuugucuggaaaugccacccagcacaugcccgcacccccuuugcaaucugccuaacuccugcucaucccuccagcuccagcucagucauuaccuccugucaucugccuccuccaacucccuaccccaggcaauuguggcucccucauggguguccccacaguacucugcacuccagaucaugccacuuacgcaacugcacugucauggguuaugucaguuaucugucuacugccuuacucaucuuugcaaugccagguacuagagauacaacagacacucaauguuugcugaauaaauuaauguaucagaugguacuuaguaccauaagucaccuacugcuacaguggaccgugaucagcuuaguacaaagcaugauucaaagagaaaaggguucaaguacuggaugugccacuggcuagcugcaugugcuuggggaaggcacuuccucucugagucuuaguuuugucauguuaauauguaacaaaagaggggugaauaauaccaucuaccccacaagacugugguugacucaaggucacucgagaaagcagaugugaagauucuaguaacuauaaguccuuucuucgaguugaaauacuuucccaagccccuaaaaacauucucucugcagagaaugaagacaaggcacauguauaccugccuucugagccucaucucugucaacauguucgcaaaaguaaaaaaaaaaaaaaaaaaacccuggggccgccuaugagggccauauuuaacacauauccuuaauucucaggcucugaauacuugucccaguugacaucugcagcugccaagagugacauuugacucuggaaguguguuccaauaaacuugccuauuaaagcuuuccagcucccacuggauaagccuaagacugaagacuuaggaaggugaacaauuaaaucaccuccuggaaaacuaaccauaagcaauuuaauauaaucguguaucacaacuccuaguucacuuacugaaaucauucaaaaucucuuuuccuaauaaauaacccuccggccaauugcaagauaaaaacacacaggaaugucaacuaaauuuuuaaacuaagaaccaaggguagugugguuaaaaagagggaggaagauuuuuguuuuaaagcuaaaugccucugaagcucauuacaaguuacuugugggguggggguggggggaggaaauuuuaaugacaaaaaaaaaaaaaaucaccuaauacccaaaauaccaggagcuggggauacaacaggcacguaauguuugcugaauaaauuaauguaucagacgguacuuaguaccauaauuuggcuacugcuucaaugggccccacucagcuuacuagauaucagaauucaaagagaagauucaagcacuggcuaggccacugauuagcugugugagcuugggaagauacuuucauuuccgggccuuaguuuuaucaucugaaugcagacauauguaucuuauaauauguaauaaauguuuuuuauauauacagauauagaaaagauaaaaccuucuacacuggaagacacacaucauuuuaacauggggaaauucuuuaugguuuauauauauuuucauaccuauuuucacauuuuauucucacaacacucagaugcuauagacagcacagauucccaaccgcuggaccagagaugaucaaaaaccacagguuagucaaucugcaccagggcguaaaaaggccaagcagagaauagauuguguauuuugauuucucuacucugcaacuauucccaagguuucacauuggccaggacaaggaaacaggguuccaacucuccagagggccaggcuggcucugugacgaugcacaccccacguccccaccccacauccaccugugcuccucgaauauucauguuccccaucacagguagccccagcuucuacacacuagucagacacagcgacuuccagcagcucacgcacagcaagauucaaguagcacauauucuacugcucugcacauauucagacaccaacagaaacccgggaauguccaacucagcuggcugagauguuaugugggucucagucagcccagacagaaggagcuugcaagaaaaaaaaaaaaaaaaaagaaaagaaaaaacugggaagugaccgaauauauauguaaaaacaguuuuacuuccuaccacgauggauucugggcccauugaaauguguuaaaaaaacugugugagcuguccugaaacaaaauguaaggaaguagaaucuguugcuauauauaagcaccuuauuuggggacaucuuugcugcaaaauaaauggagauucagacaagaacuaggaauagguguuuguggaaugaauuaagaaagccuaauacauuauauaacuccccuucacauacacaagagcuaccuggaccugucaaucacaaucuaugucauucuaaagguaaagucuuuuucauuuauuuuauaagcauccaucuuuccaggguaggauaguuuaaaacgaaggugggugggagaaacauaggcuggcuaaccaucugcacuccuuacaauuuaaggcugaaaauguagcaaugguaauuuucccccagugagcuacuuuacagaauaugucccucucuuuucagugucauguguacaaaguaucuagaaaauuauuuauuauaccuucguaugggaauuuauuuaauuauucaaacccaguuaaauucuucucaguuauguucuccuacaguaggguucuguacgaguuggggauuggcaggaaaaacagaaguauaaaggaaagauuuagaggaccagaauaaagcauggaagguaguauucauggacuagaaaagauauggugaaguaagauaggaguuaagugggaagagugggggagcugcuucagcguaaaggacugaacaaaaucagaacaaacauaggaaaagucaaauacagauuuuuuucuaaucugaagagauccaaaagacacacucacuuuauuuauuuauuuauuuauuuauuuauuuauuuauuuauuuauuuuuaaaaaaggaagccuaguuagcaauguacagucuaacucuagaagacagggcugggggcugcggaagugggacccaguucccuacuacacuggucaggcuggcaauggcgccuuaugcuacauguugguucucugcaguaugugacuaaucagguccuacagcaaaaccagggaaaucgguuuacuuccccaugggacacccaagaaucaucugaaugagguuaacuaauauccaaggagcagacauaauuuguucuccaucccccaccuaguguggcaacaccaaauaccacacauacguccagcagcaggaaguaacacacaggcaggagugguuuccaacucccagacagucuuuuugugugagaucacacagacguucucagccugccacugugcucugaggugccuggugaagccacuccagaucccacugcuccaaugcuuccuaugcgcucagaaagucucaacaggcauucugccucacaaucugaaccccaaaaugagaggagauaggaauggcaccuaaaguuucucagacuucccaaagagcauggacuucugacuacacagaucuaguugaaagaacuggugaacauucagcauccaagaaucuaaaacuguuaacuguuaagaaagaaauuuugaaagaugaggucuuuauauucuagcaacaaaauacagcugcucccaugaguggacauuccaaaagcccuugagugucuauccagagccuuacacuuaggguaaguuaagaguucuagggaagauaacucacuugucuccaguugugaaauacucaagaagggagauagaauuacagcacagagauaagaaugaaaaagaugcaggauagcaauaguaccuaaaccugguaauacuaggggcccgaaacaaauacuuuucauuauuuucaugggucauaaagcaucaaaggauggaaagaggaacacucuaugaaauacauucuggguaaggaugauguuuagugagggaagcacugaggugaagaagaacuuaacucugagguuuaaaauuccuuucuggauaaagauccuuuccggaaaaaaaaaaaaagauccuuucugcaaacaccugguuggagcgggggugggugagagagaacccacuagauuuagcagaaagacauuaauacuuggccuacuuuuuaaaaaauaaauauuugacauauuugacaugguguuuuuggaauuuuuuuuaaaugaaaacaaaaaaaaaaauaucaaauaugccugacaagugaaggguaggaaaugcaauagggaaauauauuucuccuuucacuuugcaaauaaaggugggcauuaaaaucacugagaugaucugcucuucccagcacccaaauuuucccccaucucugauuagauuugggagaggccucaucaguagguucagcucuuuguggggccucucagcacuagcgcuaaagccuaacagcagcccagcauuaaaaccuguucucuaugacacauaugauucuacaaagcuccacuggaaggcggccccuuggagcucacacagaggaaggaucaggccuugauauucacaugacaaguaaucaaaggggcaacuuagaagaaaagaaaccagagccagggcaccaagagagggauaaacuugggaacaauaaccuuuaagggaagaucacucuuugauauuuauuugagagauguuugacuauccauuaaucauaauauccaaguaguuuccauagagcuguggcaacacuucccaugcuaucuauuucccugcaccguuuguccacauacccacccauucuuucuccuuucuacccaaauaacaagacaccuccugucccaacuccagaagaaagaacuuauauaaggaaggauagaugaaaugcuaagaggcagguuaagggauguguucuaugggacuaaauauauggguccccugcucuggaagccuuuuaaaaaccauaagcacuaauuuacauuccuaccaacaguguauaagcauucccauuucuccacagucucgucagcauccacugucuccugacuuuuuaauaaucgccauucugacuggcguguggugguaucucauugugguuuugauuugcguuucucugaugaucaguguuguugagcuuuuucucauguuuguuggccacguaaaugucuucuuucgagaagugucuguucauauccuuucuccacuuuuugaugggguugcuuucuucuuguaaauuuguuuaaguuccuuguaaauucuggauauuagaccuuugucagauggguagauugcaaaaauuuucucccauucuauagguugccuguucauucugaugauaguuucuuuugcugugcagaaguucuuuaguuuaauuagaucaacuuuaucaauuuaucaauuuuggcuuuuguuguaauuaguucaaccauuguggaagacagcauggugauuccucaaggaugcugaaccagaaaugccauuugacccagcaaucccauuaccguguaugcacccaaaggaauauaaaucauucuacuauaaagacacauguacacauauguuuacugcagcacuauuuacaauagcaaagacuuagaaccaacccagaugcccaucaaugauagaauggauaaagaaaauguaguacauauacuccaugcaacacuaugcagccauaaagaucauguccuuugcagggacaugggugaagcuggaagccaucauccucagcaaacuaacacaggaacagaaaaccaaaugccucauauucucacucguaagugcaaguugaacaacgagaacccauggacacagagagggaaacacacaccagggccugcuggggguagggaugaggggagggaacuuagaggacgagucaauaggugcagcaaaccaccauggcacacguauaucuauauaacaaacccgcacguucugcacauguaucccauuuuuuuccuuuguguuagaaagaaaaaaaaaauccauaagcagcuucaagccuugagcccugaaacgguuacauuuuaauaaauauugcaggggucggggaguggcaugcacagaguagcaacaguagcuuuaccagcuugacuuugauucucaucaggcuauaaggaggucuuucagaauguuaaauuagccagacuaucuacacaagguacucagguugggcugagggcacuccuauuaaccacauccagauccaggaaaaaaaaacaugggcacaaaaugagggcuuccaaauaaauguucaaaagaaaguagacaaaggcaagaggcugagaaucugugcuugugggcgaagccaggaaauaaggauaaaccacagaaagaaaaaccaucaugacaaugugccuuucacaaccgucuuucucacuacugcugccccugggggcacaugaucucagacacacccaggugcacuggaccaacucuaaagacaagacagagauaacagggggagcagaaucuccagucugccuucccaagauucacccugugugaccuggaggggacuucacaggcugauuaagcugggugcacuggcucacaccuguaaucccagcacucugggagggcaaagggggaggauugcuugagcccaggaguccaagcaacauagcgagacccauucucuauuaaaaaaaaaaaaaaaaaaaaaaaaaaauuuaaaggccaggcgugguggcucacgccuguaaucccagcacuuugggaggccgaggcggguggaucacgaggucaggagaucaagaccauccuggcuaacacggugaaaccccgucucuacuaaaaauacaaaaaaaaaauuagcugggugugguggcgggcgccuguagucucagcuacucgggaggcugaggcaggagaauggcgugaacacgggaggcggagcuugcagugggccaagaucucgccacugcacuccagccugggcaacagaaccagacuccaccucaaaaaaaaaaaaaaaaaaaauuuaaaaauuagucgcauguuguggcaugugcaccuguagucccagcuacuugggagguugaagcaggaagaugguuucagcccaggaguucaaggcugcagacagcugugaucaugccacugcacuccagccugggcaacagagcaagaccuugucucuaagaaaaauuuaaaaauuaaaaaauaaggccgggcacgguggcucaugccuaaaaucccagcacuuugggaggccaaggcagauggaacacuugaggucgagaguuugagaccagccugaccaacauggagaaaccccaucucuacuaaaaauacaaaauuagccgggcgugguugggcaugccuguaaucccagcuucucgggaggcugaggcaggagaaucgcuugaacccaggagguggaggcuguggugagccaagaucacaacaugcacuccagccuggguaacaagagcaaaacucugucucaaaauaaauaaauaaaaauaaaaacaguuuuuuaaaugaacaaaggcuguuuaauucagucuccucaacuuagaucuaaggaaggugucuucucugggacacguagcgaucucaaguucuucucacuauuucauaccauuucugggucacuccaguccaaacucuuaccuguuaauccagucacucucugaguaacagguguuauuaacuacaccuaauuuacagagaagaugacuugccuguagcuacucagcaaaaccuguuuaagagcugggugaaaaauguggagucaggcaccacaccaagaacagaaaagaaaacuaccuugagcaagaaaacccucugcuacucauuccaagagacagauuuuuccugccuaaaaugagcuucuccauuuucgcagguuuuccagauucccucacuacaaucacucuccaaaauugguuccuaacuuccaacacaaaaaguuuagagccaaaaauggaaaaaggaacucuguuuuaagcagaaauuucauguuucucuaugcaggcuggaagcuggcauuguguaaaacuauaauuagugcccuagcacuggcuuccucaggagaaaaaggcuuggccuuccucaucucacuucaccucuggcccacugcccuguccaccaucccucucaaucuuagaggccagaacgcccuagaccaggcuugcuucaggacaauuucauugacugcagccccauagagaaaucugcuguggucccgaguccacucuuucccagaucggagcccacgguugugccaagcacuacauagagacaauguuuugccucucggucagguucucagaacagaagcucuccaccaccugaccaccuccaccuaguucauugguaaacaccugagauccacaaaaccacaacucccccuuuauccuuaugcucugccccuucccccacucuggguagacuguaccaaggaaaacuaaaucaauacugacauuccaauuauuagaucagccuaauccuuuuguugagugcacucuuaagaaaccucugcucuucccuacuauauuuuuuaagaaauggcguuucacuuuguuggccaagcugaucucaaacuccagaccucaagcaacccucccaccucagccucccaaacugggauuacaggccugagccaccgcacccagcuccaucauucuuacuuuucauaaucauauuaauuugccuuuucccacaucuggcucauuuuguaccaaauccaacuagguugucccaucugagugcuuuccuaugacccaccauguuuucugaaauauggugggcuuauuucuauggguagaaacuuaagguuuuccacccacagaugacaaucuaagaauaaagacgugaagggcagauaguaucaaaagcugacacagauaacaggucaucuauuuguauuccaaacuccucaucuauggauguaaagcucaggggguuuuuggggguguguguguguguguggguguguguguguguguguuuuguuuggagacaagagucuugcucugucauccaggcuggagugcagcagcaugaucucagcucacuacaaccuccgccucgguggguucaagcgauucuccugccucagccuccugaguagcugggauuacagacacacgccaauauacccggcuaauuuuuguauuuuuuguagagauggguuuucaccauguuggccaggcuggugucgaacuccuggccucaagcaguccuccugcacuggccucccaaagugcugggauuacaggcguaagccaccacaccugacaaaagcucaacguuucuucaagaaguucaaccuccaccaauauuuucuaagaguccagacugcuuguacaaaccaguaagguaaaacugagcaucugaggagaaaaaugagcaagucauaaaauaaaccuaaauaaacugcaaccacacaacaaccuuuaacuucacucauaacuaaagucaauaaacaauauuucacccaacuuuuucaacucagguuagcaguuaaaauguucauaugaucauuauguuaacacuaaaugccaauuuaaccaaaacuucauauaauugcaucagaagaugaagaaaaguguagggaaacaggaggugucacuuaaaaccuaaucuucggcugggugcaguggcucauggcuguaaauccuagcacuuugggaggccaaagugggcagaucacuugagguuaggaguucgagaccagccuggccaacauggugaaaccccgaacccaggaggcagagguagugagccaagaguacgccacugcacuccagccugggugacagagcaagacucagucucaaaaaacaaacaaagaaaaaacccuaaucuucaagcugggaaugguggcauaugccuguagcccuagcuacucugaaggaugaggcaggaggaucgcuugaggucaggaguucaaggaugcaaugugcuaugaugguaucugugaauagccacugcacuccagccugggaaacauagugagauccuaucucuagaaaaaaauaaaaaccugaucugaucuucuaaaagagaaagucaauaaagaagcuuaacauagucgaggcugagggagugaugcaaauuaggaaaauguaauuuuuugaaauauggagauaaaagaaauagcuagaggauuuaaaagugguuguuucuuaaaaaugggcuggggugaagaaagaaggacuacugacuuuugguuacaggccuuucuaggugucauuauuguuaucaauaccaccaccaucauaagagauaauuauugucaguuuuccauauaccagaaaacauuucaauugccuuuucugaauuauuuauuguuuuauguaaucuuuacaauccucacaauacaggcaggcacuacuuugguacccauuuuauugaugaggaaaauugacacacagcgaguaacuuugcccaagaucauuucacuaggaagugguaccacugagacagugugauuugucuuuuuauaccauauacuuuuuuuuuuuacuuuuaccaaaguaauaaccuauauguuaaguuuuuaacaauauacaagcacacacacacuucacagcagcagcagccucauuaacuggccaguuaaaugagggugugagcuaucuccacucuacaugauacaaagcucacaaggggacaaaggcagucaugacauugcugucacaccacaacaugagauuuaauaugaacaggugcccccgcauacaggcuaagcccauacauccaccugaugagugcaaaccccuguucuucacugaggaacaguccaaacugcccucucucauuuuauucccacugauaucauuuucugggacuaggaauaaaaaggaaaaacauguucuaaucccuaaaucaagucagcuuccaggauccuuguugccaacuugacaaagaauacaccuauaucaaaaaguguucgugcuuauccucauccugggaucugacaugaaacacucuccccagugaaaugugaaaugcacacuuaacuaaauucuacaugugguuucagaagauagauagcccuucugacuccuauccauggaucccaggcuaaucuaaaaacucuugaccuacagguaaacugucugcuaccaccagagagaaacagaaggaaagauaagacuugaccaacuuccagauguuuuguuuuguuuuguuuuguuuaaaaaaaagggcagucucuuuuuucuuaucagcacaguuauagaaacuaggaaaagaccacagucaaaaucccauacccauaggaauucaauaccuguaggaauccagggacauuaaauaaauuuuaaaauguugugguuuuuuagagacaaagucucacucuacugccaauguuggagcacaguggcacaaucauagcucacuguaaccucaaacuacugggcucaagugauccucccaccucagucucuagaguagcuagcuaggccacaggugccacacucagcuaauuuuuuuuacuuucuuuuuuaauuuucuguagagacaagaucucacuguguugcucaggcuggucuggaacuccugggcucaagugaucaucccaccucggccucccaaagcacuggaauuacaagcaugagccacugcaccuggucaacuuucuuugcagggcaugacagccagugagaacgcacagaaugcugggcacaguggcucauaccuguaaccccaacacuuucggaggccgaggcaggaggaucacuggaguacagaguuagauaucagccugggcaaaaaagugagacuccaucucuaaaaagaauuuuaaaauuagcugggcaugguggcacacuccuauaguaccagcuacucaggaggcugaggcaggaggauuguuuggguccagcaaguugaggcugcagugagcagugaucaugccacugcacuccagucugggcaacagagcgagacugugucucaaucaaucaaucaaugaacaaacaaacagaaaacagcagcugcugucugcaggagcacccccuuccccaaaauacugcugaugagacuuaaauauuucccaaaucucaaggagacugauauuuagcugauguaaaacaacucagauccaguuaauuguuacacagcuaaaauaaugucacaccucaagggacaugcucuccaaagaguugcgaagaaaaaaagucuguuucccaagagagguaacauucauuuuauaaguacuacaucugugcauaaauauauauuuguaauugaaaaggaaaagcuuuaugaggaaaacaaauuacagcaacuaaccucugaggaagagugcgccaagaagauguaggaaaaaaaccaaagugccuuuccuacccucuaccgugcacagaauauuucaccucuggucaccaaaacguauggcgauuucuccccaccagcaaccaaucaauucaucagcagacaccagcuggauguccuguaauucaauucugacacgaucuaccuggagagagcgccagaucccacaggcugagggcucaguccccaagacugccccauacuucagaugccaauggcaggucccagguugugaccugugcuucugacagagguuuuuaaaucaggguucucaugaccccuccucagguucgauuaauuugcuagcuuggcucacugagcucaaagaaacacuuacuuauguuuacccauuuauuauaaagggaacaauuuauuauaaagauuauaaaggaaacacaggaacagccagauuaaaaagacgcaaagggugaggcaugugggaagggugcaaagcuuccacacccucucgaggcagucacccuccaggaacccccaccuguucugcuaucuggaugcucauucaaacacuguccuuuuggguuuuuaugaaaacuucguuacauacgcaucauugaucacaaugcugucauuagugaucagcucgaccuucagccccccucucccucucaccuccccagaggucaggggcauggggcugaaaguucuaacaccguaaucacgcgguucguucccuuagcaaccagccaccauccuggcuauccaggagcccaccacaguuaucuuguuagaacaaaagaugcuccuaucaccugggaaauucuaagggauuuaggagcucuguuaucacccaggaaauuacaaagguuugagggugcucugugucaggaacauauuagaacaagagguucuccuagugccccuauccacaggguuuuaggagcucugugccaggaaugagggggcagagaccaaacacauauuucuuauuauaucacaguaccacaggugcugaaggauuuuauuuuuacuucuuacuuggaauaccucguguucauccacacugaaugucaacuacgaggagggagccguucuaggugcaggcacugcaggagaaggcauacgugcccuuucaggcuugcacugagacucaauagagcagaguagguuuuuuggacucugaagccaagaguuuaaaugccagccccaccuggcacucuauacacaguggguacuuaacuccuuggugcuacagucuucccauguugaaauuggggauaauuauaguaccuuaccugaaagggcugugagaggaaauaaaggcauuaauacaaauaaaacacuuagaauagcacucaguauauaguuagugcucgggaaguauuagcuauuaccaaaagaaauacauugaaaagagauaaacaauaaacacgugcaaaauuauuucaaaugguauuagugauauaagaaaaaaauaaggcaguggaaucaagagaguugcaguaggcacuccauuaguauuaaaucaacauuuuacaagaacauguguuacuucugauuaagaauaaaaaguggcaaaguaugauaaagguuguucuccuguuuuuuagagacagggucucuccaucugucacccucaaacuccuggccuccacagauccuccuaccucagccucuugaguagcuccuacuacaggugcaugccacugcaccuggcucauuacuuauuuuuuguagagaugggggguucuacuauguugacaggcugguaucaaacuccuggccucaagugauccuccugccuugaccucccaaagugcugggauuacaggcauugagucaucaggcauugagucaucaaucccagccaaaaguuguccuuuuuaguaaguuaaaagccugugccaucccucaaaaaaccuguggccuaacgacuucuugaaacucaguccugucccuaauuuuugccauaaauguaggguucauuuaaagaugacuuuucccaaaacuauacaugugaaauucaguuuucaaaucuuaaauucugacaugagaaugagaaacaaaaaagacccagaugaacucccagguaauccaaucucacaaucaugguuuaaaaaaaaaaaggacuugaauacauucacucaaguauguuugagcagcuacaauauucuaggcacaauggacagagauaaagacagugaccugaaacucagucuacugagaagagaacaguaugggguggugucagagaaagaaaaacacaggaugcaaaccucaauucagauugcagucaacugacagaacacuuccuaggggaagugacagcucaagaggucuuugaaggaugaguaaaagugaccacacaaaagaggcacaucagaagcagcagcaucaacacacgugcacuaguguggaggugagcucucaagagcugggaacuggaagugcugacaacucaggguuggggaggaccgauaaggcaaagagggagugacaggaagcaaggcuggagggacuaagccuccuguggcuuagcugggagaacaggaugacagcaagacugaaggcaaagaagagcuauugaagaauguacccgacggacaggcaacaucggaguugcauuuuuaaaagaucacuccagcagcaauguggaaaauguuuuggaggugguccagauuggcagcugggaaaucagucaguggagaguuacccaggcaagaaauauggauguggauugggaggagaaauuauuucaagagaaauucagaaagcaagauugacugcaccaggagacaggauggaugugggagaauguggaagugcaggagugacagagaugacuguaagguuucugucuuguacaucuguguggagagaaaauacagguagagcagcaggucuguggcuaggaacaggaggcagguauuguuaggggucucauucuggauaaucauuggugaagaacaugauguggaaaugcccagugacagcugaauaaaugagaaagaagcccaggaaaggacucaaggcaggaaauacccaaucugcgaagcacugacaaauggagaauacagaacauggagggggaaaaaacagggaaucaagaaggggauucugaggcaugacacagccauaggcagaaaagggcccagagaugacugagaagaauggugagagugaagaaagccaaccagccaagagcagugaaaccaagaaaaguuucccagaggacaagggcacugucaaguguuacagaaaagucaagguaaagaaucuacagcuccaacgggauuuagagacuaggugauuacuggugacuuuagcaagaaaagcuuuagcauagucauuaacacuuucugacuccucuccaccugcgacaacacuuuaugacuguagcauuuacuugguauuuagcauacuuucaacaaucagacugaagcccucccugugcacgagacuggggacacaagagggauaacugacacugcaggauccuggaaucuagagguguaaacagcuaaccaugacacaagagaaugacugcuacaggaaaccaguaaagggaguacuacuuaauucaguuuggcagacgcuuaaaaacaccaaccaugacacugggcacuggguuagcacagaugagucagaccuaaacauacaagcucccugaggucagggccuuucucuaaugcacugcuguguucccagcaccucacaagugucugacacacuauaaguaaucaacacauauuuacugaaugaauggcugaaugaacgaagacauggaccuuuucuuucaggagcaggaagggguggaagcuucaaaaacugcaauuugugaccuggauuaaagaaguaguacaggccaggcgcgguggcucacgccuguaauccccagcacuuugggaggcugauuggggguggaucaccugaggucaggaguuugagaacagccuagccaacauggugaaaccccaucucuacuaaaaauacaaaaauuagcugggugugguggugggcgccuguaaucccagcuacucgggaggcuuaggcacaagaacugcuugaaccuaggaggcggaggaugcagugagccgagaucgugccauugcacuccagccugggugacaagagcaaaacuccaucucaaaaaaaaaaagcagcagcagcagcaguaggauuuugcuaggaucauggagauuuuuauauucauuuuauauauauauauauauauauacacacacacacacauacgugugcacacacaaauauauaucuccuguacaaggcuaaguuacuagagucacacagauauuggucaaacacuaccuugccucuagcagguuaucaagaaacaguugauaggagagguagcaaugggagggcuuucuguggugcugggaauaaucuauguucaccauaugauaauucauugaaccgugcuuuuagaauuuauacauuuugcuagguguucuauuaguaauuaaaagguuuuuuuaaaaagaugcuaauaaacuguuuuuucucccccuaacuaccuacuacaaaacaagagaccuuaacuccuuuaggaaaaaggcacaacuuaacuacaggaaaggaucgcuaaggccuacagaaagcugguaagacaagaauaagaaacuucaaaggucgacccaggaagagggugcccaauaucugacuagcuaugggucuuaucagcaaagaaguaauaacucacauuagucagugggacuuaaacuauaaaggcuccuuaucacuaucaaugccuccauuccuggacccugucaggcacagaugccagggagcagugcuggcuagaacuggacggcaagacugaccaaagauacacuggagggacaaguucaagggaucgauugcaccacaugcugacuauggucaauggcaauguauuguauacuugaaaauugccaagagaguagauuucaauuguucucaccacaaaaaaaugacuaagugagguaacagauaugcuaauuagccugauuuaaccauuccacaauguauacauacauuaaaacauuaaugggcacaccauaaauauauuuucauuugucaauuaaaaucaaugaauaacuauuuaaaaacauuuuuaaaggcugaccaggccgggcacaguggcucacgccuguacucccagcacuuugggaggccaaugccgggggauaacuugaggucgggaauucaagaccagccuggccaacauggugaaaccccgccucuacuaaaaauacaacaaguagccgggcaugguggcacacgccuguagucccagcuacuugggaggcugaggcaggagaauugcuugaacccggcagaggcugcagugggccgagaucgcgccacacuccagccugggcagcacagcaggacucugucuggggcgggggccggggugggggaaggcuggccaaccagccuguucugacagcacaucugcacagaacaugaaucacgguaccggcaagugaccggcccacugcagaagcauugcuauguauauaccucugcauacauuuuaucguuuaacccuaacaccucuccaaaccagacaucaucuccuuuucacagauguaggaauagguucagaagaaacagauuaaaaguggccaaauagggauguuaacacaagccuggcugacuccaaaacccacgcacguucuccacuccaucaagcuuccugggcuuaccucaacaaggaagcaucuucugaacaaaccagggauucucuaucuuaacuugaaguggacacauuauaaagcuucaauucuaucacaccaaaaaaacaccuuaaacuccaccaagacccagcaagaagagccucauggcaggcuaggacugaguucuucccagaagacaggucuaaaacacaagcuuuuccaccuuaacaauggaugucuccugaccccuuccuccagaaaucaaauggccaaucugaugcccacuucagcuucugucaucccucuguagucagacaaggagggcucgcucagcuugcauuuccuuccugaagaguauucacuaccucucuuguucaaacacuauguaucacucaauauucuauuccuucugcucucaaauguuuacuuucucuacaaaaggagguagagaaaaauguagccauugacuaauaaaaaaagcauaucuuaccucaaucaaaaaaaaagcauugaguuaaacaaaauaggugacaguucuuuaagagcuugacaauacgaauuuaaaguuaaaaguuuaaguuaaagucacucucugauuuuuucuuucuuuuuuuuuugagacgaagucuugcucugucauccaggcuggagugcaguggcacgaucucggcucacugaaaucuccgccucccugguucaagugauucuccugccucagccucccgaguagcugagauuacaggcacccgccaccaugcccagcuaauuuuuguauuuuuaguagagaugggauuucaccauauuggucaggcuggucucgaccuccugaccucagaugaccugcccaucccggccucccaaagugcugcgaugacaugcaugagccacugcacccagccugauuuuuuuuaaugcaccacuaaacaggcaccuaagccaucuagcaugcacacuuacaagaccaagcucagugacugacaaugugccagcaaucuuauccaggugaugguaccccaagaggaaauacaaaugugaacagcaaagggacaacuauccacaucccccagcaacagguuuaauguuaaaacuaguauuagaagcaguaacugagcaaaguaacucauucuucaaccauucaacagauauuugagugucuaauguuuacaauuuuaaauagagugaucaugagaaggagacacgugagcaacacuugaaggagggaaggugguuaacgauacugauaucaagagaugcccuggcagaaugaacagccagugcaaaggaugcauuucuagggcccucccgaucuuguuguagacuuaauuuacuaggaguaaaaugggaagccacugcaggguuguaucagagcagggaauuauccaacuuucauuuucacgggaucacucuggcuguuaugagaauagaauguguacacaaagaaagaagagggagaugggucaggagacaacugcaaugaugcaacugacagaugaugaugaccuggaccaggguagaagcaaaggaguggaaaagugcucaggcugcagauauguugugaaggcagggccaacaggauuuccuaagggaauggauccaagucacuuagcgauuaugaaugcaaacauguuugaagacuacaguccaacgucaacacucuuaccagcccauucuucauaagcucucucuagacagccugagaggcuacagaagaaauaaagaguagucaaggauaaccccgagguuuuaggccugagcaacuagaaagaugaagcugucaucaacugagauggugagguuaaagauugagcacguucaaggggugagaugaggaguucaauauuggaaauguugagauuccuaugauacacagaguuugaaaaaaaauuacuuaauauuugguuauucuacaaacauuugagaaccuccucauccuucccguuuuuggacacuuguuagcuucaggcaauagugagguaaaacaaagucccugauccugagagcucagucuagagaagauagacuaaacaagcaaggaccacacagggcaagggaaaaaaauucuguaacugaggucuguuuaggaugcuuuggcaacauagaagaggaggccccaaaaagagcaaaagagcaacaccugcaaaggcuuaaaagugacaguaagcauacugaagggucccaggaccuucaggaaaucuaacugguauccaguugagaugaauguuagcaaacggcaggggaugucagucuuucagaaccccaccaaagaaagcuuacaaaugacuaccacuuacacagguucagauucaagaaguacuuugugugaccagugguaacaauuacaggauacucaaggcuaguuacagaacugucaaaauguaagggcuuguaaggacccucuucuguagaugaauauacagauacuuaauaaguaaguggcaacagugggcuggaacacaagggcugugguuugaaaguguccuccaaaguucacguguugaaaacuugaugcccaauguggcaguguugggaaguggggccugaugggagguguuugcaucuuggaggcaccaccaucaugaacuggauuaaugccauuaucgugggagcagauucguuaugacagggguggguuccuuauaaaaggaaccucuuguuugaaacuuuugugcacgaggacaggcacuucccucccccuccucuccuccugcccuucugccuuccaggacgggaugaccaugacacagcaaaaaggccaggugucaggcacucaaucuuggacuucuuagccuccagaacuguaagaaauaaauuucuguucauuaucagguauucugcuauagcaguacaaaacagacuaagacaccaagcuaccuaaaucaguugucuucaaacuaggguacaugaaaacuuccugagccacaugaaagcaagcauacuuuuucacaaucaggcuucucccacuuuacaaaauaaaggcccaucaccccuccacucugaauccaugcaaaaaggugaucuaaaauacucgagcugauacuggaagaugaaugacuuaaugacugaauaacaauuccuuuuacaagucuggagguuuccaguuuuccugcuuucuacaaaauuagaggagaugaauggcaagcuaguugauucaaaaaauccacuguauuuugacauauaauuuuaaagguaaaaacugagucuaagugaccuucauauaacaauauucuguccauuuccaucuacuuauuuaugucaacaggguuccuuaaagcuuagaucuauacaaaugaaaaaucuuauucuaguauuaaauaguaauuauccacagaaucaucaaauaauuggggguggaaggcucuaucucaucaagauguuuucuucaaaaaaauguauaacauauccauuugguuguuuuuuuuguuuuguuuuuuguuuugagacggagucuugcucuugucgcccaggcuggaguguaguggugcaaucucagcucacugcaaccucugcuuccuggguucaagugauucuccugccucagccuccggaguagcugggauuacaggcaccagccaccaugcccagcuaauuuuuguauuuuaguagagacgggguuuccccauguuggccaggcuggucuugaacuccugaccuuagguaaucugccugccuaggccucucaaagugcuaggauuacaggcaugagccaccgcgcccggcaguauccauuuguuuugaugaauuuuauacuaauaaguacaguaguaaugcaaucgaaaagaaauaaauacuuagauucaugagaacaggaaauaaaauuuuaauguauacuucugucacgugugauagaacgaccaauaaaauauuuucaagcauaaaaauaaaugaaauuaaauuaauauuuugcaggggaaguggaacugaaauaugauugaggaaaaaagaaaaauaaacauuucugacucaaauaagagcuuguucaucuacauguuuuaaaauguaugacaauaggucaaauuauuauagauuuagagcccaucagauacauuuaaaagaauaaugaaacaauuguuguuuuuaaguguauauuuacaauauaucagaaaucacuuccuuuucaacucuuuauuuauaaugaaaaaaacugaugucaaaaauaugugauggggcccaguacaguggcucuugccuguagucccagcaccuugggagcccaagacaggacgaccgcuugaggccaggaguucaugccagccugggcaacauagugagacacagucucugaaauaauaauaauaauaauaauaacuaauuuuaaaaauacauauuuuuacaacauauaaaaauauauauauuauaugugcaaaaugggaugaagaauucuccagaauucucuuagcgguuaugaauacaaaaaugucuuuuagaccauaguccaaaaucagcacuguuaucagcccauucuaucacaagcuuucucuagacagccuaggagacuagaagccugcgaagggcaaagacagugcucaucuccacucccagggaaaagcaaucccagaaacacagaacuuuggacuucuagaggacaggcaagggaaagcagagcaugcuagcugagaugacaaaacagcccuugcucccugcuagucagccaaaaaaaagguaaaaaugucagaccaaauagcauacuuaugggcugaauaaagaaauaaagaagcacaacucuacaacccacacaaaauuguuauguuucugccauguacguaccaggcaaaauucuuaccaaacacuacaugggacaggaagaaaaaguacugccugcuggucaccugucccauaggguacugaagguuaaguguaggcauucacagaaauacugacacuuuuccuguaguuucacagggagaaaccaaguaaaaacaacugcuuuaaaaaaaacaaaaaaagaaagaaagaaacccauguuauggaaagaguauugccaauagcgaguuggcaaagcaaacugaauuuuucagaguugucaccuucugucauuguucaaaauucucaggcauacauuuagaaccacugcccccucauccaaucaaauuauggcuuaugaggccugaaagccuaaugcuggagggcuuuauaugguucuuuauauuuuucagguuauucuauuaaauugucuacuaauugcacuuuuuuuguuuuuucugauauagggucuugcucuguugcccagguuggauugcaauggugggacuaaggcucacuccagccucaaccucccaaggcucaggcaauccucccacuugagucucccaaguagcugggacuacaggaugaaaauuuucuagcucguuuuaaggaaaagccauagcauaacuggaggaugggaauaucaugauuuaguaaguacuacaaaaugaugacuuuccucuacuuggaucuuuuuagagguaacuuuuucaaauaugauaaucauuaaauaaaaauucagaagacuaaacuuagaacaaaaccuucagucuugaaugaccaccaaaacuaacaccaccaaggucauccaagacucaccaaguauuaaacaagauuuuuaaaaauaaaacgucuuucaaucuucagucacaaauaaaaaauauuuuaguaucaaaagauuuuauaccauuaaagaaauuauguuucuaaauguuuccuuuuucucauuuuuuauuccuauuuuguaugucauaauuauauauggguuauacuuauauauuuuauauauaugaugaaaagaucgaaugcuuucaugacaaaucagcuuaaugacugaaaugguuuaauggacacgaaagcauacagacaugcauacacacucacauauaaaaguauacucucaaccccuuuuuauugauuuuaaaauacugaaauacaagucuaagauuuagagaccuuaaguaguuccaacagcaccaucacagagcccacuagcaaaaaaggucaggucuucagcagugaaauucccaaagacaaucugucuccaucacagaaccucauaaaagcaagauuugacaaagaaaugacaugaaagcaaaugcuauguagugaacugguaggugaccacaaacagagugagcaucagaaaccauacuucaaagacacucaaggaacaaagaagaaauacagccugaggaaaggcagcaggauaggaacuacuggaggcagcaggacccaggguuucuucuucauucuaccagacaucgugcuaggcauggcucagugaacaagcaggagagauucaggcagagcagacagcaaaugcggacauccuuggcugggggaaagccugccaugccaagagugggucuggcuggacuagcuagaguaagggggaaagggaagaagguccgaagggccagaucauggcagcaguuugaggugacggaaaacacacaaugccaucucugagaaaagcagcaaaaggaccaaaccagccccacaguccugggaacaccugacaggaagguguggaauacgugaucuggcuggauggggauggcgaccaagguuccagaacagagcagugggcgccgacacggguccagagcacauucugaagcauuccaaaagcagaugcugacucacggccaagcugcacugagguggcaguccacaccucagaggggacagcaucuccucucuuauccuauaauggucacacacaggccaaccucccuaaaaauauuuacacgaagaggccacugcuuguggagaaaguucaaaacagguacagauuuuaagaaaaaaaaccggccgggcacagaggcucaugccuguaaucucagcacuuugggaggcugaggcggaucaugaggucagaagaugagaccagccuggccaacacagugaaaccccgucuccacuaaaaauacaaaaauuagccggacauuguggugggcaccuguaaucccagcuacuugggaggcugaggcaggagaaucgcaggaguuguagugagccgaguucgcaccccugcacuccagccugggugacagagcaaggcucugucccaaaaauaaauaaaaaauaaaacccuagauccuaaucccaguccuaccacuaagucaaaaguuccccuaaccucaucuuccauugucaucuaccaguagggaagacacaugccugacuucaaagggaauagauaaucaaaugcuuuaaugauaaagugacuugguaauaaacacaguggaagaaauuuauaaacaguaaacugcuaaggacagagaccuucuuucaugguuucuuaaauccuuauuuccccucaaucccaagcacuuaaacagguuaaguaagaaaaaguauucucucacagaacacauacucuacgggaagaagcagucaacaaauaagcauaagacaagaaagauaugguaagucuauggaagcagaagacagaaaaaauaauucucauuaaggaaauggguaacaaagcucccucaagaaaguauuaacagagcugagccuuaaaaagacuaaaggccauuacaaaaagaagaccacugagcaaaaauguaagugaagacaguucaguaagauggucugugugcauuuggcuguguagaaaaauaaggccgggcacgguggcucaugcauguaaucccaacgcuucgggaggccaaggcaggcagaucaccugaggucaggaguucgagaccagcccggccaacauggugaaacccccaccucuauuaaaaauacaaaaaaacuagccaggccugguggcacaugccuauaaucccagcuacucaggaggcugaggcaggagaauugcuugaacccaggagguggagguugcaguaaaccaagauggcaccacugcauuccagccugagugacagagugagauuccaucucaauaaaaaauaaaauaaaaaauaaaaauaauagccugggaccauauuaggggccaaggggauuuguacuguacugaaguguuugaccuguacugagcaguggggaguuacccaagguuuccaaaaaggaaaauggcacauccagagcuauuccuaaggaagaccacucugauggcaguguaauggagcagauuuuucucguuucagaggcuauuuuaguuguccaaugaagagguuacagaacaaggaacaggcaaagaugaaaaggaaacagaaugacaccuaaaagucacagauauguaugcaggcaaagaaguuuagccuggguuuuuuuccaccuuuuaguguuauuacaccuguccuuuagggggaaauaugaaaaucugguuugguuugcuuuugagauggggucuugcuacguugcccagucuggaguacaguggcaccaucaaagcucacugcagccuccaaguccuaggcucaagccauccuccugccucagccuccugagaagcugguggcacauacauggcuaauuuuuaauuuuucguagagacggggucucucucuguugcccaggcugguuuugaaggcauccuccuuccuuggccucccaaagugcugggacuagaggugugagccaccguacucagccauaaccuuuuuugguuuuuguucgagacaggucuugcucugucacccaggcuggaguguaguggcacaaucacagcucacugcagccucgaccucccauacucaagcauuccucccaccucagccucuagaccugcagcacugcaccuggauaauuuuauuauuuguagagaacaagucucaccauguugcccaagcugagaaucugguuuuaaacauaggucaaaauaacuuucucgacccaccacaauuuucauuuuauacagauggggucucacuauguugcccaggcuggccucaaacucccgggcucaagcaauccuccugucucugccucccaaaaugcuaggauuacaggugugagccaccaggcccagucuuggacuuuuuuaauaacaaaaauaucaauaaucuuaaaggaugacaaacuaucaaucauucguaugucaaaaauguacaaacaagcuugggcaacauggugaccuagucucuacaaaaaauaaagauugccggcgugguggcgcacaccuguaaucccagcacuuugggaggccgaggcgggcggaucacaaggucaggagauugagaccauccuggcuaacacagugaaacuccguguuuacugaaaauacaaaaacauuggccaggcgugguggcgggcaccuguagucccagcuacuugggaggcugaggcagaagaauggcaugaacccgggaggcggagcuugcagugagccgagaucaugccacugcacuccagccugggcaacagagcaagacucugucucaaaaaaaaaaaauaauaaaaaaaauaaagauuaaaaagccagcccagguaguggcucacaccuguaaucccagcacuuugggaggcagaggcgggcggaucacuuaagucuaggcauuugagaucagccuggcaacauggcaaaaccccuucucuacaaaaaaaaaaaaauuagucgggcaugauggugcaagccuguagucucagcuacucuggaggcugaagugggaggaucacuugagcccaacagguggaggguacaguaagccaagaucucaccacggcacuccagccugggcaaaagagugagacccugucucaaaaacaaaacaaaucaaacaaacaaaaaaauuagccagucaugauagugccagccuguacucccaguuacuccagguugaggcugaggcugcagugagcugugacagugccacuuacucugggcuagguggaaaugcgagaccuugucucaaaaauuaaauuaauaaauaaaaauguacaacaugcuuugaaaacugcagaaaaacggacccuuccuuucuugagaguuucuacacucuuccuccuggauaaaaauagcagagaauuagcuacucccacauuggcucaccacuaucccaucccucacuuuacccaaguaacaccaaaagcuugauuaucaaguuagaacaggugacgacugagaaacacacaagaagaacaauaacagaguuauucaccuuuuagggucgcaguuuucacccucgugguaacuaaauuauucagaugauuaccaagaucauuuuguuucuaaaagcucauaugcaaguuuaagccuccuccccacuuuaggaggacuggacuucagcuuaaaauuuggaccccacuacaugccaggcaggcauugugcuaggagggcugggaaaacagccaugaacaacaacaacaaaaaaugcucccaauccaacaggaauaugccagaagagcaagaauaauucuaaaagaacagguaaagcuuccugaagggcuagcauucugguuuugcuuugaauuacuaguauaagucauaguaaagaacauacucaaaaauuacaaauuuuuuuaaaagccuucaaccagggagcacacagaacagaaacuucaggaccuaaagcaggccgauuccuaaccccgggagcuacggacgagaucaacuucaucaauaaagaaguccagcagcgccagccgccgugucuggcugggcuccuugcgcuaaaguaguccagaccaggagggaaaaauguaaaaccaacauggaggaggggcuacugacgagucgguucgggagcuaaaaccucguggcucuuuccucauggcgccaaccagccuuccugcucugcucuccccagccgggagaagcaucauccugccucuccaaaccagcacccagcacccagcucucaggaucccuugaggaacccgugcuccaaaugaaguuggaggguguuaaacggugggaaaaacaaguagccacaucuuaaaggcuguuaggggagcaaagaaagaaccaucugggaggacuccacccuucuccaccugcagaaaaaaccccggguaaagcuaggaagucauuucccuugucucuccuugccuugcggauaaaacaaaggaaacaggcuccuaagagggucagacacccauacgaugacccccuuccguggauccaagacgcguacguccuggacaccgaagagcuuggagccaguacaacuuucucauugaagccgaccacguuuccucuuauaaccuuaaaaaacagaagccccuacuauuaucguuucauugaugucacggcaccuauuuggcucucagacuuuuacccggaaaccccuguaauccccagcccuugcgugcagccccacacugggcuccccuuccccgggaugccgccucgcgcguucccgccacccucgcccucucggccgcgcuucccggcucgcuccgcccucggcaccaggcugcgccgcggggcgagcacgucugugccagaccggggcuugagggaguccaucggggguuagugggggauccugcggaaagcccucucccccgacacuggaguugcaaaacaauaagcauccgcuucccugcccuucccccauaggaccccggccacgaguuauuaacgcggggggagaaaagccggaggagcacucccgcccugcgaucguggccgcguacccccggaacccccaaggcccgagucuucgccugcccccgccgcagcgcccccaggccgcgcggggcgcacucggcgcuggagcgcggccgggagcggaggcgcgcgggccacgcgguggcugccgcaacugacacggcccgcggccgccggccacaugcgccgcccagggacagaagccgggaagggagcgcggcuccgggccccgccguaccuugccgcuagcuguucccccgcugacgccuauaaggaagggcucgccgccguugggcugcuggugguucugcagggucugcucgcuguccccggccaugguucgcgccgccccuccucccgcugccugugcgaacggacgcacgcuccccgcccgcgcccgcgucggacucccuccgcuuuccgcagccgccgcugggcgcugccggggcugaggccgcugucgcucgccugcgagccgcucggagcccggugacggggcuggguuucccgaaggagccaagagccuuccuuugcccgcagcggcugguccgguuuacaucccaggcagaggucagcgugaugcugcugcuccaauccgggcgggcagcgcgcugcuauucgccgaggcggaggcggcgaggcgucuggccccagccuccgccccucccgggccccg

SEQ ID NO: 191160 - RNA, 84124 nt, Homo sapiens
cggggcccgggaggggcggaggcuggggccagacgccucgccgccuccgccucggcgaauagcagcgcgcugcccgcccggauuggagcagcagcaucacgcugaccucugccugggauguaaaccggaccagccgcugcgggcaaaggaaggcucuuggcuccuucgggaaacccagccccgucaccgggcuccgagcggcucgcaggcgagcgacagcggccucagccccggcagcgcccagcggcggcugcggaaagcggagggaguccgacgcgggcgcgggcggggagcgugcguccguucgcacaggcagcgggaggaggggcggcgcgaaccauggccggggacagcgagcagacccugcagaaccaccagcagcccaacggcggcgagcccuuccuuauaggcgucagcgggggaacagcuagcggcaagguacggcggggcccggagccgcgcucccuucccggcuucugucccugggcggcgcauguggccggcggccgcgggccgugucaguugcggcagccaccgcguggcccgcgcgccuccgcucccggccgcgcuccagcgccgagugcgccccgcgcggccugggggcgcugcggcgggggcaggcgaagacucgggccuuggggguuccggggguacgcggccacgaucgcagggcgggagugcuccuccggcuuuucuccccccgcguuaauaacucguggccgggguccuaugggggaagggcagggaagcggaugcuuauuguuuugcaacuccagugucgggggagagggcuuuccgcaggaucccccacuaacccccgauggacucccucaagccccggucuggcacagacgugcucgccccgcggcgcagccuggugccgagggcggagcgagccgggaagcgcggccgagagggcgaggguggcgggaacgcgcgaggcggcaucccggggaaggggagcccaguguggggcugcacgcaagggcuggggauuacagggguuuccggguaaaagucugagagccaaauaggugccgugacaucaaugaaacgauaauaguaggggcuucuguuuuuuaagguuauaagaggaaacguggucggcuucaaugagaaaguuguacuggcuccaagcucuucgguguccaggacguacgcgucuuggauccacggaagggggucaucguaugggugucugacccucuuaggagccuguuuccuuuguuuuauccgcaaggcaaggagagacaagggaaaugacuuccuagcuuuacccgggguuuuuucugcagguggagaaggguggaguccucccagaugguucuuucuuugcuccccuaacagccuuuaagauguggcuacuuguuuuucccaccguuuaacacccuccaacuucauuuggagcacggguuccucaagggauccugagagcugggugcugggugcugguuuggagaggcaggaugaugcuucucccggcuggggagagcagagcaggaaggcugguuggcgccaugaggaaagagccacgagguuuuagcucccgaaccgacucgucaguagccccuccuccauguugguuuuacauuuuucccuccuggucuggacuacuuuagcgcaaggagcccagccagacacggcggcuggcgcugcuggacuucuuuauugaugaaguugaucucguccguagcucccgggguuaggaaucggccugcuuuagguccugaaguuucuguucugugugcucccugguugaaggcuuuuaaaaaaauuuguaauuuuugaguauguucuuuacuaugacuuauacuaguaauucaaagcaaaaccagaaugcuagcccuucaggaagcuuuaccuguucuuuuagaauuauucuugcucuucuggcauauuccuguuggauugggagcauuuuuuguuguuguuguucauggcuguuuucccagcccuccuagcacaaugccugccuggcauguagugggguccaaauuuuaagcugaaguccaguccuccuaaaguggggaggaggcuuaaacuugcauaugagcuuuuagaaacaaaaugaucuugguaaucaucugaauaauuuaguuaccacgagggugaaaacugcgacccuaaaaggugaauaacucuguuauuguucuucuuguguguuucucagucgucaccuguucuaacuugauaaucaagcuuuugguguuacuuggguaaagugagggaugggauaguggugagccaaugugggaguagcuaauucucugcuauuuuuauccaggaggaagaguguagaaacucucaagaaaggaaggguccguuuuucugcaguuuucaaagcauguuguacauuuuuauuuauuaauuuaauuuuugagacaaggucucgcauuuccaccuagcccagaguaaguggcacugucacagcucacugcagccucagccucaaccuggaguaacugggaguacaggcuggcacuaucaugacuggcuaauuuuuuuguuuguuugauuuguuuuguuuuugagacagggucucacucuuuugcccaggcuggagugccguggugagaucuuggcuuacuguacccuccaccuguugggcucaagugauccucccacuucagccuccagaguagcugagacuacaggcuugcaccaucaugcccgacuaauuuuuuuuuuuuuguagagaagggguuuugccauguugccaggcugaucucaaaugccuagacuuaagugauccgcccgccucugccucccaaagugcugggauuacaggugugagccacuaccugggcuggcuuuuuaaucuuuauuuuuuuuauuauuuuuuuuuuuugagacagagucuugcucuguugcccaggcuggagugcaguggcaugaucucggcucacugcaagcuccgccucccggguucaugccauucuucugccucagccucccaaguagcugggacuacaggugcccgccaccacgccuggccaauguuuuuguauuuucaguaaacacggaguuucacuguguuagccaggauggucucaaucuccugaccuugugauccgcccgccucggccucccaaagugcugggauuacaggugugcgccaccacgccggcaaucuuuauuuuuuguagagacuaggucaccauguugcccaagcuuguuuguacauuuuugacauacgaaugauugauaguuugucauccuuuaagauuauugauauuuuuguuauuaaaaaaguccaagacugggccugguggcucacaccuguaauccuagcauuuugggaggcagagacaggaggauugcuugagcccgggaguuugaggccagccugggcaacauagugagaccccaucuguauaaaaugaaaauuguggugggucgagaaaguuauuuugaccuauguuuaaaaccagauucucagcuugggcaacauggugagacuuguucucuacaaauaauaaaauuauccaggugcagugcugcaggucuagaggcugaggugggaggaaugcuugaguaugggaggucgaggcugcagugagcugugauugugccacuacacuccagccugggugacagagcaagaccugucucgaacaaaaaccaaaaaagguuauggcugaguacgguggcucacaccucuagucccagcacuuugggaggccaaggaaggaggaugccuucaaaaccagccugggcaacagagagagaccccgucucuacgaaaaauuaaaaauuagccauguaugugccaccagcuucucaggaggcugaggcaggaggauggcuugagccuaggacuuggaggcugcagugagcuuugauggugccacuguacuccagacugggcaacguagcaagaccccaucucaaaagcaaaccaaaccagauuuucauauuucccccuaaaggacagguguaauaacacuaaaagguggaaaaaaacccaggcuaaacuucuuugccugcauacauaucugugacuuuuaggugucauucuguuuccuuuucaucuuugccuguuccuuguucuguaaccucuucauuggacaacuaaaauagccucugaaacgagaaaaaucugcuccauuacacugccaucagaguggucuuccuuaggaauagcucuggaugugccauuuuccuuuuuggaaaccuuggguaacuccccacugcucaguacaggucaaacacuucaguacaguacaaauccccuuggccccuaauauggucccaggcuauuauuuuuauuuuuuauuuuauuuuuuauugagauggaaucucacucugucacucaggcuggaaugcaguggugccaucuugguuuacugcaaccuccaccuccuggguucaagcaauucuccugccucagccuccugaguagcugggauuauaggcaugugccaccaggccuggcuaguuuuuuuguauuuuuaauagagguggggguuucaccauguuggccgggcuggucucgaacuccugaccucaggugaucugccugccuuggccucccgaagcguugggauuacaugcaugagccaccgugcccggccuuauuuuucuacacagccaaaugcacacagaccaucuuacugaacugucuucacuuacauuuuugcucaguggucuucuuuuuguaauggccuuuagucuuuuuaaggcucagcucuguuaauacuuucuugagggagcuuuguuacccauuuccuuaaugagaauuauuuuuucugucuucugcuuccauagacuuaccauaucuuucuugucuuaugcuuauuuguugacugcuucuucccguagaguauguguucugugagagaauacuuuuucuuacuuaaccuguuuaagugcuugggauugaggggaaauaaggauuuaagaaaccaugaaagaaggucucuguccuuagcaguuuacuguuuauaaauuucuuccacuguguuuauuaccaagucacuuuaucauuaaagcauuugauuaucuauucccuuugaagucaggcaugugucuucccuacugguagaugacaauggaagaugagguuaggggaacuuuugacuuagugguaggacugggauuaggaucuaggguuuuauuuuuuauuuauuuuugggacagagccuugcucugucacccaggcuggagugcaggggugcgaacucggcucacuacaacuccugcgauucuccugccucagccucccaaguagcugggauuacaggugcccaccacaauguccggcuaauuuuuguauuuuuaguggagacgggguuucacuguguuggccaggcuggucucaucuucugaccucaugauccgccucagccucccaaagugcugagauuacaggcaugagccucugugcccggccgguuuuuuuucuuaaaaucuguaccuguuuugaacuuucuccacaagcaguggccucuucguguaaauauuuuuagggagguuggccugugugugaccauuauaggauaagagaggagaugcuguccccucugagguguggacugccaccucagugcagcuuggccgugagucagcaucugcuuuuggaaugcuucagaaugugcucuggacccgugucggcgcccacugcucuguucuggaaccuuggucgccauccccauccagccagaucacguauuccacaccuuccugucagguguucccaggacuguggggcugguuugguccuuuugcugcuuuucucagagauggcauuguguguuuuccgucaccucaaacugcugccaugaucuggcccuucggaccuucuucccuuucccccuuacucuagcuaguccagccagacccacucuuggcauggcaggcuuucccccagccaaggauguccgcauuugcugucugcucugccugaaucucuccugcuuguucacugagccaugccuagcacgaugucugguagaaugaagaagaaacccuggguccugcugccuccaguaguuccuauccugcugccuuuccucaggcuguauuucuucuuuguuccuugagugucuuugaaguaugguuucugaugcucacucuguuuguggucaccuaccaguucacuacauagcauuugcuuucaugucauuucuuugucaaaucuugcuuuuaugagguucugugauggagacagauugucuuugggaauuucacugcugaagaccugaccuuuuuugcuagugggcucugugauggugcuguuggaacuacuuaaggucucuaaaucuuagacuuguauuucaguauuuuaaaaucaauaaaaagggguugagaguauacuuuuauaugugaguguguaugcaugucuguaugcuuucguguccauuaaaccauuucagucauuaagcugauuugucaugaaagcauucgaucuuuucaucauauauauaaaauauauaaguauaacccauauauaauuaugacauacaaaauaggaauaaaaaaugagaaaaaggaaacauuuagaaacauaauuucuuuaaugguauaaaaucuuuugauacuaaaauauuuuuuauuugugacugaagauugaaagacguuuuauuuuuaaaaaucuuguuuaauacuuggugagucuuggaugaccuuggugguguuaguuuugguggucauucaagacugaagguuuuguucuaaguuuagucuucugaauuuuuauuuaaugauuaucauauuugaaaaaguuaccucuaaaaagauccaaguagaggaaagucaucauuuuguaguacuuacuaaaucaugauauucccauccuccaguuaugcuauggcuuuuccuuaaaacgagcuagaaaauuuucauccuguagucccagcuacuugggagacucaagugggaggauugccugagccuugggagguugaggcuggagugagccuuagucccaccauugcaauccaaccugggcaacagagcaagacccuauaucagaaaaaacaaaaaaagugcaauuaguagacaauuuaauagaauaaccugaaaaauauaaagaaccauauaaagcccuccagcauuaggcuuucaggccucauaagccauaauuugauuggaugagggggcagugguucuaaauguaugccugagaauuuugaacaaugacagaaggugacaacucugaaaaauucaguuugcuuugccaacucgcuauuggcaauacucuuuccauaacauggguuucuuucuuucuuuuuuuguuuuuuuuaaagcaguuguuuuuacuugguuucucccugugaaacuacaggaaaagugucaguauuucugugaaugccuacacuuaaccuucaguacccuaugggacaggugaccagcaggcaguacuuuuucuuccugucccauguaguguuugguaagaauuuugccugguacguacauggcagaaacauaacaauuuuguguggguuguagaguugugcuucuuuauuucuuuauucagcccauaaguaugcuauuuggucugacauuuuuaccuuuuuuuuggcugacuagcagggagcaagggcuguuuugucaucucagcuagcaugcucugcuuucccuugccuguccucuagaaguccaaaguucuguguuucugggauugcuuuucccugggaguggagaugagcacugucuuugcccuucgcaggcuucuagucuccuaggcugucuagagaaagcuugugauagaaugggcugauaacagugcugauuuuggacuauggucuaaaagacauuuuuguauucauaaccgcuaagagaauucuggagaauucuucaucccauuuugcacauauaauauauauauuuuuauauguuguaaaaauauguauuuuuaaaauuaguuauuauuauuauuauuauuauuucagagacugugucucacuauguugcccaggcuggcaugaacuccuggccucaagcggucguccugucuugggcucccaaggugcugggacuacaggcaagagccacuguacugggccccaucacauauuuuugacaucaguuuuuuucauuauaaauaaagaguugaaaaggaagugauuucugauauauuguaaauauacacuuaaaaacaacaauuguuucauuauucuuuuaaauguaucugaugggcucuaaaucuauaauaauuugaccuauugucauacauuuuaaaacauguagaugaacaagcucuuauuugagucagaaauguuuauuuuucuuuuuuccucaaucauauuucaguuccacuuccccugcaaaauauuaauuuaauuucauuuauuuuuaugcuugaaaauauuuuauuggucguucuaucacacgugacagaaguauacauuaaaauuuuauuuccuguucucaugaaucuaaguauuuauuucuuuucgauugcauuacuacuguacuuauuaguauaaaauucaucaaaacaaauggauacugccgggcgcgguggcucaugccuguaauccuagcacuuugagaggccuaggcaggcagauuaccuaaggucaggaguucaagaccagccuggccaacauggggaaaccccgucucuacuaaaauacaaaaauuagcugggcaugguggcuggugccuguaaucccagcuacuccggaggcugaggcaggagaaucacuugaacccaggaagcagagguugcagugagcugagauugcaccacuacacuccagccugggcgacaagagcaagacuccgucucaaaacaaaaaacaaaacaaaaaaaacaaccaaauggauauguuauacauuuuuuugaagaaaacaucuugaugagauagagccuuccacccccaauuauuugaugauucuguggauaauuacuauuuaauacuagaauaagauuuuucauuuguauagaucuaagcuuuaaggaacccuguugacauaaauaaguagauggaaauggacagaauauuguuauaugaaggucacuuagacucaguuuuuaccuuuaaaauuauaugucaaaauacaguggauuuuuugaaucaacuagcuugccauucaucuccucuaauuuuguagaaagcaggaaaacuggaaaccuccagacuuguaaaaggaauuguuauucagucauuaagucauucaucuuccaguaucagcucgaguauuuuagaucaccuuuuugcauggauucagaguggaggggugaugggccuuuauuuuguaaagugggagaagccugauugugaaaaaguaugcuugcuuucauguggcucaggaaguuuucauguacccuaguuugaagacaacugauuuagguagcuuggugucuuagucuguuuuguacugcuauagcagaauaccugauaaugaacagaaauuuauuucuuacaguucuggaggcuaagaaguccaagauugagugccugacaccuggccuuuuugcugugucauggucaucccguccuggaaggcagaagggcaggaggagaggagggggagggaagugccuguccucgugcacaaaaguuucaaacaagagguuccuuuuauaaggaacccaccccugucauaacgaaucugcucccacgauaauggcauuaauccaguucaugaugguggugccuccaagaugcaaacaccucccaucaggccccacuucccaacacugccacauugggcaucaaguuuucaacacgugaacuuuggaggacacuuucaaaccacagcccuuguguuccagcccacuguugccacuuacuuauuaaguaucuguauauucaucuacagaagaggguccuuacaagcccuuacauuuugacaguucuguaacuagccuugaguauccuguaauuguuaccacuggucacacaaaguacuucuugaaucugaaccuguguaagugguagucauuuguaagcuuucuuuggugggguucugaaagacugacauccccugccguuugcuaacauucaucucaacuggauaccaguuagauuuccugaagguccugggacccuucaguaugcuuacugucacuuuuaagccuuugcagguguugcucuuuugcucuuuuuggggccuccucuucuauguugccaaagcauccuaaacagaccucaguuacagaauuuuuuucccuugcccugugugguccuugcuuguuuagucuaucuucucuagacugagcucucaggaucagggacuuuguuuuaccucacuauugccugaagcuaacaaguguccaaaaacgggaaggaugaggagguucucaaauguuuguagaauaaccaaauauuaaguaauuuuuuuucaaacucuguguaucauaggaaucucaacauuuccaauauugaacuccucaucucaccccuugaacgugcucaaucuuuaaccucaccaucucaguugaugacagcuucaucuuucuaguugcucaggccuaaaaccucgggguuauccuugacuacucuuuauuucuucuguagccucucaggcugucuagagagagcuuaugaagaaugggcugguaagaguguugacguuggacuguagucuucaaacauguuugcauucauaaucgcuaagugacuuggauccauucccuuaggaaauccuguuggcccugccuucacaacauaucugcagccugagcacuuuuccacuccuuugcuucuacccugguccaggucaucaucaucugucaguugcaucauugcaguugucuccugacccaucucccucuucuuucuuuguguacacauucuauucucauaacagccagagugaucccgugaaaaugaaaguuggauaauucccugcucugauacaacccugcaguggcuucccauuuuacuccuaguaaauuaagucuacaacaagaucgggagggcccuagaaaugcauccuuugcacuggcuguucauucugccagggcaucucuugauaucaguaucguuaaccaccuucccuccuucaaguguugcucacgugucuccuucucaugaucacucuauuuaaaauuguaaacauuagacacucaaauaucuguugaaugguugaagaaugaguuacuuugcucaguuacugcuucuaauacuaguuuuaacauuaaaccuguugcugggggauguggauaguugucccuuugcuguucacauuuguauuuccucuugggguaccaucaccuggauaagauugcuggcacauugucagucacugagcuuggucuuguaagugugcaugcuagauggcuuaggugccuguuuaguggugcauuaaaaaaaaucaggcugggugcaguggcucaugcaugucaucgcagcacuuugggaggccgggaugggcaggucaucugaggucaggaggucgagaccagccugaccaauauggugaaaucccaucucuacuaaaaauacaaaaauuagcugggcaugguggcgggugccuguaaucucagcuacucgggaggcugaggcaggagaaucacuugaaccagggaggcggagauuucagugagccgagaucgugccacugcacuccagccuggaugacagagcaagacuucgucucaaaaaaaaaagaaagaaaaaaucagagagugacuuuaacuuaaacuuuuaacuuuaaauucguauugucaagcucuuaaagaacugucaccuauuuuguuuaacucaaugcuuuuuuuuugauugagguaagauaugcuuuuuuuauuagucaauggcuacauuuuucucuaccuccuuuuguagagaaaguaaacauuugagagcagaaggaauagaauauugagugauacauaguguuugaacaagagagguagugaauacucuucaggaaggaaaugcaagcugagcgagcccuccuugucugacuacagagggaugacagaagcugaagugggcaucagauuggccauuugauuucuggaggaaggggucaggagacauccauuguuaagguggaaaagcuuguguuuuagaccugucuucugggaagaacucaguccuagccugccaugaggcucuucuugcugggucuugguggaguuuaagguguuuuuuuggugugauagaauugaagcuuuauaauguguccacuucaaguuaagauagagaaucccugguuuguucagaagaugcuuccuuguugagguaagcccaggaagcuugauggaguggagaacgugcguggguuuuggagucagccaggcuuguguuaacaucccuauuuggccacuuuuaaucuguuucuucugaaccuauuccuacaucugugaaaaggagaugaugucugguuuggagagguguuaggguuaaacgauaaaauguaugcagagguauauacauagcaaugcuucugcagugggccggucacuugccgguaccgugauucauguucugugcagaugugcugucagaacaggcugguuggccagccuucccccaccccggcccccgccccagacagaguccugcugugcugcccaggcuggaguguggcgcgaucucggcccacugcagccucugccggguucaagcaauucuccugccucagccucccaaguagcugggacuacaggcgugugccaccaugcccggcuacuuguuguauuuuuaguagaggcgggguuucaccauguuggccaggcuggucuugaauucccgaccucaaguuaucccccggcauuggccucccaaagugcugggaguacaggcgugagccacugugcccggccuggucagccuuuaaaaauguuuuuaaauaguuauucauugauuuuaauugacaaaugaaaauauauuuauggugugcccauuaauguuuuaauguauguauacauuguggaaugguuaaaucaggcuaauuagcauaucuguuaccucacuuagucauuuuuuuguggugagaacaauugaaaucuacucucuuggcaauuuucaaguauacaauacauugccauugaccauagucagcauguggugcaaucgaucccuugaacuugucccuccaguguaucuuuggucagucuugccguccaguucuagccagcacugcucccuggcaucugugccugacaggguccaggaauggaggcauugauagugauaaggagccuuuauaguuuaagucccacugacuaaugugaguuauuacuucuuugcugauaagacccauagcuagucagauauugggcacccucuuccugggucgaccuuugaaguuucuuauucuugucuuaccagcuuucuguaggccuuagcgauccuuuccuguaguuaaguugugccuuuuuccuaaaggaguuaaggucucuuguuuuguaguagguaguuagggggagaaaaaacaguuuauuagcaucuuuuuaaaaaaaccuuuuaauuacuaauagaacaccuagcaaaauguauaaauucuaaaagcacgguucaaugaauuaucauauggugaacauagauuauucccagcaccacagaaagcccucccauugcuaccucuccuaucaacuguuucuugauaaccugcuagaggcaagguaguguuugaccaauaucugugugacucuaguaacuuagccuuguacaggagauauauauuugugugugcacacguauguguguguguguguauauauauauauauauauauaaaaugaauauaaaaaucuccaugauccuagcaaaauccuacugcugcugcugcugcuuuuuuuuuuugagauggaguuuugcucuugucacccaggcuggagugcaauggcacgaucucggcucacugcauccuccgccuccuagguucaagcaguucuugugccuaagccucccgaguagcugggauuacaggcgcccaccaccacacccagcuaauuuuuguauuuuuaguagagaugggguuucaccauguuggcuaggcuguucucaaacuccugaccucaggugauccacccccaaucagccucccaaagugcuggggauuacaggcgugagccaccgcgccuggccuguacuacuucuuuaauccaggucacaaauugcaguuuuugaagcuuccaccccuuccugcuccugaaagaaaagguccaugucuucguucauucagccauucauucaguaaauauguguugauuacuuauagugugucagacacuugugaggugcugggaacacagcagugcauuagagaaaggcccugaccucagggagcuuguauguuuaggucugacucaucugugcuaacccagugcccagugucaugguugguguuuuuaagcgucugccaaacugaauuaaguaguacucccuuuacugguuuccuguagcagucauucucuugugucaugguuagcuguuuacaccucuagauuccaggauccugcagugucaguuaucccucuuguguccccagucucgugcacagggagggcuucagucugauuguugaaaguaugcuaaauaccaaguaaaugcuacagucauaaaguguugucgcagguggagaggagucagaaaguguuaaugacuaugcuaaagcuuuucuugcuaaagucaccaguaaucaccuagucucuaaaucccguuggagcuguagauucuuuaccuugacuuuucuguaacacuugacagugcccuuguccucugggaaacuuuucuugguuucacugcucuuggcugguuggcuuucuucacucucaccauucuucucagucaucucugggcccuuuucugccuauggcugugucaugccucagaauccccuucuugauucccuguuuuuucccccuccauguucuguauucuccauuugucagugcuucgcagauuggguauuuccugccuugaguccuuuccugggcuucuuucucauuuauucagcugucacugggcauuuccacaucauguucuucaccaaugauuauccagaaugagaccccuaacaauaccugccuccuguuccuagccacagaccugcugcucuaccuguauuuucucuccacacagauguacaagacagaaaccuuacagucaucucugucacuccugcacuuccacauucucccacauccauccugucuccuggugcagucaaucuugcuuucugaauuucucuugaaauaauuucuccucccaauccacauccauauuucuugccuggguaacucuccacugacugauuucccagcugccaaucuggaccaccuccaaaacauuuuccacauugcugcuggagugaucuuuuaaaaaugcaacuccgauguugccuguccgucggguacauucuucaauagcucuucuuugccuucagucuugcugucauccuguucucccagcuaagccacaggaggcuuagucccuccagccuugcuuccugucacucccucuuugccuuaucgguccuccccaacccugaguugucagcacuuccaguucccagcucuugagagcucaccuccacacuagugcacguguguugaugcugcugcuucugaugugccucuuuuguguggucacuuuuacucauccuucaaagaccucuugagcugucacuuccccuaggaaguguucugucaguugacugcaaucugaauugagguuugcauccuguguuuuucuuucucugacaccaccccauacuguucucuucucaguagacugaguuucaggucacugucuuuaucucuguccauugugccuagaauauuguagcugcucaaacauacuugagugaauguauucaaguccuuuuuuuuuuuaaaccaugauugugagauuggauuaccugggaguucaucugggucuuuuuuguuucucauucucaugucagaauuuaagauuugaaaacugaauuucacauguauaguuuugggaaaagucaucuuuaaaugaacccuacauuuauggcaaaaauuagggacaggacugaguuucaagaagucguuaggccacagguuuuuugagggauggcacaggcuuuuaacuuacuaaaaaggacaacuuuuggcugggauugaugacucaaugccugaugacucaaugccuguaaucccagcacuuugggaggucaaggcaggaggaucacuugaggccaggaguuugauaccagccugucaacauaguagaaccccccaucucuacaaaaaauaaguaaugagccaggugcaguggcaugcaccuguaguaggagcuacucaagaggcugagguaggaggaucuguggaggccaggaguuugagggugacagauggagagacccugucucuaaaaaacaggagaacaaccuuuaucauacuuugccacuuuuuauucuuaaucagaaguaacacauguucuuguaaaauguugauuuaauacuaauggagugccuacugcaacucucuugauuccacugccuuauuuuuuucuuauaucacuaauaccauuugaaauaauuuugcacguguuuauuguuuaucucuuuucaauguauuucuuuugguaauagcuaauacuucccgagcacuaacuauauacugagugcuauucuaaguguuuuauuuguauuaaugccuuuauuuccucucacagcccuuucagguaagguacuauaauuauccccaauuucaacaugggaagacuguagcaccaaggaguuaaguacccacuguguauagagugccagguggggcuggcauuuaaacucuuggcuucagaguccaaaaaaccuacucugcucuauugagucucagugcaagccugaaagggcacguaugccuucuccugcagugccugcaccuagaacggcucccuccucguaguugacauucaguguggaugaacacgagguauuccaaguaagaaguaaaaauaaaauccuucagcaccugugguacugugauauaauaagaaauauguguuuggucucugcccccucauuccuggcacagagcuccuaaaacccuguggauaggggcacuaggagaaccucuuguucuaauauguuccugacacagagcacccucaaaccuuuguaauuuccugggugauaacagagcuccuaaaucccuuagaauuucccaggugauaggagcaucuuuuguucuaacaagauaacuguggugggcuccuggauagccaggaugguggcugguugcuaagggaacgaaccgcgugauuacgguguuagaacuuucagccccaugccccugaccucuggggaggugagagggagaggggggcugaaggucgagcugaucacuaaugacagcauugugaucaaugaugcguauguaacgaaguuuucauaaaaacccaaaaggacaguguuugaaugagcauccagauagcagaacagguggggguuccuggagggugacugccucgagaggguguggaagcuuugcacccuucccacaugccucacccuuugcgucuuuuuaaucuggcuguuccuguguuuccuuuauaaucuuuauaauaaauuguucccuuuauaauaaauggguaaacauaaguaaguguuucuuugagcucagugagccaagcuagcaaauuaaucgaaccugaggaggggucaugagaacccugauuuaaaaaccucugucagaagcacaggucacaaccugggaccugccauuggcaucugaaguauggggcagucuuggggacugagcccucagccugugggaucuggcgcucucuccagguagaucgugucagaauugaauuacaggacauccagcuggugucugcugaugaauugauugguugcugguggggagaaaucgccauacguuuuggugaccagaggugaaauauucugugcacgguagaggguaggaaaggcacuuugguuuuuuuccuacaucuucuuggcgcacucuuccucagagguuaguugcuguaauuuguuuuccucauaaagcuuuuccuuuucaauuacaaauauauauuuaugcacagauguaguacuuauaaaaugaauguuaccucucuugggaaacagacuuuuuuucuucgcaacucuuuggagagcaugucccuugaggugugacauuauuuuagcuguguaacaauuaacuggaucugaguuguuuuacaucagcuaaauaucagucuccuugagauuugggaaauauuuaagucucaucagcaguauuuuggggaagggggugcuccugcagacagcagcugcuguuuucuguuuguuuguucauugauugauugauugagacacagucucgcucuguugcccagacuggagugcaguggcaugaucacugcucacugcagccucaacuugcuggacccaaacaauccuccugccucagccuccugaguagcugguacuauaggagugugccaccaugcccagcuaauuuuaaaauucuuuuuagagauggagucucacuuuuuugcccaggcugauaucuaacucuguacuccagugauccuccugccucggccuccgaaaguguugggguuacagguaugagccacugugcccagcauucugugcguucucacuggcugucaugcccugcaaagaaaguugaccaggugcaguggcucaugcuuguaauuccagugcuuugggaggccgaggugggaugaucacuugagcccaggaguuccagaccagccugagcaacacagugagaucuugucucuacagaaaauuaaaaaagaaaguaaaaaaaauuagcugaguguggcaccuguggccuagcuagcuacucuagagacugaggugggaggaucacuugagcccaguaguuugagguuacagugagcuaugauugugccacugugcuccaacauuggcaguagagugagacuuugucucuaaaaaaccacaacauuuuaaaauuuauuuaaugucccuggauuccuacagguauugaauuccuauggguaugggauuuugacuguggucuuuuccuaguuucuauaacugugcugauaagaaaaaagagacugcccuuuuuuuuaaacaaaacaaaacaaaacaaaacaucuggaaguuggucaagucuuaucuuuccuucuguuucucucuggugguagcagacaguuuaccuguaggucaagaguuuuuagauuagccugggauccauggauaggagucagaagggcuaucuaucuucugaaaccacauguagaauuuaguuaagugugcauuucacauuucacuggggagaguguuucaugucagaucccaggaugaggauaagcacgaacacuuuuugauauagguguauucuuugucaaguuggcaacaaggauccuggaagcugacuugauuuagggauuagaacauguuuuuccuuuuuauuccuagucccagaaaaugauaucagugggaauaaaaugagagagggcaguuuggacuguuccucagugaagaacagggguuugcacucaucagguggauguaugggcuuagccuguaugcgggggcaccuguucauauuaaaucucauguuguggugugacagcaaugucaugacugccuuuguccccuugugagcuuuguaucauguagaguggagauagcucacacccucauuuaacuggccaguuaaugaggcugcugcugcugugaagugugugugugcuuguauauuguuaaaaacuuaacauauagguuauuacuuugguaaaaguaaaaaaaaaaaguauaugguauaaaaagacaaaucacacugucucagugguaccacuuccuagugaaaugaucuugggcaaaguuacucgcugugugucaauuuuccucaucaauaaaauggguaccaaaguagugccugccuguauugugaggauuguaaagauuacauaaaacaauaaauaauucagaaaaggcaauugaaauguuuucugguauauggaaaacugacaauaauuaucucuuaugaugguggugguauugauaacaauaaugacaccuagaaaggccuguaaccaaaagucaguaguccuucuuucuucaccccagcccauuuuuaagaaacaaccacuuuuaaauccucuagcuauuucuuuuaucuccauauuucaaaaaauuacauuuuccuaauuugcaucacucccucagccucgacuauguuaagcuucuuuauugacuuucucuuuuagaagaucagaucagguuuuuauuuuuuucuagagauaggaucucacuauguuucccaggcuggagugcaguggcuauucacagauaccaucauagcacauugcauccuugaacuccugaccucaagcgauccuccugccucauccuucagaguagcuagggcuacaggcauaugccaccauucccagcuugaagauuaggguuuuuucuuuguuuguuuuuugagacugagucuugcucugucacccaggcuggagugcaguggcguacucuuggcucacuaccucugccuccuggguucgggguuucaccauguuggccaggcuggucucgaacuccuaaccucaagugaucugcccacuuuggccucccaaagugcuaggauuuacagccaugagccacugcacccagccgaagauuagguuuuaagugacaccuccuguuucccuacacuuuucuucaucuucugaugcaauuauaugaaguuuugguuaaauuggcauuuaguguuaacauaaugaucauaugaacauuuuaacugcuaaccugaguugaaaaaguugggugaaauauuguuuauugacuuuaguuaugagugaaguuaaagguuguugugugguugcaguuuauuuagguuuauuuuaugacuugcucauuuuucuccucagaugcucaguuuuaccuuacugguuuguacaagcagucuggacucuuagaaaauauugguggagguugaacuucuugaagaaacguugagcuuuugucaggugugguggcuuacgccuguaaucccagcacuuugggaggccagugcaggaggacugcuugaggccaggaguucgacaccagccuggccaacauggugaaaacccaucucuacaaaaaauacaaaaauuagccggguauauuggcgugugucuguaaucccagcuacucaggaggcugaggcaggagaaucgcuugaacccaccgaggcggagguuguagugagcugagaucaugcugcugcacuccagccuggaugacagagcaagacucuugucuccaaacaaaacacacacacacacacacccacacacacacacacacccccaaaaacccccugagcuuuacauccauagaugaggaguuuggaauacaaauagaugaccuguuaucugugucagcuuuugauacuaucugcccuucacgucuuuauucuuagauugucaucuguggguggaaaaccuuaaguuucuacccauagaaauaagcccaccauauuucagaaaacauggugggucauaggaaagcacucagaugggacaaccuaguuggauuugguacaaaaugagccagaugugggaaaaggcaaauuaauaugauuaugaaaaguaagaaugauggagcugggugcgguggcucaggccuguaaucccaguuugggaggcugaggugggaggguugcuugaggucuggaguuugagaucagcuuggccaacaaagugaaacgccauuucuuaaaaaauauaguagggaagagcagagguuucuuaagagugcacucaacaaaaggauuaggcugaucuaauaauuggaaugucaguauugauuuaguuuuccuugguacagucuacccagagugggggaaggggcagagcauaaggauaaagggggaguugugguuuuguggaucucagguguuuaccaaugaacuagguggagguggucaggugguggagagcuucuguucugagaaccugaccgagaggcaaaacauugucucuauguagugcuuggcacaaccgugggcuccgaucugggaaagaguggacucgggaccacagcagauuucucuauggggcugcagucaaugaaauuguccugaagcaagccuggucuagggcguucuggccucuaagauugagagggaugguggacagggcagugggccagaggugaagugagaugaggaaggccaagccuuuuucuccugaggaagccagugcuagggcacuaauuauaguuuuacacaaugccagcuuccagccugcauagagaaacaugaaauuucugcuuaaaacagaguuccuuuuuccauuuuuggcucuaaacuuuuuguguuggaaguuaggaaccaauuuuggagagugauuguagugagggaaucuggaaaaccugcgaaaauggagaagcucauuuuaggcaggaaaaaucugucucuuggaaugaguagcagaggguuuucuugcucaagguaguuuucuuuucuguucuugguguggugccugacuccacauuuuucacccagcucuuaaacagguuuugcugaguagcuacaggcaagucaucuucucuguaaauuagguguaguuaauaacaccuguuacucagagagugacuggauuaacagguaagaguuuggacuggagugacccagaaaugguaugaaauagugagaagaacuugagaucgcuacgugucccagagaagacaccuuccuuagaucuaaguugaggagacugaauuaaacagccuuuguucauuuaaaaaacuguuuuuauuuuuauuuauuuauuuugagacagaguuuugcucuuguuacccaggcuggagugcauguugugaucuuggcucaccacagccuccaccuccuggguucaagcgauucuccugccucagccucccgagaagcugggauuacaggcaugcccaaccacgcccggcuaauuuuguauuuuuaguagagaugggguuucuccauguuggucaggcuggucucaaacucucgaccucaaguguuccaucugccuuggccucccaaagugcugggauuuuaggcaugagccaccgugcccggccuuauuuuuuaauuuuuaaauuuuucuuagagacaaggucuugcucuguugcccaggcuggagugcaguggcaugaucacagcugucugcagccuugaacuccugggcugaaaccaucuuccugcuucaaccucccaaguagcugggacuacaggugcacaugccacaacaugcgacuaauuuuuaaauuuuuuuuuuuuuuuuuuuugagguggagucugguucuguugcccaggcuggagugcaguggcgagaucuuggcccacugcaagcuccgccucccguguucacgccauucuccugccucagccucccgaguagcugagacuacaggcgcccgccaccacacccagcuaauuuuuuuuuuguauuuuuaguagagacgggguuucaccguguuagccaggauggucuugaucuccugaccucgugauccacccgccucggccucccaaagugcugggauuacaggcgugagccaccacgccuggccuuuaaauuuuuuuuuuuuuuuuuuuuuuuuuuuaauagagaaugggucucgcuauguugcuuggacuccugggcucaagcaauccucccccuuugcccucccagagugcugggauuacaggugugagccagugcacccagcuuaaucagccugugaaguccccuccaggucacacagggugaaucuugggaaggcagacuggagauucugcucccccuguuaucucugucuugucuuuagaguugguccagugcaccugggugugucugagaucaugugcccccaggggcagcaguagugagaaagacgguugugaaaggcacauugucaugaugguuuuucuuucugugguuuauccuuauuuccuggcuucgcccacaagcacagauucucagccucuugccuuugucuacuuucuuuugaacauuuauuuggaagcccucauuuugugcccauguuuuuuuuuccuggaucuggaugugguuaauaggagugcccucagcccaaccugaguaccuuguguagauagucuggcuaauuuaacauucugaaagaccuccuuauagccugaugagaaucaaagucaagcugguaaagcuacuguugcuacucugugcaugccacuccccgaccccugcaauauuuauuaaaauguaaccguuucagggcucaaggcuugaagcugcuuauggauuuuuuuuuucuuucuaacacaaaggaaaaaaaugggauacaugugcagaacgugcggguuuguuauauagauauacgugugccauggugguuugcugcaccuauugacucguccucuaaguucccuccccucaucccuacccccagcaggcccugguguguguuucccucucuguguccauggguucucguuguucaacuugcacuuacgagugagaauaugaggcauuugguuuucuguuccuguguuaguuugcugaggaugauggcuuccagcuucacccaugucccugcaaaggacaugaucuuuauggcugcauaguguugcauggaguauauguacuacauuuucuuuauccauucuaucauugaugggcaucuggguugguucuaagucuuugcuauuguaaauagugcugcaguaaacauauguguacaugugucuuuauaguagaaugauuuauauuccuuugggugcauacacgguaaugggauugcugggucaaauggcauuucugguucagcauccuugaggaaucaccaugcugucuuccacaaugguugaacuaauuacaacaaaagccaaaauugauaaauugauaaaguugaucuaauuaaacuaaagaacuucugcacagcaaaagaaacuaucaucagaaugaacaggcaaccuauagaaugggagaaaauuuuugcaaucuacccaucugacaaaggucuaauauccagaauuuacaaggaacuuaaacaaauuuacaagaagaaagcaaccccaucaaaaaguggagaaaggauaugaacagacacuucucgaaagaagacauuuacguggccaacaaacaugagaaaaagcucaacaacacugaucaucagagaaacgcaaaucaaaaccacaaugagauaccaccacacgccagucagaauggcgauuauuaaaaagucaggagacaguggaugcugacgagacuguggagaaaugggaaugcuuauacacuguugguaggaauguaaauuagugcuuaugguuuuuaaaaggcuuccagagcaggggacccauauauuuagucccauagaacacaucccuuaaccugccucuuagcauuucaucuauccuuccuuauauaaguucuuucuucuggaguugggacaggaggugucuuguuauuuggguagaaaggagaaagaauggguggguauguggacaaacggugcagggaaauagauagcaugggaaguguugccacagcucuauggaaacuacuuggauauuaugauuaauggauagucaaacaucucucaaauaaauaucaaagagugaucuucccuuaaagguuauuguucccaaguuuaucccucucuuggugcccuggcucugguuucuuuucuucuaaguugccccuuugauuacuugucaugugaauaucaaggccugauccuuccucugugugagcuccaaggggccgccuuccaguggagcuuuguagaaucauaugugucauagagaacagguuuuaaugcugggcugcuguuaggcuuuagcgcuagugcugagaggccccacaaagagcugaaccuacugaugaggccucucccaaaucuaaucagagaugggggaaaauuugggugcugggaagagcagaucaucucagugauuuuaaugcccaccuuuauuugcaaagugaaaggagaaauauauuucccuauugcauuuccuacccuucacuugucaggcauauuugauauuuuuuuuuuuguuuucauuuaaaaaaaauuccaaaaacaccaugucaaauaugucaaauauuuauuuuuuaaaaaguaggccaaguauuaaugucuuucugcuaaaucuaguggguucucucucacccacccccgcuccaaccagguguuugcagaaaggaucuuuuuuuuuuuuuccggaaaggaucuuuauccagaaaggaauuuuaaaccucagaguuaaguucuucuucaccucagugcuucccucacuaaacaucauccuuacccagaauguauuucauagaguguuccucuuuccauccuuugaugcuuuaugacccaugaaaauaaugaaaaguauuuguuucgggccccuaguauuaccagguuuagguacuauugcuauccugcaucuuuuucauucuuaucucugugcuguaauucuaucucccuucuugaguauuucacaacuggagacaagugaguuaucuucccuagaacucuuaacuuacccuaaguguaaggcucuggauagacacucaagggcuuuuggaauguccacucaugggagcagcuguauuuuguugcuagaauauaaagaccucaucuuucaaaauuucuuucuuaacaguuaacaguuuuagauucuuggaugcugaauguucaccaguucuuucaacuagaucuguguagucagaaguccaugcucuuugggaagucugagaaacuuuaggugccauuccuaucuccucucauuuugggguucagauugugaggcagaaugccuguugagacuuucugagcgcauaggaagcauuggagcagugggaucuggaguggcuucaccaggcaccucagagcacaguggcaggcugagaacgucugugugaucucacacaaaaagacugucugggaguuggaaaccacuccugccuguguguuacuuccugcugcuggacguaugugugguauuugguguugccacacuaggugggggauggagaacaaauuaugucugcuccuuggauauuaguuaaccucauucagaugauucuugggugucccauggggaaguaaaccgauuucccugguuuugcuguaggaccugauuagucacauacugcagagaaccaacauguagcauaaggcgccauugccagccugaccaguguaguagggaacugggucccacuuccgcagcccccagcccugucuucuagaguuagacuguacauugcuaacuaggcuuccuuuuuuaaaaauaaauaaauaaauaaauaaauaaauaaauaaauaaauaaauaaagugagugugucuuuuggaucucuucagauuagaaaaaaaucuguauuugacuuuuccuauguuuguucugauuuuguucaguccuuuacgcugaagcagcucccccacucuucccacuuaacuccuaucuuacuucaccauaucuuuucuaguccaugaauacuaccuuccaugcuuuauucugguccucuaaaucuuuccuuuauacuucuguuuuuccugccaauccccaacucguacagaacccuacuguaggagaacauaacugagaagaauuuaacuggguuugaauaauuaaauaaauucccauacgaagguauaauaaauaauuuucuagauacuuuguacacaugacacugaaaagagagggacauauucuguaaaguagcucacugggggaaaauuaccauugcuacauuuucagccuuaaauuguaaggagugcagaugguuagccagccuauguuucucccacccaccuucguuuuaaacuauccuacccuggaaagauggaugcuuauaaaauaaaugaaaaagacuuuaccuuuagaaugacauagauugugauugacagguccagguagcucuuguguaugugaaggggaguuauauaauguauuaggcuuucuuaauucauuccacaaacaccuauuccuaguucuugucugaaucuccauuuauuuugcagcaaagauguccccaaauaaggugcuuauauauagcaacagauucuacuuccuuacauuuuguuucaggacagcucacacaguuuuuuuaacacauuucaaugggcccagaauccaucgugguaggaaguaaaacuguuuuuacauauauauucggucacuucccaguuuuuucuuuucuuuuuuuuuuuuuuuuuucuugcaagcuccuucugucugggcugacugagacccacauaacaucucagccagcugaguuggacauucccggguuucuguuggugucugaauaugugcagagcaguagaauaugugcuacuugaaucuugcugugcgugagcugcuggaagucgcugugucugacuaguguguagaagcuggggcuaccugugauggggaacaugaauauucgaggagcacagguggaugugggguggggacguggggugugcaucgucacagagccagccuggcccucuggagaguuggaacccuguuuccuuguccuggccaaugugaaaccuugggaauaguugcagaguagagaaaucaaaauacacaaucuauucucugcuuggccuuuuuacgcccuggugcagauugacuaaccugugguuuuugaucaucucugguccagcgguugggaaucugugcugucuauagcaucugaguguugugagaauaaaaugugaaaauagguaugaaaauauauauaaaccauaaagaauuuccccauguuaaaaugaugugugucuuccaguguagaagguuuuaucuuuucuauaucuguauauauaaaaaacauuuauuacauauuauaagauacauaugucugcauucagaugauaaaacuaaggcccggaaaugaaaguaucuucccaagcucacacagcuaaucaguggccuagccagugcuugaaucuucucuuugaauucugauaucuaguaagcugaguggggcccauugaagcaguagccaaauuaugguacuaaguaccgucugauacauuaauuuauucagcaaacauuacgugccuguuguauccccagcuccugguauuuuggguauuaggugauuuuuuuuuuuuuugucauuaaaauuuccuccccccacccccaccccacaaguaacuuguaaugagcuucagaggcauuuagcuuuaaaacaaaaaucuuccucccucuuuuuaaccacacuacccuugguucuuaguuuaaaaauuuaguugacauuccuguguguuuuuaucuugcaauuggccggaggguuauuuauuaggaaaagagauuuugaaugauuucaguaagugaacuaggaguugugauacacgauuauauuaaauugcuuaugguuaguuuuccaggaggugauuuaauuguucaccuuccuaagucuucagucuuaggcuuauccagugggagcuggaaagcuuuaauaggcaaguuuauuggaacacacuuccagagucaaaugucacucuuggcagcugcagaugucaacugggacaaguauucagagccugagaauuaaggauauguguuaaauauggcccucauaggcggccccaggguuuuuuuuuuuuuuuuuuuacuuuugcgaacauguugacagagaugaggcucagaaggcagguauacaugugccuugucuucauucucugcagagagaauguuuuuaggggcuugggaaaguauuucaacucgaagaaaggacuuauaguuacuagaaucuucacaucugcuuucucgagugaccuugagucaaccacagucuugugggguagaugguauuauucaccccucuuuuguuacauauuaacaugacaaaacuaagacucagagaggaagugccuuccccaagcacaugcagcuagccaguggcacauccaguacuugaacccuuuucucuuugaaucaugcuuuguacuaagcugaucacgguccacuguagcaguaggugacuuaugguacuaaguaccaucugauacauuaauuuauucagcaaacauugagugucuguuguaucucuaguaccuggcauugcaaagaugaguaaggcaguagacagauaacugacauaacccaugacagugcaguugcguaaguggcaugaucuggagugcagaguacuguggggacacccaugagggagccacaauugccugggguagggaguuggaggaggcagaugacaggagguaaugacugagcuggagcuggagggaugagcaggaguuaggcagauugcaaagggggugcgggcaugugcuggguggcauuuccagacaaaaucggagggcuuggaacagcagugugugcucacaccugguacguagcaggagugagaggcaggaacagcaguuugaggcuugacagcccugugugcgaagcgaagcauuugaaugaugucucauuaccacuguauaccacauguccuuccccugcagcuuuggcugacaucugucauucuacccuacuccuguuggccuuacuuucucccuuuuaccccucucaacguuugcuuuaggcugucaguguuuacugcaccccauaaaagguuagauccucccaccaggccugaucugacuacuaggagagacugucuguaucugcuggagggauugagagaauugguacagaaggaguuuuguggaucaugacaucuagaauuagcacucugagaaagagggaguaagcaugguauuaggauuggaaaaagguuuuuuuccuuucagaccauuacaaaaacucaugaguucaggauguaucaguugugugaauaagguggauguuugaagaccccacuagcauguguugaguuuacagccacugugcaagaugcaucuuaaagauugauagucugugcacuuuuaucccgaggugugagguacuggaccucugucauaggggagagaguagaggcucagagagguuaaguaaccugccugaaguugcuccaccaguaagauauggaaccaaggauucacaugugggcuggccaaccucuucaugcccugugccuccuauguguguaggugggucugucacuacugcccuggguguccugcagaauggcugugguucccaguccacccccuugggagccuugccuacauuagcucgauuugcugacaggugaacaaacaagcaaccagcugcucugauaggccugggaacuuguccccggagagaaugcccaaguccaggaagguuaugccaggucaugaagcagaagugucuggacaugucacacagucugcugagccagcagugcccacuucauagcccuuucuguagggccccuguguugacucccugcaugguacucgucccuuagcccaggagaggccccaugggaggagggagaguugcagcaacuucuggacccugagccauaggaacuuccccuucccaaucucugagaagauguucacagugaccuggccagggucacugcaagaaagaaaauggaaugcugauggggcaagggugacagggaagccaggcauuccagcuguguucaaagcagugacaaugacugugggagcggguccuguuuuauauauucaucauucugaggccuucagggacuauuuuguuagcuacauaaguguugaaagggcugcguaaaccagaaaucaaauucuguagauuggcaucugcuggauaaaucuucugcugggauugcuacaacauguugaauaaccguguguuuugaagaaugaaaaagauaagacaguucacugaguugcaacguuuaugacacagggaauggaggacuguaauuaaaucuacauaaaaaggccauguuuuccaaguguacuuugaacuuggggcagguguucugagugggugggugcaucaucucauuucccccugcggaggaggcugcuggcaaccugggaauggagguuaacaccauuuguuaccccugaaguuucuggaugucuagaggaggacccccuuccugcgccccgccccuccaugcaccaguccagagcuguggucuccuuccuguguuggagacucgcugcugguccuccgcuggugucugaguugguuaaccuuaacugaaccccuuaacugaacuuuucuuguuacauguauuccagcucucagugaagugacauucugcccucugggcccagaucccugaacccuucccugcauuucagaccuaaauagcacccugucagaaagaucaguggggccgggagcuguggcucacgucuguaauccuagcacuuugggaggccaggguggguggaucacuuugagcccgggaguuugagaacauccuaggcaacaugguaaaauucuugucucuacaaaaaaacccacaaaaaauuagcagggugugguggugcaugccugugguccuagcuacuggguggggaggaguagggggaagcugagguaggagagaaucacuugagcccaggaguucaaggcugaacuaagucaugagugagacccugucucaauaagaucaauggguuggaagugaaagucccuucccaaacucaacucuggggaagaagcucuugccuucucuggcccuccccugcccaccuuguccacccugcuuugcccaucacagcaggccucccguuccacugcaauaacccuccccacuagucuccuugugcgggaccagucuuuacucuucuuuggguugcuguuugcgucagggcucacagcuuugaaggagguucaagccaccaucauauuuugcuauaguccagacugcuggacauugaucaguccucuguccccaccuuaacccugugcacgcaguugcacugcggggcagauucaagaugcucacccugugucccacugcuuguuuucaggcuguguugaucacaccugccugcugccuuucaggaucaccuucuuaguucuuuguauccaccuuuguccccacccuccacagccuugucuugaaggccacauaccacaccuuugaagcugcccucuuccuguugaagccuuccuugcuuuuccaauugcuuuucuacuguugacaaaaguagaggggacugugaccuaggguuauaauucaucucccugcaguugugcaugauguuugugcagagugaauucuuuuuuuuuugagacagggucucacuuuuugagacgggccucacuccaguugcccaggcgggagugcaguggugcaauugcagcucacugcagcuucgaccucccaggcucaggugauucucccaccucagccucccaaguagcugggacuacaggugcacaccaccacaccuggcuaauguuuuguauuuuuaguagagacagaguuucaacauguuggucaggcuggucuggaacuccugagcucaagugauucauacgccucagccucccaaaauucugggauuacaggugugagccacagcgccccgccccagagugaauucuuaaccuuaucucauaucuauucgcuauucuugacucccuuguuucuauuauaauccuuagagccgugguggucaacuccaagagaguaggaaccaagucugcaugauuugccuaaaauacuugauacuuuacugggaguaaguauaauacuugaaacugcuuuguugagaaaaauaaaagaaagcaucuguccagucuacuauaauaaaauagcuuagacuggguaauuuauaaacaacaggaauuuauagcucacaauucuggagucuaugaggcccaaguucaaggcaccaguagauucagugucugguggggggcccauucucugcuucauaguuagugccuuuuauggucuucacuugauggaaagggcaaaagguaucccccaagucucuuuuaaaagggcgcuaauuccauucaugagggcugagccuucaugaccuaaucaccucccagaggucccaccucuuaacgcuauugauacguggauuaaguuucaacacaggcauuuuagggggacacaggcaugccaaccuuagcagcaacuuuucauauaauuuguauccuaaaaacaguaaaacucggccgggcgcgguggcucacgccuguaaucccagcacuuugggaggccgaggcgggcggaucacgagguccggacaucgagaccaucccggcuaaaacggugaaaccccgucucuacuaaaaauacaaaaaauuagccgggcguaguggcgggcgccuguagucccagcuacuugggaagcugaggcaggagaauggcgugaacccaggaggcggagcuugcagugagccgagaucccgccaccgcacuccagccugggcgacagagcgagacuccgucucaaaaaaaaaaaaaaaaaaaaaacaaaaaaaaacaacaguaaaacucaauagcucugguuuauugacuguuuauuacaugccugcuaagauaggcauucccuaccuggccauuuuacagaugaaggaacucagguuaaaggagguuaacaaccuuguccaaggucagacagcacaucuggauucagacaucagcuugugugacuuaagcuuauuuuucucuucaccaugccaguccugccucuagcaaaauacacgcagauuucaugauaccacuuuuaauuucagcaaauuauguuaucauuuucaauuaacugauaauuagcuggcaguccuuggaagguagaaggaguucugauggaagcccucaucguuuuuuauucuuucaugacuuccacuugaagguccuugcuuacugaaauggaagccauaaguccucucgucacccuugguagaagggugcuaaaucauccuugcuaaauacuugacggaaaccaucagucaucucguuuggcucucaucaaucucuuuguucauaugcacaggcucuuaaucucuguuuucccuuucuuuagaguaccguagucucagaugauaaacuucucugaagcuaauuucuucacugcugcccuggagugucucuucaugcugcauucuaaacaagugaagagcaaaguugcucuugguagggcagccagguucaggacagugcugcuuccagaucagaaaacauccauaggguguagucuggcccacgcuugauguaggcacaaggcagaggcgaaugaagaucaugggagguccuuugguguaaaaaccccaucugccuggagcuucaggauuagcaguguuucacagcccgucugaagugccagcacuugggaaaacuuacaagagagauguuugggaaguauuucaagcacugcuuuguguccuuaaggaacagugagugaauggcccguugcaggcugagucugaugucaguuuuugacuuccguauaguaguacaucagguggcagcuggcugcaacccagccuccacugacuuuagagccagccaagugaguucuaguuucagcccacaggucuuauguuguugccgagggaccuuuacaagacacuuaaacccuuaguuuccucuuguaaaugagaauuuuaaaaaguucccgacacagagagagaggccaucaauaaauguuggauaccuucccuuucacuucccuguuuaugguuuuugaaauuuggaaaagaagcuugucagaucuguguguagaaauaauaaauaauaggacuucccuguguagaaaagaaaaacuuuauuuuuuagggauuuuguuaggcauuugccuacuuagagaucguucugauggucuuguucucaacuguccccagccagauggggaacauaggaaaccuauuaugugcgagccaauggguccagagaaaagagauagacagcuauugugaugucuaucagaggacacugucuucucccgugccaggugccaggugugcugaagaucuacuuugcagauugaccccauaaggauuuaugcacuugagggcucaucucuggagacacauggaaaauuagcaaggcaaaaguuuggaguaaagaugucugcacagagugggcagcuuguguguuggagaacaagccauguuggccauuuguugugaauggcgugaggaaaaaugcuucagaaacauagacuuuucuggaucugcaagcaccagcauuuuugguguucuuuuuuacuucaguuuuagauuugcagcaguauuauuguuuccugauuuuguuaagcagaucuucaguauuucaucagcaguauggguuaaguuggcauuagaagcuaugcugggaaccuaauccucacccguuugucugggaaaauguguuuccguguugcacagugagugaacuuuuugauggcaguguguuuguaaguuggggacugccuguagggcauuuuguaaagaagagaacauucuuuucaaaccaagggcuucugagagauaaagggaguugucauuggaaccacaugcuaaaaaagcaugcuugaaauuaguuuugauuuuaccuuaguacaguugagcugaaauaaccucuagcagggugcucuagcaauacagaauauuaguaguagacucauggaggucaucuagugguuucugauggagaguuuacagacugauuugguuugugaugaaaauuacauucucugaaauuuauauagaaagcauguauuauauaucacuuauauaacguauuuguuaaauauggcagucaccuuauguguuuuauaaaaagucauguaguuuuuuaguaguuccugccuuauuuuuuuuccuucuuuucuuuuaagacggaguuuugcucugccaucuuggcucacuguaaccuccaccucccguguucaagugauucuucugccucagcuuuccaaguagcugggauuacaggcaccuaccaccaugccuggcuaauuuuuguauuuuuaguagagacaggcuuucaccauguuggucaggcuggucucgaacucuugaccucaggugauccacccgccuuggccucccaaauugcugggauuacaggcaugagccaccgcgcccagccggguccugccuuauuuuucaauauccagguacaugacuccaccagguccuaggucugccaccucuuugugccuucuuuggcuuuugugauggucacacccagggugccaagugagaacaguuuuuuuuuaaaugauauuucagaaacaaauguuuuauuaauuauuuuuauagguaucaguauauuguguaugggguuuaggauuucaccucauuaugcuucagccugauuauuggguauacaaaaaguaauuagaauagaauaguauaaagaagaaaaaacuuucaugacccaaaccuaaccauuaacuaauaguuaacacuguuacauuucuuucuaaacuucuuaaaauguauguauggaacuuacauauauaaguaagguuuuagacaaaaagguuuuggauaaaauugagauuuuaguuuuauuuauuuuaauuuuuauuuuuuagagacacagucuuacucuuucacucaggcuggaguucauuggcaugaucauagcucacugcagccccgaccuccuggacuuaagugauccucccaccuuagccuccugaguguccaggacuacaggggugagccaccaugccuggcuaauuuuuauuuuuucuacuuuuuguagagaugagguucucaauguguugcccagguuggucuugaacuccuggccucaauugagccucccaucccagcucccaaaguauugggauuacagguguuagccacugugucuggccaaaauugagauuuuacacacacacacaugcacacacacacuuuugguaacuuaauguauacugaacaucucccauauuaccaaauauucuuuucaaauguccuuugguagcuguacacaucacaucauauguguaguguacuaaaacuuaacaacccccauuauuggugaccauguaguuuguuaauccacuuuugugcaaugacgggcaucuuccuaaguuaauuuuuuguuguucuuuaauuauuuccuuaggauaaauuccuagaaguggaauucauugguuaaaaggcuagacauuuguuauacuccugccaaacuggugugcagaauucuuggugcuugcuguugguagcacugugaguaguuucccagauguaguguguugcaggggugacaguacugaaaggcccuccacccccugcaaagcauggcaagugcagcagcaagaucugcgguggcaaaaaccaggaagacagucauucccaucaucuuuugacauugcuuuuuuccccauuuuuuaggggggacaauugauguucuuugucaauucaaucauauuucuuucuuuuuuuaauguacgaagauagacuuccuauauuauauugccuuuuuaaacaucuuucccacacaaaaaagagagcuaccgacagacuguccauuccguugcacuaggacgcucuucaaacaaagccgguaccuugaggagacaguaaaggaggucugaaaugaacaugccccgaucaccagccaagcacucugaugacagagcuuggaagccagggucugggguaagcuaacuaggauaaccacagucguaacgaccaauuacagaagaacacucgcacaaugagacuuugcuuucaucaacagugacagaacucaggccaguucuuuugauucuaaaaagguaggagaucaaacccaaugcuuaccaccugcuaagcagaaagaucugauccgcuuucccaaaccaguuauuuguuguguggcuggaaacagaagaagggcugccuaaaacugaguggugggcuagguaguacggggaauagggagaggaagaaggggaggagcagggagcaaagguacuuucagggagcaguauuuuaagucuuccuggaagaggaaguuaacugggagacuggaguauaggcugugcucuuagcauauauaccgggaaguaaacaccucuuaggaggcuggcuugaaguugacaguuaguaaugcaagcuauugauuuuuuuugaaaguauuuguuaagagugaauugguuucuauaacugugaaaauggcuguaggacaacguuuccccugcccaauugugguuucagaugcuacuuuucaccacuuugaaccuggaggacaucuugguuuuagagacucuaccugaaaaauguaacuuagguucauuguacuuuuauugagggcuuggcacuggaauaaguguucacagauugauaacauaagaucccugcccuugauauauucaguuuaguggcagugagaggaauaauaauauaaauagauaauuuuauuauucuggcaaaauauacauaacguaaaauuuauuuucaaguuuacaguucugugacaugcucauguuguuauacaaccgucaccaccauuuauuucccaagcuguuucaucuucucuaacuuaaacucuguaucuguuaaauaauaauucuuccucauccccaggcccuggcaaccaccauucuacuuucugacucagaauuggacuauucuagguacuuuaguuaaguggaaucacacagcauuugccuuuuugugauuggcugauuuuacuuaauauaauuccucaagacucaucguacuguauuguaugucagaauugucuuuuuaaggcuacguaucauuguauguauauaucaauuuauucaucaauaggcacuggguuacuuucaccuuuugacuguugugaauaaugcuguuaugaacaugaguguacaaauauacacauaccucggagauauugugguuucaguugcagaccacggcaauaaagugaauaucauaguaaagugucacacaauuuuuuguuucuuuuccagugcacguaaaaguuauguuuacacuauacuauagucaauugaauaugcaguagcauuaugucuaaaaaaauugcagagaccuuaauuuuaaaaugcuuuauuacuaaaaaucguagauaccuuaaguuuaaaaugcuuuauugcuaauggucaucugagccuucagcaaguuguaaucuuuuugcugguggagugucuugccucgauagugaugccggaaggcuaggguggcuauugcaauuucuuaaagucaacaaugaaguuugccacguugauugacucuuuccuucaugaaagauuucucuguuuuaugugaugcuguuugauggcauuuugcccauagucaaacuucuuucaaagugggagucaauuuuaccuuucgacccagcaaucaaaaaauaaaaaauuuaaaaaaaauuaaagucaguccucuuaaaccuugccacugcuuuaucaacuaagcuuauggaauauucuaaauccuuuguuagcauuucaacaaugcccacagcauuuucagcauuagauuccaucucaagaaacuacuuucguaagaagaaacuuguucaucauaagaaacuccuuauuuguucacauuuuauuaugagauugcaacaauucagucacaucuucagguuccacuucuaauucuaguucucuugcuguuuccacuacaucugcagugacuuacuccacugaagucuugaaccccucaacaucaugcaugaggcuuggaaucuacuucuuccaaacucuuguuaauguugauauuuucaccuccuccaaugaaucacaaauguuguuaauggcaucuagaauggugaauccuuucuagaagguuuucaguuuacuuugcccggauccaccagaagcaucacuauggcagcuguagccuuacgaaauguauuucuuaaauaauaacuugaaagucaaaaucacucugauccaugggcugcagaagggauguuguguaggcaggcaugagaauaacauuaaucuccuuguacaucuccaucagagcucuugggugacuaggugcauugcugaugagcaguaauauuuugaaaggaaucuuuuuuuaugagcaauaggucucaacagugggauucaaauauucaguaaaucaugcuguaaugagauaugcugccauacuggcuuuguuguuccauuuacagagcacaggcagaguagauggagcauacaagggccuuaggauuuuuggaaugguaaaugagcauugacuucaauuuaaagucaccaguugcauuagccucuaacaagagagucauccuguccuuugaagcuuugaagucaggcauugacuucucuagcugcgaaagucuuagauggcauacuauuuuaauagaaggcuguuuuuucuacauugaaaaaaucuuuaguguagcuaccuucaucaguuauuuuagcuagaucuucuggauaacuugcuacagcuucuacaucagcacuugccgcuucaucuagcacaauauguuagggauaugguuucuuaacuuaagccucaugauccagccucuguuagcuucaaacuuuucuuguguggcuuccucaucuuucucagccuucauaggauugaagagaguuagggccuugcucuggauuaggcuuugguucaagggaauguuauggcugguuugauauucuauccagaccaaacuuucuucguaucaguaauaaggcuguuuugcuuucuuaucauucauguguucacuggagugguacuuuuaauugccgucaugaacuuuuccuuugcauucacaucuuggcugacuccuuggcauaagaggccuagcuuuugaccugucuuggcuuucgacaugccuuccucacuaagcuuaauuauuucuauccauugaucuacaguuagagacaugugacucuuuuacuugaacacuuagaggccauuguaggguauuaauuggccuaacuucaauauuguucugucgcaggaaaucauagggaggcccaagaagagggagagagacaguggaaugccccagucaguggaacagucagaacauguacauuaauggauucaauuugccauuuuauaugggcgugguugguggcaccccgaaauaauuacaauaguaaugucaaagaucacugaucacagaucaccauaacauauaauaaaauaaugaaaauguuugagauauugugagaauuaccaacaugugacacagagauacaaagugaacacaugcuauuggaaaaaugguauuaacaagacuugcuucacacaguguugccacaaaccuucaauuuguaaaaaaaacguaguaucugugaagcacaauaaaaugaaguaugccuguaucuacuugaguuucaacuuuaaguucuuuuggguacauccccacaaaugguauugcugggucauacgguaauucuauauuuaguuuuuugaggaguuccuauacuguuuucuacaguggcuauacaaguucacauuccugccagcagugcacaagaauuccuuuuccucgcaugcuugcuaacauuuguucuuucuaguuucuuucuuaaaaaaaaaauugccauccuaauggguaugaaagagaaucucaucaugggccuuuuuuuuuuuuuuuuuuuuuuuaaagagaugggggucuugcucugucacucacgcuggagugcagugugucgugaucauagcucacugcaggcucaagcgauccucugcuucagccuuccaaagugcugggauuauaggcgugagccaccaccagcuaauuuuuaaaaacuuuuuuguggacgucuugcaguguugcccaggcuauucuugagcucucagccucaagcaaucuucccaaagcacaggaauuauauuaauuauauuaauagguugagccacugugccuggcaaaaguuuuaaauuuugaugaaguccaucuuacuuauuuuuuucuuuuguugccugugcuuucaguauuacauguaagaaaucauugccaaauccaaugucaaagugcuuuauuuuuauauuuucuccuaagacuuacaguuuuagcccuuaaguuuagguauuugaucuguuuugagguggugguuucuuuuguuguuguuguuuguuucuuuuuuuguaugguguaaaguaaggaaaggucuaacuucauuuuuuuuuuuuuuuuuuugcauaugaauguccaguuuucccaauaccauuagcuggacgauaauuuuaauaugugaaugaagauacuuuugcucacaggaguuuuugagccucagugucuggcuacaggguucucauuugaauguccaguuuucccaguaccauuugcuggaugacaauuuuaauaugugaaugaagauacuucugcucacaggaguuuuugagccucagugucuggcuacaggguucucauuugaauguccaguuuucccaguaccauuugcuggaugacaauuuuaauaugugaaugaagauacuucugcucacaggaguuuuugagccucagugucuggcuacaggguucugcuuuaauauguaggaggaagagauucaagccucuugcuccauuauggguagacagcacacuacagggagcuucccugagggaacuuucuguguacuguuuccuagaaaucuguaggaaccauuucaagugacguggaaggagguuaucaagguaggauuagaaacauguauuuauuaugcugcuuacuauccagucuucaguuauauauguguuauuauuuuacagaaggcuucauuggacaaaaauuccuuguuagucuuuuuuuucgagaaggaguuuugcucuguugccccggcuggggugcaguggcacgaucuuggcucauugcaaccuccgccguccagguucaagccauucuccugccucagccucccaaguagcugggauuacaggcaugugccaccaugcuuggcuaauuuuuguauuuuuaguagaggaguuucaccauguuggccaggcuggucuugaccuccugaccucaagugaucugccagcguugccccucccaaagugcugggauuacaggggugagccaccucgccuggccccuguuaguguuuaguaugguuucuuuuuguguagggggagugaauuuuuugugugugcgugugcguuugcuuauuguacccauuucucaugguauggaaaaaaacaggauuucauacucuuaacaggauacccugcacaaggugggaaaauauaccucguguuuuaaagaaaaauaguuuaacaaauggcuuucaucuggguuguacuccagacuugcugcugcuucaugcuuuuccaauugugccacaggccugaucccuuagcaugugugcagcugugggcuagaggguugaaagcagguccugugucucuuuccuggugaacuccacagggacacagcugcaggucuuuuguaacgcucuguauaugcacaggaagucccuuacaacccacucuguuagaucucauuuccucuucgguuauuugcccucuguggucucugggugucagccuggccugccuuuucaggguucaaggagcugcuggauuggugcccucuuguggucugccuuugaugugguugggaucuugggagcugaaggcaaagaaaggacaagugagcuaccgaggaguaaggaagacaugaaguugagaagauaacagagggaaguuaaaaaaaaaaaucuuugguugaggaaauuguuucugaauauaacaugauaaaaucaguuuagguuaaucaguuuaacugcaucaauaaagaauuucuuugcaaaacacuacuuaaaaagacaguuaacuagaaagaauuugugaggcaaaugagaaauggccaguuuccuuaauauauaaagagcuuuuauaaaucaauaagaaauaaaagaccaauaaaucaacagagaagugaggacaggauaucaacaaaccaguuccagaagaacagaagccuuuuaggcauauacauagucuuuuuuuuuuuucucuuuuugccggcugcucuagccaguuuacuuauuuuuuauuuuuauuucuuugagacagggucuugcucuugucacacaggcuggaguacaguggugcaaucucagcucacugcaaacaccaccuuccagguucaagcgauucuccugccucagccuccgaaguagcugggaucauaggugugugccacuaugcccagcuaauuuuuguauuuuuaguagagacgggguuuugccauguuggccaggcuggucuugaacuccugaugucaagugaucugcccgccuuggccucucaaagugcugggauuacaggugugagccaccaugccuggccgucuuuuaggcauauaaaagauguuuacccucacuuaaaauaggacagcaaauuaaacagaccaaagguuaaauaucauuaagagugagggggaaauaguacauuauauauaaauuguugauggugggggcuagcugggcauauauauggaaauuuuaaaaaaugcagauucuuugcccuagcaaauccacuacuggaaaucuauucuacaaauauauauguauauccauacauuaaguucauuuuagaaaaaguugagacauaauuuaugucugucaauggaggacuagcugcaguuccuucauauaguggaauaccuugaagcccuuaaaaaggaggcagucuuaaaaguauugacaguauaaucuuugagauauauaagugaacgaaggugcagacagcguguauuagugucuguguuugaaaaaaaucauucacacaugguuuuauauguagggacugccucugaagggauguacacgaaacugaaaacaguagcugccagagaagugaucagcaauccggcugggagauagaguaggaaggagacaggcuuugugccuuauacuauuuuguacccugugaauuuugcaucacguuggagaugcaaaaagcaacuaccuugaaaagggcagucgagaucaaguggaguaagauauuuauucagcgcaauguuaauuauaaaaaguaaaguaaguagaaagaccaggguaggaacuaccgaaaaacaaaccaacgaacagaaaagaaaaccaaaaaaacccccagaauuucaugucugguuuuagguugccacaauuuaauaaugaagaagggacagauuauagaauucugagauagagaauagcgagauacaauaaaauguaguuaucuuaaaagaagucaguaugcaauugauugaauagacuucaccccucacuggaggaauaucuugcccacauagggagggaagaaacugauggccaccgucuuggacacaagcuaccaugcaugcauauaaacacggaaaaaugcuugccaaaaugguagcuacauuuauuucuagcaguaggacuuagccaaucauuucugucuuuguuuuaccuacuuguacuuuuuagaaaaagauuauuacguucauuuuuuaauaaugagaaaaagugaagcuucccauuucugugugauucuuuauaucuuccugaccuucucuuuuuucacuucuugcagugugaaaacccuuucucccguugggcugucguaguucaucaucaguaaaaccuccauauucucaacccuuucuuuugaguguccuuuaccuuuucugucaaaaacuugcucuuuccugauuucccuguuuuuccugccaagccucaggagaagcuuuucccacaugcugcuuaucuuugggccuuagugccgagacgugggggguggugcuuccuucuuacuuccuauuucuuucaaaccauucucccucccucccuccugccuaaaacaccagcuuuggaucucacaucaccagagccacucacuacuccugagcuauuucucugugauuuuaucuccuaccuuauugucucuuucuuuccaguaucacugcuuccuuuaguucuuggcaauuucaguguaaacauagguaaugacuuuagccauugucucccucuaccuuagaccuuaucauuaccaguaauugcaguccuccauaaccuuaauuucaugcaucccauccucugaggacaaccuucuauuuuaugaauuuacuucucuacuacuuuuauuuuaaaaacaaaagagacagggguagaugggaacuugaugcugcccucauaagcacugauucucugggcuccacaaucaccugggccauuuccugggccacccagccugcuucuugagggaaugcuuugugauuugauuguuuauagauguuaugcuagaccccuguugacuccaauagggaugacaccauguuugagagacugaagaaaagacccggagguaucaaaugagacauaggguuuauuugggggacucacguacagagccguccaguggcagcgggcuuggcaggaagcaugcugcuaccuuuuguaaaaaacauguagcucauauagcauuuucauuuagcauccucccccuggcagccucccaaaacaaaggucuccauccccugcguuaaaagggauagggcagggauuuggaugucuuuaauagacaaagacugaaucuccagguuggccacucucagauuucuuagccuggaacuccaaaccaacacucuucucauucuuaggauaugcuucaguuauggcuaucaggugccucugccauaaaacaggaagauuuuuuuuuuaacguaagaauuccuuuucuuccaucuauagguuguuaaaauggaagauuuguuuuaccgaggacaugaaaggcauugcaguugcuugggcauucuagaagagggugcuguccuuugcccugguguuuucuuagguggcuguggcaggaacacuaacucuuaaggaaauggaugcuuuuucuuuccugguacauaauguaugaacacuaguguguuguuuucauuguguagugugguuuaauaguaugauaauguaguuuugugccguuuuauagacgugaagaaaauaaaacuaaugggcaugaauugaugaaguuuucaacugaguuaccaaaaaaaaaaaaaaaaagcuuccuaauggacuuuccuggaaagauuugucuaaaugaaaauuugguggaucuuaaagaagagaauaauuuuuauugaacauauaguuugugcuagccacuaucuuaggcauguagcuuauuaacacuuauggcccauuuguggaacagguaugguuaccugcaguuuaaaacaaggaugccaguguucuaagagguugaguugcccgagauaucacugguauguuagagucaggaaucaagccagguccugugugcccugcccagccugacuuuaaaggacuauguagggaaacucucugaaaccacauuuuuccuuuacucucacaccacaacaguuaacacggaagacuucugugaccgauuguggugagagaggggggauuuccucacacagcaaggcacagacaccaguugaguguccuccaauuuacuugcuacacuauuuaccuggagauagugucaaaucccacagguuggaaacucaagucucuaaaacugccccugcccccugcagacaugcaaaccugagccucuggaacuucugauugauugacuucaagucgagguucccauaacccccucuuaggguuugauuaauuugcuggaguggcucacagaacucagggaaacacuuauguuuacugguuuauuauaaaggauauuuugcaaaggacacagaugaagagacgcacagggcaaggcauggggaaagaggugcggaguuuccaaccccucccuugugugccacccuccaggaaccuccagguguucagcuauccggaaacucccuguacccagcuuucuuggguuuuuuggaaacguuccuuccuacagugcuuagcccucucaggggaggguuugagacccacaaucugaaagguggggaaagauuagauuccugccucgggccaggugaaaggaaggcaggaaagagauucuguuuccugacccaacauuaucacaaaagacuguaacaagggcugugggaguuauggaccaggaaccugguugaaaaccauuauaaaucauaacaccacaaggaccuauauuuugcuuuuuaggacauuguaguagguggguaguuuucauccucuugcuuuuuaaaaucuaucuugcccagaaguuuauugggcauuucuauggaaacacaacaccucucuuaaauggcaguuucacacaucugcagccuaguaauugcuacucauuuugaagacccugaagcacaccacuggaucuggaagugacaucuucgucaccaaggaaacaguagauuaaguccugugcucaguauaguuuuacuucugaguauuuaguaaguaugauaaauuauuaaccaggauauuugauuagguagacaugccuauauuccagauagcaacaguuuaccauuagagcaaacagaaaacaccaggaaaaauucugcaggacaaguuuguaaaaugcaaugauacaucuuuaugacauauauccucuguaaggagauaaaaacaauguauguacaggaguguacauaaauaaaaguugaagaaaguacauccucugugauuuaaaaaaagaaauucaauauacccauuaaaaaagugacagguguauuaguuuucuauggcuauaguaacaaauuacuacaaucuugaugacuuaaaaugacagauucauucucuuauagugcuggaggcuguaagacugaaauuuaggugugggcaguguuggccucuucuggaagaucugaaggagacccaugccuccguccugucucccagcuucugcugccauuucuuguaucaccccagucucuacuuucaccuuuauauggcuuucccucaugucuccgugucuucaccuuuucuguuucuuagaaggacacaugucaugggguuuagggcccacccuaauucaggaugaucucaucucaagauauuuaacuuaauuacaugugcaaagaccuuuuuuccaaauaaggucauauuuugagguugggggaguuagaauaugaucguagauuuuggggggcaacaauguaacucacuuauaaaugguccacugacccccccaaaauuuguccugugugcagaaugcauucaucucaucccaauuaauuauuaacacugcuuugugaggaaaaauuaagaauuuugaaaagugagaagcuauaccucugggauaaauaaaaagacaaauggcagaagauggauagucgcuaaucuuuuuuuuagauaaacauuuuguuuugagauaguuguagguucacaaacacauaagaaauaauacagagagaucccauauuacaaaagacaccgggauguugacguugauacagugaagauacagaacacuuccaucgcuacugcuguuuugcuguuuauuaccugccccggauuucccgccccuccacugcucccugucccuaaccgugguccaccacuaaucguuccacaauuuuauacaaauauaaccauacuguauguaaccuuuuggaauugcccuuuuuuacucagcacaauucucuggagauucgugcagguuguuguaucagcagucauucguuuuuauugcugaguaauaguccauuguauggauauaccguaguuuaaccaucggcguaaugaaggccaucuggguggcuucuaauuuuuggcucuaacaaagcuucuaugaacauuuguguauguauuuuugugugacuauguuuucauuucugugggaucaguacaauugccugaucauaugguaguuuaguugcauguuuauuaucuucuuuaauaugcuuuuuuuaaagagcaguuuuagguuccuagcaaaauugaggaaaagauagagauuucucugauuccccuuggcccaacacaugcacaaccuccccuauuaucaacaccccccaucagagagguacguuggucacagucaugaaccuacauugucacauccuuaucaacaaguuaauaguugacauuaggguucacuuuugcuguuguacauugaguggguuuggacaaauguaugauaacauguuauccaccauuauagcaucauacagaauaguuucacuucccuaaaaaauccccugugcucugcccauucaucccugccuuuccccuaaccccuggcaaccacugaucuuuuuguuguccucauaguuuugccuuuuuaagaaugucauauacuguaguugaaaucauacauuaugugaccuuuucagauuagcuucuuucacuuagcaauaugcauuuaagguuucucagugucuuuucauggcuugccagcucauuucuuucuuucuuuuuuuuuuuuugagacagagucuugcucugucacccgggcuggagugcaauggcgcaaucucggcucacuguagucuccaccuucuggguucaagcgauucuccugccuuagccuccugaguaacugggacuacaggugcgugccaccaugcccagcuaauuuuuguauuuuuaguggagacgggguuuggugaaacccccucuggccauguuggccagaguggucuugaucuccuaaacucgucaucugcccaccuuggccucccaaagugcugggauuacaggcguaagccaccgugcccggcugccagcuuauuucuuuuuagcacugaaucacauuccauugucuagcuguaccacaguuuauucauucaccuacuuuaguacaucuugguugcuugcuuccaaguuuuggcaauuaugaauaaagcuucuauaaauaccaugcgcaaguuuuugugugaacauacauuuuaaacuccuuuggguaaauaccaaggaacaugggugcuggauuguaugguaagacuguuuaguuucacaggaaacugccaaauugucuuccaaaguggcuauaccauuuugcagcccuaccagcaaugagugagaguuccuguugcuccacauccuuguuagcacuugguguugucaguguucuacauuuuggccauuuuaauagguauguagugguaccuuguuuuaauuugcauuucccugaugacaauagauguggaacaucuuuccauaugcuuauaugucaucuauaugucuucuuuggugaagugucuguuaaggucuuuagaccauuuuuuguuagguuuguuucuuauugucgaauuuuaagaguuuuguguuuuuauuuuuuguuauauuuuggauaacaaccucuuaucaggcaugccuuuugcaaauguauucucccagccuguaucuuguugucauucucuugucaggaucuuuugcagagcagaccaccaugcuuggcuugagguucauuuuuuuggucgauggauauccauucaguugcuucagcaccacuucuugaaaaggcuguccuuccuccacugaauugcauuugcaucuuugucauaucaguuauucauauuugcgugggucugaaauaagaguuuggcccauaucuacugauaguucugccaguuucacaaauuaauaaaagaaaaucauuauauucaaaggauguuugcuuuuuauuauuauuauuauuauuauuauuuugucaguaguagauuagcccugaaaauuuaugaugacuuccagugugaugaacuuacuccuccuuauacaguaacguggucuauguggcuuugggaguucuuuucucuuuucucuuuuuugauucuuggaguuuuggggcccuggagaugguagugaugaaugacgaauucagcaaaacuuagaagggaacagucgagggaauugagacagccaauagaggacuugaaccccuuucuucaaaugcuaugaagaauaaauaauaagauuaguuuucaaagaugugaaagagacucugaaaaaggaacggaagugggugcuuggcauugcuuucucuuuccuuccccuguugcucuguauuugggcauuagaugugggugcuggaggagaaauuaagaagaaaauguuaaaaaucuugauaacuagacagucugauuucugauuuuccaguuuagauaaggauuacuggauggaggaguuaacuaaaauauacuuuguacaacaaagcacuguugugcuguuacauccacauuaaauguuuacucaugugcggccugcaauuuggaaagauucggcagaggauccaacuggcacauugugcucucuugaucuauucaguuuuuuaagaacggaggaaagucagcuuucguuuugugucucauacccagaaggacuucaguucuuucuuucaguccauaauuucuguaauaagcauauuaucuuugcucaguaaacaggucccuagcaaguggguggguuuuggugugucacccaggacaaggggcccaguuuguuguuuuucacuaucccaacuugccucuuaacgcucaaguaaaaggggaaagaaauagacccagccucacuugcacccacaagucaguaauaauuagucuuccagcaggucuccucuuuguuucugcuucuuggagagggcaucauaagcagcaguucaccaaaguuagcaacaagccuagauccauucaguuuuuuuugggggugugugugugugugugugugugugugugugugugugugugugugugugaugucuuuuguguuuguccuguggggacaaauacaaaguaggauccauagacuccauauucaggcuuagaauaaagacugaaauuaaucacuauucuauauggaauaaucuuaauucaguugcgagggauacauugccccuugaaucucaagcauagcccuguuuugucuuugcuuggugguagcuguuaaccaggcucugggugagccuagaacuuggucucacaugagcaguguagauaccucucugccuuuuuguuuaagaugauguagcaggcugggcgugguggcucaugccuguaaucccagcaccaugggaggccgaggcguguggaucacuuugggucaggaguucgagaccagccuggccaacauguugaaaccccgucucuacuaaaaauacaaaaaauuugcugggugugguggugcacaccuauagucccagcuacucguuaagcugaggcagacgaauuguuugaaccugggaggcagagguugcagugagcugagaucacgccacuguacuccagccugggcgacagaguaagacucugucucaauaaaacuuaaaaaaaaaaaaaaaaaaaaaaaagagaugauguagaagaaccauaguucucauuuuuggccaguuugccuuccagauuuucucugucauguuuaccuauaucuuuuacaugguuauagucagaguauuuguacuauauucuccccuguccucauauguacuuacucaggguuuuuuuuuguuuguuuguuuguuuucuaucuugaucaauuucacuguaaguuuguuacuuggcaugaggguagaaauguugauucuuacucuacugcuuacucuacugugugguggcgaagagcaugcaucuugaagccagcccaucugacuuugaagacaggcucaacuguuuuucagacguuugacuuugguccgagucacuuaaucugcuucucugacucaguuucuucuuauguaaaguaaaauagggguaauaagaauacccacuucauagaguugauuugaggauuaaauauaaccaaguauauguaaagcuuuuagaauaguuccugacauauagcauguucuguguguuagcuauuauuaucaucacucaguuaauuuugaaccacuuaauuuccaagugcuggugagucuaaagagcagagccaaacauguaauuacauaaacccagaagugaauuuuucaaaugucuuuucuaguaauagagcuuaaugagauuggcacuucagggaaaaguccuaggaacuuguuuauguuggugacuguugaucagccagaagaucucucagacgcagucuaacaucugcaucuuucuaggcuggacuaccuuugcggcaccaacagauggaucaggaauuaaaacugggagcuucuguuguggggaaucuuucaucuucuacuguuaauagccuuguggguuucccucuccuggguacuacuuucucuacggagagcuuggucuguggcacaaacaggugccgaaagggggaagaaacaccucuggguaaauaucuggaggucggcaggugacagagcaguggucuggggacacugguucagguguauguucaucacccuacccuuuaaaacucacauggaaaugacuuggcugauaaguuacuugugguuccugugauaauuaaggcagccuguuggaccaggacaaaggauuuccucagcuuucaagagaacguuucuaccaagagccauauacuaaggugugcugguuaugugaguguugaccucaguauuaguaucacuucuguugaaagugacagaaaaccucuaaaacaggguuuaaagauaguguaccucauuauuucagaauguuugugcugcuguaacaaaauaccugacacugugugauucaugaagaacagaaauuuauuucucacaauuccagaggcugggaaguucaacaucaagguacuggcaggguuggugucuggugagggccgcugucugcuuccaaggaugcaacugguugcugaauccucuagaggggacuaaugcaguguccucucauggcagaagagcagaagagaaugaauccacucccucaagcccuuucauaagggcccucaucaccuccuauaggccuaccuucuaguacaaucacaucagcaguuaaguuucagcauuucagcgugugaauuuuggggggacacauucagaccuuaacacucacucuuuuguuuuuuuuugagacacagucucgcucugucacgaggcuggagugcaguggcaugaucucagcucacuguaaccucugccucccggguucaagcgauccuccugccucggccucccaaguagcugggacuacaggcgcgugccaccacacccagcuaauuuuuuguauuuuuaguagagaccggguuucaccauguuggccaggauggucuugaucucuugaccucgugaucugccugacucggccucucaaagugcugggauuacgggugugaagcacucacucuuaauggcucucagcucuaauuauuugaaucuugggcuuuuauuuagcugcucucccauccuuaguuagaaugauagcagugcugcaagguggcugcuugagcuucagcuaucaggucuucauuugagucaacaggaaggaaugucaaaagagggaacaguugcauagucaugaggaacugcaaagguggcugaaaaaugcagucugugugcccagcuaaaauucaaggacugauggcuugaguccaggaguucgaggcugcagugagcuaagauguuacgacuucaaaaaagacuucugauaaauuuugacauuucuauuuaacagacauuugggagacacacccccaccccccaguccaggugccugagaauaaaaacuuagucacacuauugguccuugugcuccaaaagcucuucaguuauuugauugacccauggcugcuuuuugguacugaagaaccuuauuaguaauuuagugaguuuuuaauuuagauccuguaugugguggcaugggugggugguggugauuguauuguagcuaggagcuccuagucagcaaugcaugggcucuggggccaugcaugacuucaagaauagauggccuagggcaacccacuuggguccccuuccaugcuguggaagcuuuguucuuucguucuucacaauaaaucuugcugcugaaaaaagaaaagaauagauggcuuugcagauauuccagggaagcauuugagugacaccucucuauugugccacuuaaucaguuggauuggaaguugagccagcagguuugaaccuuguucuuaguuuuaaaccagggcaaauuacuggugcuuugguuuucuaaugccuguaaauuagagcuucugagccauguggggagcaaccccuacccgcaaaggagugauguaaugucugggggcugcaaugguuuuuuccuuugagauggauaccauauaagcuaguggugauacuuacuuuaugauagugacagggaaagcuacugccaagaguaauugaugugacccacacauagucccagagccaaggagcuagaugggaucuuccugccugaggaggccaagcgucuggccuucaagcauucuucucugcugugauguuguuucccguccugaaaagcagggaggaaaugaucaaucagugugccucaaccuggagccgauuggcugugguugcuaaguuuucuucccucugagcagcccucccugugauucugaagcagcucauucggaguguuacaacagacaucuugaugggauucaaaaauguugggcagcaugguuaucuggucuucuucuguaaggaugacugugaggugugccagcccauucccguagggacacaccuaacccgacgcccucccaagggcugaauuguucugagcuguccaggcuugggcuaugucagguucugagcacugaaguguaguggaggguauaugacaaagaggcgacagagcugauuacccugcuuguuuucuuuuauuuauucaguggucuuggaacugggcaagaggauuuuauggauuagcuccuggaagacacacacuagaacuaacauaguaagauuguguuuaggcugucagagccaccuccagggugagaacgauuuuagagaaauauccuuuguguagcaauacaggaaccuaugcuggcucaacagcugcccuuuuggaaacugccagccgaaggggccuguugaugagcuguuuacugccacuggggcuucccaaaugggaagucucugcuaaaggaguucauuguucagcaugucuaguggacccuggcuccuaacagcuggauucuuuugaacauaauaaacauuucuagaacagguuuucuuggugagcuuuuagcuuccuuuuaauaggcacaucacuugccugccuuuaguucuaugaaguucaacauaaauguugacuuuagugaugcagugggacaaaacaguauuauauuucucaucaguucccucccugucucccuuccccugucauuguuuuccagagguaaaguacauuuauggagaacaucggggugaaugccaaagcggcuuauguucuaaaauagugaaaagaauugugcaguuggaguuagaccuaugguuugagacucagcuuugggacugagcaaaucauuucacgugaucaauuuucuaagcuccaguuuccucauuaggaaaaaagaagacaaaguaauacuuguuguaauggaauuaaaugagauaaugucuucagaaugccauguaaguaaagaaauugugaaucaccuucacugauuuguuccauagauuuuguuuuuuccuuucuuaaaauaccuuguauugaccuucaccuaacuuuguauuuggacaacacccaacaguccuagcagaccuuuaacccucccgacuccaauuucaguaauguguuagaaguggcagggacagaauauauucuggauucauucacuaaauauagagauauuauacaaaaugaagcugaacucacgcuccagugggcagugucaguuugccugugagacagcgcuaugcagcugcagccacuaagugucuaggcacuggagauggacggcuagagugggaauccuggcuccauucaaccucucuuugccucuauguuugccaucagugguguggauaugauaauaauucccaucacauaagcuugugguaugcaaaugagaucauuuuaaagugcugagcccaguaccuagcauauagaaagaaauggggcuuuuauuauagugauaauaauuuuuaauugugguaaaauacacauaacauaaaauuuaccaucguaaccgucuuuaaguguacaucucagugguguugaguauauucacauuauuggaugaccaaauuccagaacccuuucauuauauaaaauccauucaacaacucuucauuuuccccuccccucagccccuggcaaccaccauuuaacuuuccguuucuaugaauuugacuuugcauagugcauuucacuuugcauagugaaauccuaugguauuugucuuuuugugacuauuaauauaauuguuaagucuuagcccacuguaacaguuguacccuuucccauuuuagauuucuauaggcucaggauugccugccuucucaaacccugguuauugguggauuauuucucuuucuuuucuuuuuuucucucuuauuuuuuuagagauagagucuugcucuguugcccaggcuggagugcaguggcaugaucauggcucacugcagccuugaucuccugggcucaagcaguccuccugccuuagccugccacacguagcugggacuacaggcacaaacaccaugccuagauaauuucugaauuuguguagagguggggucucacaguguugcccacccugggcuugaacuccugggcucaagugauccuccugcccuagcuucucaagucacugggauuauaggugcacgccacugugcccagcugaauuauucuuaaggaacaagaugacaccucagagcuccauuucauccuuuugaagagaggggcaggauuaggcaaaaggagaacacagagaugauagugaaagagauacagaggugaguguuaaguaagcgaaagagcauuuauucagggcagaguagagucucuuugugggacuccuccuucccucccugccuucuucccuaccagguaaaaauucaaaccuacacaacaauagagaggaugauauaaccaaacccuauguacaugucagccagauucaacaguuauccggauuuuuuagggcccauuuguaauauggcccaggaggaagaaaaugccugaacaaucuagauuaaccuagaggcagguguuucuuugcuuauuugugcaauuuuauuuaucuccuuccugauaaagggcuucuucugccuugggacuucuuacuaucuaagguugagguaaagagccaggacucuaugaaaccacauuacuuaacuugguuuccucauccauguaggagagcacauguggcuucuaaagguggucauaauggaguguuuggcacagggacugcugccuaauaaguaaucauuuacacuguuagcagugguaguguguuuguggaagggaagggucaccagccagguccuugaaaacacaggacugaaacaugcagcgggggaucaacacaauuagucauacuguaucauugaucaaggguugggaugagcgcugauuuucuagaauugcaccuacuguauguucauuaucccauuuuacuggccauuguacagguucuguccuagauugugcuggguuaagggaaacaguaguuuaucugcaaaauuagguaguguaacuuuuuaauaugcuuuuuugauggugaugggauugcuauuuacauuaaaaacauuuuauggguuuuaaauauaaauaaaaauaucacaauuugaauaacuagauaauauacauuuggcuucgugaaucacuuuuuuguuuuuguucuuuggaauucuaggaggaauucuaucuacuaauaaaggcugcagacuuuaucuuccuacaaccuuaggacguaagaaacguccuaagauagaugccugggaggaaaaggaaauugagggccuacagguguuuaaaaaccuauaguuuauaauugcuuagagccuuugauuuccccccccacccauccaucuguagcacccagagagccuugguuuuguaacauuuucacuuuugaaucuaguuuaucauaugaaaguuuuacuguucugugauauuuuggggcaugggaggaucuguggucccaaaguccagaguaguuuuaaauguuuuucuguguuaauaugcaaaaguaucaugaaggcgaaauaaauuguuugcaaauaauugagucaaaauauuauuguuccuccaaagauccuuacuuagucgugugucacagcuuguauaacaggacguauuuugcagagcuguuuaguuugcacugacuugugcaacaggaauggccaguuuuccuuacgcucagggcaaucaaacacaacuuuauaagaauuguaacuuuaaaagauuucauauuuuuguuguuguuguuguuaaaaucguugaugaaauaaauucaauaguaaaacuucuaagauuugagucaucaaaccucuaaauaugcuguuuuucuguucuguucuguucuguucuuuucucuuuuuucuuuuuuuuugaugcagucucacucuguugcccagguuggaguacauggcacgaucucagcugacugcaaccuuugugucuuggguucaggcgauuuuccuggcucagccucccgaguagcugggacuacaggcaugugccaccaugccuggcuaauuuuuguauuuuuaguagaggcaggguuucaccauguuggccaggcuagucucaaacugacuucaggugauccacccaccuuggccucuuaaacugugggauuauaggugugagcuacccugccuggccuaaauaugcuguuuuuccuuucuauuuauucgguugaccaguuucuuucuucuucuuuuuuuuuuuuuuuuuuuuuuuugagauggggucucacuguguugcccaggcuggucucgaauuccugaccucaagcaauccacccccuucagccucccaaaguuaugggauuacaggcaugggccaccgugcccggcaggucaaucaguuucauuagaagacuuggguuaugucuccuacagcuuguguaauacagacauuuuuauuuuuacauuagucuuuguaugaaaugaaaaaagaaaucaguuauuugauaaauacaauccuucacuaucucauucuauugaaugcacuuguuucauaauguuccuuuuacgaagaguauauugaagggaaaaaggggcagacacauguauuacuaucuguuuuucuuuuuuuuaaauuuuaggauacauguauuacuaacaacaacacacaaagcauguagguuugaguucauuuggaguuggcuucuccacucuuguuugggauacuccuaaguuguuuuagauguuggugguguuuguguuccuugucacccugucuguggugacacacguuugugaaaaggccaccugguuuacuguagaugugaagucauggcuguggacuggagcaaaaguaaccaacagaaguaggauuaacgcugugagcauagccuucuugcuaacuagcugagcucucuggccaugguuuuugguuccguugauauaaagagaugugcaggggcugaguggcauuccauggaugugcagucaccuugugauuccaaggcccuguagccccucagcacaucaucaccaugccuucauucuacuuucugcugccuuuuuugucugucuauaccagggcacaagcagacaggaucagguagcccuaccuuuaucaguggcucugggaaaggcucuucuggaggaggagguggugugugcugcccuccuucccccaccaucacugcaaguaccugacaguaguaagcuguguuaagggaagggaggaaggaacuuuggggauccuaagacuucucugucacaggcguguaaggcggacucuucuccguuagccuuuuuuuuuuuuuuuuuuuaauuuaacuuuuaaguucagggguuuguuacauagguaaacuugugucacagagguuuguuauacagauuauuucaucacccagguauuaagccuaguacccauuaguuauuuuuccuuauccucugcuuccucccacccgccaccuccagcaggccccaguguguguuguuccccucccuguguccaugcauucucaucauuuagcucccacuuacaagugggaacaugcaguauuugguuuucuguuccuguguuaguuugcuaaggauaguguccucuagcuccauccauguucccacaugagacgugaucuuauucuuuuuauggcugcaucccuuagcccuuuaacucaucaugcacgauagcugccuuuggauucuuccuuccagagccccuucuuggaaggugugcaucagcuugguuacucucgggacuuccucuguaccacacgugcccuuucucuuauuccugggugcucucuucucuccucacagucuuccgugugugcuaagaucgugcagcuccuggggcagaaugagguggacuaucgccagaagcagguggucauccugagccaggauagcuucuaccguguccuuaccucggagcagaaggccaaagcccugaagggccaguucaacuuugaccacccgggugagucgggcauugaaggggguauguaucuguauugguguguuggggggaauaguuuuauuuugcucaugaggaaguugcuuaaccucucggaaucuuguuucuaucuagaacguagggacuugauaacuaccuugcaguguuauuguggggcuuaugugaaagaaggaauuuucaaaugcuucaaguagugcuuggcucauuaaauacugauugaaucuguaucugaacaaaggugauuuuguaugagccugggacucaagaugggccagacaugaggucgaacauacagagcuaguccugcugccucugaucugaggcagcccucgucagacccuccuccucagguguacauguguguucaacccacugucuggcagagagggagauggaggggcaggguggcugccagagugguuuuugcccuacagcccuagaucagcacacugcuccuuuagcuggcuuggguuucuuauaauuguuagaagcaaaccugggcauggugccuauuguguguacucccccagucauggguuugcuuuccaggucaguuuagcaugugccaauccuaggaugauaacagcuaaacuuggagaggggaaagaacugacugaagucagggauggaaugucaaaggagagaaaaaagaaaucuauuugucagaacucauuuauacacccuauuuugagauacagggagcauccauucugcuuuggguaaaaauccagcuuuuuagggagcaguaugauuaccuuuaaagugugaugugcccauauacauguuuaugaggaugccuuguguaugauuauaggagauccuauuuuaaaauuaagaaacauuuuaacaauuugguauuuuucagaugccuuugacaaugaacucauucucaaaacacucaaagaaaucacugaagggaaaacaguccagauccccguguaugacuuugucucccauucccgguaagugagcuguucugggccagggauggcacccacugcuccgcagagcaucccuggucugcacugagaccuccuuccuuaccucucgcacuucagaccucuguccuaccccugccuaaugccauuccagcuggucaguggagugggugguggcagcagugugugcugugggauuguagagguuggggaguucaucugagcgcucccuggaacaguccuguugucacgauuccuuaacucugaaggaugggauagugauuucagcuugagggacugcaugugcauucugauccacauuccagugcugcuguuccuggaacaagauguaaggggagggguagaggaagggcaggaagaagagcaaagaaaacuguuuuuucugcuguccugguuuacuugggauuggacaauguggagaggcaugaggucaccagaucgugaucucagaauuaaccaagcccuccagaaagcuucucaguggaaucaaaccaguccuuuccagugaagccucaauuuuagugcuccugauuaggaauagaggaguggccacacuuccaccucauccuccuucccuuugagugaugggaaugggcuccuagaagauugcacuccugcuggccagaccccaggcuccuucagagcgucucagaccugaauguagaacacacacaucuucccaugagucugaacuagagagcauggugacgauuugguugcaggaggaagaugagagagagagagagagagaaugagcaugcaugugugugcguugagguguagagggggcuguuuuggugcuuaccuccaugccucaccagaaucuucugaaacacuuccuucuaugggccagguucuucuguguaggagagaggagagugaaagaucaggauaccauccucacgccucccgugucacucuguuuuccuaacccaaccacugcagaucauggaggaaugaaugaaggcauuucguauaggauuuggagcuuacacgaacaucaaggcugggagagugaaggccuggaaguuuauagucagagaaucagacaaaauaguccccacugacucuagccugaggcacuggagcagaagcugggguucauggaaaaguccaagaaaccaccaugucuggguuugcagccucaaucugggagcuuauggacuguuugcaaaguuucccugucucaguauuaugaucuccugaauauuguggauuuugcuucacucucaccuucgaagucucuuguuggcguaguaaccuggaagcauguggggcaagggauucugagaauuguaguucucccuuagggggaaguggugguggugucacguugacaagagacauuccagcccaccacuucccaaguaaagaauuaaaaugcagcaugauggcuaaggcaagggccugcagaagaauguaaaggagggaggaagagcaggggauucagagcagguuguauggaggaggugauauuuaagcuuuagauaggaaaggauaagaaguuguuugggaaagggauuuccaaggugcuggguagggaagcauuucagagcuaggcauggaucagcuugguuggggcauggcaguggagagguguggaggaaugggagugggugugugggaaggcaggcagaccucaggucaugaagggccauaggcggcagggccaggagcacagacauuuuggcaauagggagcuacagacgggucuauuguuguaguggaaaggucauugugguggcaggaggagagaggaucugcaaugccauuugugaagaagccuuuggaacagccccagugagagucugauaagggccugaaagaaagcaguggaacugagcaugguugacaggagccagggccugaccagugcagucuaggaguggaggagggaaguugaagaccucgugcaucaugaguuccaucaaguugauaugccaacaaaagaaaauccugguagaauucccagugcagacauguuucacguuuccuccugauuuaucucauaccuuauauuuuaaaaccuuauccuuuaguggcucaaagcucaugucuuagaaacuuucacugaucacccuagacccauauccaccccuuuccuaccuccuugcaaaucuuaagggccacuuaauuggacaucgagccauucaggguuaacugauuccaucccacccaugggcguuugguacaaacaaaaauuuguugggcuaaaaugaagaagacauuuacuuguugcaauuacauuucucugagcauccuuuuccccauaagccaaaugagaugguuagacuggguuaucucagaugaucuaauuggcuaguuucuuucuggggcuucccagccagacucuaaauuccuaagugguauauuaugccagguaugacuccuugcacauucugggcuaguaguugcucaauaaauuuguuguuguuuuuuaaaaacucugagcuguuaugacaguuuuuagaccugcguuuggacuugggaaaugauuaauucuaacuucuuaaggcaccaccaacaaauuaggcaguuaauuuucuccuuccgaaggaaaaccacuuuuccuuuuuaguauuuaucaguuaggcauccuaaaaugcucuuaauaucuagugucaguacagauugaacaucccuaaucuaaaaacccaaaaugugaaaugcuccaaaaucugaaacuuuuugagugccagugugacguucaaaggaaaugcucauuggagcauuucagauuuuggauuuucauguuagggaggcucauuguagauccucucucccccugccauauuagggaugcccuaaauauaaugcagauauuccaaaaucugaaaaaaauccaaaauucaaaaauucuaaacaccuaagcauuucauauaagggauacuuaaccuggauauguaaacuuagugcagccauuguguucucuguuaguguguucaaguggacucuugcacauacauucacuuuauuuuuggacaaagccuucccacacucuccuugguguaggggaguugccuagagaguggcucacuauuucacuuacccauugguucuguuuucugaacuucucuagguugccuucuuaugcacaaugacaaugggcacaccauuuucuggcagcugacauuccucuagacuggugcuucucuacccuggcugcauguuagaaauaucuugggagcuucuaaauaguguugaaguucuagcuccacuucagacucauuaaaucagagcuccuuggggguaggauccagguagggauauuuuuauaagcuucccagaugguucugauaugcaucucagauacaccacaauucuagggcauuuccuaauccuaguccuuuuuucccgucuucccugccccguucugccacuugcuagcuacccuagcagugccugccuuaaaacucagacacaagccuguugguccaagcugagaaggcaucaggaaguguuuaugggaaggaguuccaacggcacccucuugagcuggccguugauacugaccuccuuauguuugcacagauggaacuacuguuuuaagagacuuuguuuuauuugguuugccagugugcuagucagggugaguggaaaccuugcaaugaugauuauuucucuauuuucagugaauuuugagcaagaggcaguuggugacauauaaggugggcauaggacagaaucaaaagacaaaacacagugaaagcugcagcaaggcaaagcugagcacaagcaaggccaucugugacagcccgucgccuaaccguuuagcaauguuucacccuucuugcuuuuugaaaagucauguugguugagcuugguagcucaugccuguaauccuagcacuuugggaggcugagguggguggguugcaugaguccaggaguuauagaccagccugggcaauaugguaaaaccccguuucuaccaaaaauacaaaaauuagccuggggugguggugugcaucuguaguccuagacacuuagggggcugaggcgggaggaucgccugagccugggaaguugaggcugcagugaguccaagauugcgccgcugcacuccagccuccugggugacaaagugagacccugucuccaaaaacaagaaaaagaaagaaaagucauguuuacaauuagugccugcccuaggcuacccaaccauguggguuggguggaugaggucaugcauauuucugcuuuauugauaaggaagagcagcucuagggagcucaggauugaccuguggccacuuuguugguuugggguagagccagaccagacagacgucgggauucuguacuuccucacaaaugcuuucucgucuguauccucuuucccaaaacuuuucuuuauuuucccuccuucccuuccccuucuguccuuuccucccuccuuucaauugccucaggacuggcggggaggggauggaguuguugagagaaaacugugaguuucuguuuuuaaaguucagaguguuagguuccauaaaugccaggccaugagagcauuccuggagacgccuucagagaaaaaaagaaaucacaucuguuuuugucugccuuuauucuucauucaacagcagguuuuuuuaauuccaaggagaaggaugucugccguguauuucuguuucauggugaaagcucagaaguggucaaaggagaccuuugucccggccgugaucacccuuggcucuuugguggugguccgagggcucuguaagaccauauuagccaagucuuuagcccccgcuugaagucugugggggcaaggaacccagaacccagcccagccagauguucuggcccuuguucucugucccuugcuagccccugccuggcuuggcccauuaucugcucugugcuuugcaggaaggaggagacaguuacugucuaucccgcagacguggugcucuuugaagggauccuggccuucuacucccaggagguacgagaccuguuccagaugaagcuuuuuguggauacagaugcggacacccggcucucacgcagaggugcguucuaaaagccucagguggcccuguugguggccaccuugagggcgggggagcugggagccugugacaggaccccacccgccugagucugaagcccaugccuucccugaggcagcugugugucgcaugguccagcccggcugcgucaguccagccccaggauauccugcugcccagacacuugguaacauuugagaagggauuagucacuuacuguuugggauaacgaaaggcuugugaggucacagagacuaaauaagacacugacaucugguuuugccuggaaaaguuugauuaaaugcuuaguuccuugcaauuuguuuauaagacaucaaaaugaagaugcucugauuuggggaacuaacuguaggacccccgaggauaggauccccugugccugaaguacugggcagcucauccuguuagccugcuucucuagcccuuuauuuuccagcaggcuuuauggaggcauuaucacucuuuccagucagcucaggagggaagucagcugugcccuccgcaggcccuacuaagugugggccugccugugcuaagucccugugcuugugugcugaaggcacagcagugccccuugguagaggagcccagccugugaacugagcucuacaggguauucagcagagaguucgcuuccaccaggagagauugggaggcuucauggaggaagaaggguugggacuuggauguggugggguagggugacgcuauaggcaacccaugaaggugcacggcagagauguacagacaguggcuuguuccgagaguggcaggaaccuggaguguacagaggguuguacgaagagacacuacaaaguagguuggggucugguuuuagagacugagaucucuagucugguucucggugggcaagggagagccacugugagguucugagcgaggcaagugaaguggccacuguucuguguuggacacugguucugacaaaggaaauguaagugaagccuguagcuggagcagcucuuuggagacugcucugcugaucuagacgagaggcagggcugugguccuuagaugggugggagagggagcagaguugagaugagaagaguauuagcagaguuagaaucgaccaggacccagcaagggcaguggguggaggcgacugaauagaggaaugaaaggugagaagguuugagucuccguugugugacagaggcagggagacacaggaaaugacgagguuagcuccuagucacaggacacauuauugacaguuucagauauuauaagcuguaucccagggcccucugacuucaaagucuggguaauuuucucuuuucgguucaugaaacagaucuguaguuuaucccauuuagcaccguaauuguaagaacuauucaugagaccaguagaaccuacagaaacaaguccugagcuuugcccuucuaaguaguaauagauacauaugcuauuaagucagugggagcuacaucuugcucccagguggggugagggacaguuaguuuugugugauggaaaaaagaauggaaugggaggagacuuuuaguucuagcagagcccuucccagcuagcuuugugacuaggcucuugcgacaccccggcuuggguuucuuuauggauaauacaggggagacaggccugcuuuuagugucacgacucuggcuggguaagaguugcauggucauuuuggauagauaauugaacccugagccugacaaccccucaugcuucugccccagggccuggcuugucaccuuaauccacaaacuccggcccugcuuugguugaucugcucaguguccaugucagcuugucaaauuagagaggcagugugauacacagggacagauaaauuuuagaguccagcgaauugggcugagauccugguuuuaccacuuacuagauguguggcaaauugugcaaauuggcaaauuguguuuuaacuuuuuuguaucucauuuuccuauuagaauguggucuuaugauugguacuucugggauaguugugaagaugagagguagugcagguaaaaugccugguggugcauuagucaauaaauaucuauguggcagaucagaaaucugcuucugcugaaggggucggugcuguucguuuucugaauuuucugacaagacugguuagauccuccaaggggaucugcuccggucauguccucaggagcuagugaugcccggacugaugccaucacuaguccagcagugguacucagucucagggaugcagugcugccgagggaggccucgcagcagggagugcaggaaccagcacaggagauuagaaccaaguuuugagcagcagcaagacgcuggaaauaaagugcauccuagugucuaauucaaacagaucaucacggugugguuucaacagaacauuuucccuuccuuucuugcaugggauucuuaugugaaauaggagcaauuccuacaauggugcuggcccucuggggguuucuuagggccagcucugccucuccgccuucucugaacaggcugccugggcagggcucugcuuucucauuucagaucugcuaacuucacaugucaccuacugccgagucacuuuccugauggauucaugggacuuuucugcaugcuauuucuacaaauucauucucucuccacguaggacaaaaaacaugcuuggcaugugcuuuguggagugcgggggugcugggguagggaggcugguuagucagaagcagcuguugagugagcuugaacauuccuggagacuugaguuagcuccaugauuuuacccaucugucacacccuccugggcaugugaccuccagauucugaguugacccucaugugggagagagaucuguguuugagugaagcagcccuggaaacuaccuccuuccugauggaaacccuugaucuucucgggauugguuucuagccucauuugccuucauauucccucugugcucuuuaccaccacccagcucugaauacggggacagggaggagguggggcagggagauucaggauggcugaccccucaucuuccucauccaucauucucugguucucauagaauuagggcugcacugggccuugggggauucagcccauucuuuuacuauagaguagcacauuuccucaucagauuuuuaaagugauugacuucaccauugaggaauuaucuuuauuuugggucccucuaaguuucuuucuuggcuuuuggcuaaccagaaagagcaagucuggguuuggaagggcugacguggaagcccagcagggaaugugggcagacuuguagcuuccugcccuguacccuguccucugaaaaggccuguccuggcccagcaaaugugcuggggucagagcagugauggaggggcugguuuugagccccugggguuuccagguugugccaagaccuuguuuggacucaguccuuggcgcggcccuguuuccugacucugccugaggagaagggccuuucagugcagggaacuggcuggcccucuguuguccuuggcucagggaggcacagucugccugaggugauaguucuaucggagguucuuggggagcagaggugggcaaggccuuaugauguugcauguucccagugucugggcaacauucugacccauuccccauuugcuuuuccagcguggaagcuguagugggacuauucccuaucuuccuugcuuuuuuuccuuccucacguauguuguccuaugugcuuguguccugcucucccuucccgcguggcaaccugccuuuccagcugcccugcgggacuccuuuuucccuuugcugcccccgcucagcugggucugaccugcuuaccugaauucgagguucccgcgcucccacgguguugagcugcucugucagggaggcacugcccucccaacgcguccucagguucuguuguggucguaaucaucauagaacacaugcuuauugaacaugugcuaaggugccagcuauggugcugaagaguuuuaugcacaucucuguauuccugaauaguaacuguaugaggaagguaccauuauugucccuguuuuauaguuaaggaacuuaagauucaaagagguuaaagucacuugucgaaguucacagagguaggaguuauugggguuaggauucagguccagggcaguuuuccccccagagcccauagagguagaacaagaagcagcuuuugggcuacagagcagcuucacugugauuuaccuccuccuccuacuuucugcacgaccaguuuccucucuccagugacaaaacagcugaagccaccagaucuacagaaggaagggggcugaaggcccaggcugagggcaguuaggaggacuacgugacaggguguggacgugcacugugugugcgugcgugcguuugugugcauguguguuugugugugugcacgugugugugugugugugcugggagaaggacaaagcuuccuccagugcuaaagccuucagcaauuguaugaaaagcauguguugcaaaacaauccagcaucaggcguuugcagggcuuuaaguaaaagcugcccaagcacggguguguuuguuuuuucccuagcucugauacccuuuugaucugguuuccuuuuuucuuugggcuuuaucuggagacgugugaagaauuggaggccgcgcuggcuguguguuuuggcggugcuacucugguuagccaugugugccggagcucuggggacuucuggggggugagccacguggcagcuccuuagggcuccuucuuagcgagucucccagcagaucugccagagcagcaggucggcagcaggagcccagguccagcguugcagggguggggaaaaccauuuccuggcuggagaaggcugcugcugggcugggugggcaaguccugacacauuagcgaucagccaacuguuuuauuaccaggucucccauggagaaaacacuucguaaaucgaggagcuguuacaaaagucgaauggcagcaucauuagugcccagcuuucuggaaauguggauuuccugacaguuuucucaccuucucaucuuauagauuuccugucagccuggaucauagccaugacagccuccccguucccuggccucucugugcaugcaccugugcauguguguauaaagacagaauuauuuagacaaauggcuuucagaaguuccgucacagauauaccccauguucguuuacagugaguuucacccaacauuugagucuauuuacugagaaaugguugggaaggagcugaagagccacugcaaaugauuguagauggaugugguaacuuuuuggggugaaagauuuagcagcucagaugauaagguuagauuaagauagcauuuaaaaugacaucugcaaagagaggcaguuuuaauuaagagaaucuacuuccaaacucccuacucauggggaaacuaaggcucauguacagcggcagaaugagggugaucagucuucuuucuauuuauugacagaagacucuauuuaauaaagaguguaugggcugccuauaauuccagcacuuugggaggccgaggcagaaggaucacuugagcccaagaauucaagacuagccugggcaacaaagcaagaccccgugucuaccaaaaaaaaaaaaaaaaaaggcucacaccuguaauucccagcacuuugggaggcugaggcggguggaucaggaagucaggagaucgagaccauccuggcuaacacggugaaacccccaucucuacuaaaaauacaaaaaauuagccaggcgugguggcaggugccuguagucucagcuacucgggaggcugaggcaggagaaucgcuugaaccccagaggcagagguuguagugagcugagaucgcgccacugcacuccagccugggugacagagugaugagacucugucucaaaaacaaacaaacaaaaaauuaguccauugagguggugugugccuguagucccagcuacuugggaaguugaggugggaggaucacuugcucaagcccaggagguugaggcuguagugagcuaugacugugcuacugcacuacaaccugugugacagagcaagacaccuuguauuaaaagaaaaaaaaauuuuuuaaagaaaaaaaaaaaagaaugguaaaagccccuggauaaaacugaccgggggaagaagguagaagacagaagauggugaguuuguugucaauuugggcuucaucucagccccagcccaccauucucuaggccaugguuuucuuaucuuucacugagugauuuuuuuuuuuuuuuuuuuuuuuuuuuggcaaaccucugugcaugagguagguggaaaugguuaaccauggcuggguccucagccuggccugggcuccaugcugcagagggggcaugggugggagcugggagcagugagcugaugccugaucagugggucgcuggacuucugaacgcagguaagugcaugcaaggaggcagcgugcagcccagcccucucggggcccagauugcuucuuguuaacagugagcucuccaggagugcccugcuuuuuuaaaaaauucacacugaaauuuuguuuggagcaaauguugcuugaaacaagaaggcuguuggccuccauggacagccuuuuguuucaaagagcauugugucauugccaaguuugaccauuguaagaugucagaauguaacuugucuuuuccgaagccgcugcugaucugcucuuggucaagccucucaggauuccagcuugagaaucaucuagaguaauuguggagccugugggagcuagguccaccccaugaagggcgggugugugcuggcuccuacaccguuuuuugauucuuguuuucccuucucuuacaguauuaagggacaucagcgagagaggcagggaucuugagcagauuuuaucucaguacauuacguucgucaagccugccuuugaggaauucugcuugccagugaguuguguucuugguuuguuuuuguugaauguagaauuuaaaauuugaugauauaaacgaaggugugcaaguuuguggagcuccccugccugaaucucacuccucucucugagugauccucuguccugaaguccuaagagagggcagcccuugguccuuguguccucuguguucuccaggagcccuguccugcuguucuuucuuuggguagcccuguaggguccugccaguccuuaggcaggucauuuaauucccagcuaguucuagguuucuugcuugguggggucauggugugagaccguuuacugaggguguaucauauccaaggagaguccucagccauuuggaucucugaagggucugcaaugggugacguauggaugcacugggugcugugccccgagauguuccccucugagccucuccugccaucaccacugagcccugcuuugagcuugucuuuagcucccauuuggagacugucaugccuuacuggaauaagcuuccuucccuucacccuugcagacucaccaguccuuccuguggcagcuaggaauucucuagugagguggcuuucagagaaggaagaacacagagaguuggcccucagcccaggaaagacaggaaggggcauguugagggaaggcuaccagagacaagagguguggugugcuggggcugcagaaggagaaguauuuaacucaggagaauccuacugagucaaugagucuucuccagcuuggccaaaccauggucuggcuccugaauuauuuauaguuaagcucugagaccgggaggaagggaaggaagagcuugggacuuaaccuggucuugguugagauacacugggaaggcuggaaucucugaagacauugaagauuuagaguaaggcuggguauuggaauuucccuauuuauucuaacaauaaacuucauucuuuuucuucugggaaaauaucucaaacugucuuuguuucuuuaaggauguuacuagcuuuuacagcaacccauacuugacuuugguuuaaaugcgggacagguggacuuuuugagccaacugaguaacauugaugcccuauccauugcccuggagacuauugaguuacaagaguagguuacuggaaagagaccagagggggcugaggagcugugaacuucuuuccacccaguuaucuaucugaggaccucuccuguuauuuuugacuuaauaagaacacaaaaugaauuuauuauuggauaucagucauauuuaacugucaguuuucuacguuuaacuuaguuguaacaaagcuaaaaauucugcagacguuuucuggguuauuucugcuugcuuccacuguccagccacucuuugcucagggaagaucagcucauuccccuguaagccaggaacuuggaccugauaaaugucugcucaguucaaguuggguuuggggcugacaccguugccuuucagcaauccuagggcagaggcugcacagaguaagaugcccacaugcuugaggugugguuuauguguucuuaugcuagacuuaguuuguaugccaggaugcaguuacuuguagaauggucuacaaaaucucaguaaauuuggaccaacaaaaaagaaaaagaaaaaagaaauaugccucuuuguggccugacuuucuuucuuuaaaaauuggguaauaauagaaccuaugaacuggucaucagugaagaauacuuuuucugguuuuacccugugcuaggagugaacagugucauguuucagacuauguguaaaaguccaaggugaaccaguccccuggaaaguuuggguuuuucuaguucauauuuguccuaguggaauagaggcaauuaaguguuuggcuucaaagaccauguucucugcauaggucauaagcugaaacaguguucagcguuagaaaugagaacuugguugggugcaguggcucacgccuguaauccugggacuuugggaggcccagguggguggaucgcuugagcccaggaguuugagaccagccugggcaacauggcgauacccccucucuauaaaaaauaacaaaaauuagcugggugugguggcgggugccuguagucccagcuacucaggaggcugaggugggaugaucuccccaacucaggaagucaaggcugcagugagcugugaugaugccgcugcacuccagccugggugacagagugagacgcugucuuaaaaaaaaaagagagagugagagagaauuugaauaaaagcuaaauucuuguaauguagauaaaguggauaaaaauccaugguagauaguuaucaaucgaauuaugaacugguuuuggauuaaccacucagucuggaccauuuucccucacugaugcaugaaagucuucaauccuucuuucucauuuuccucauucccugcuuaucuucuuucauucacauuucagcuaaacaaggcacuuccuuagguuuccccaaauuucuauuaauagaugcauucacugugaaguuguaaacaauauuauauuugaagccuuaaaaggugcucuucugggcucgcuaguaugaaugcugcccuuuccccauauucccuuggagagggucucgggccaguugucucuuaacuguauuaaugcauauuaacugucuuucuccacagacaaagaaguaugcugaugugaucaucccuagaggugcagauaaucugggugagucccugcagagugucauccuggaguauaaugucugcccuuugucagucauaauuuggggcaggauguggugacccuacagggcucugcagacauggcugcccugcuugucugugauugugagccagcagaaccuuuccaccuacacgucuggccucaggaacaggucccuggguguaggcacccauguguuacggggacagacaugcacuugugcuucucuggcagaauagagggcuguagauuaccuuuuacuaucacuucccaaugaugacacuuggguacuuugcuucugaggccaccuuuuagcaaaagcagauucccuccuugaucuaauuuagaaugaccugccaucacgguagcccuuucuaaagggagcugguugcuaccauuauuguacuuauuuuucauuuuauuuuauuuuacuuuagagacgaggucuugcucugucaccaagauggaagugcaguagcacagucacagcucauuugcagccuccaauuccugggcccagccucccgguagcugggacuacaggcuugcaccaccacgguccacuaauuuuaaaaaaguguuuuuguagagaugguuucauuauguugccuaagcuggucuaaaacuccuaccucaagcgacccuuccaucucagccucccaaaguguuaggauuacaggcgugagccauagcaccuggccccauuguuuuauuuauuuuuuuggccugucuaggaaguaugaaugucucuggacuaggcguaguguggcagaguugaucuguaaaauaggaccugguuucuucauucucuuuagaauuuauuuaauuuucccuccauuuaaaaagauuauuucuugagcuguuugggaguaaguuauagcaauaaauauuuaacccuguauuuuuuaagaacaaaggcauucuuauucaucagcagaaugcagucauuaaauucaagacauuuaccauugauaugaccucuuuuaaccuggagauguucccuaucuuuuguuuuuuaagacauuuuugaggcguacaggcccauuguuugguagaaugguccucaauuuggguuugucuuuuauuuucuuaugauugguuucaugagcuuauacagucugaaggaauuaucccaggagagauguggcgugguccucuuuguguaucacaucagaaagcauuugauguguauuccauuuuuggugauguuaaauugaccucuugguugagguauauaauuuauuucuaaugcuaauaaaagauagcucucugcauuauauuuuuuggagggaaagagggccuuccauagggaugcucugucuuaggauggaaaacuggaagguucccugguggaaaggucucauagcuaauugacgugucagaaccauggcugguuaccacgucugcagacuuuggcccgagugcuucauccaguggugacugaucaucuccugauaagaagcccauucauuaagggcuuacucugugguaggcauugucuaucuuacuccuuagagcccuccugugaaggaggaggaucauauuagcucaggcagagccacugggaaguuggaugacuugccugcaaguggcagagccacuucccuggaagucuuucuacugugguuccugcaugcccuucccccagacagacucccacacucaccccugcacccaugccugcacccguaacgcucugcuggucucugccccacaguggccaucaaccucaucgugcagcacauccaggacauccugaauggagggcccuccaaacggcagaccaauggcugucucaacggcuacaccccuucacgcaagaggcaggcaucggaguccagcagcaggccgcauugacccgucuccaucggaccccagccccuaucuccaagagacagaggaggggucaggaggcacugcucaucuguacauacuguuuccuaugacauuacuguauuuaagaaaacaccauggagaugaaaugccuuugauuuuuuuuuucuuuuuguacuuuggaacgacaaaaugaaacagaacuugacccugagcuuaaauaacaaaacugugccaacuacuacuggugaugccuaauuaugaauccaacguguaaccaguuauaaauacauauauauauaaaaaaggaucuauuuuuguguaaauguacaaauacuguaaagcuguuugccauaaguauuuugcaggagggucuguacuugaguguuuuaggacuggagcuggaauuucaccaaggggaaauugccuguugugucccaggguggggaggcucgggcaucugugagagacagggaggguggcuaagguccaguugcuuuugagugccccguggaacuugaugggaaugggguuggaaaaccuugauugccuccucugucacaugccacucuuggagcuggagcuuagugauaugucaaugagagauacucuugucuuuuuuuuuuuucuuuucuuuuuuuuuuuugaguugaaauuagguaaaaucucaacucaaaaaucaaacucagggaagaggcccacugaggagaacaagucuucugcauuuucuuccugcccugcucccaccuucucgccucuggcugcuuggauagcuuggugacuccuuccucacccuccugcuucucugucucuccaagaagccagagcugccucuuuccuucccuggaagagauuuuaugggaucgcuuccugauagaagaugggaaggagagggcagaacuuugccugcugucauaucugaagaaucacugguucuuucugcaucccaggggcguaacugaucugacuccuugggcuuuuuccuguauuguggaauauagaguggaccauugcaggcugggugugggugagggcuucgguaacugaugccggcagcagcgccucauggaguggcaggggagcucugucuguggagggguaguaguuuccgcuuccuggagguuugcagugaggugaggagaguaacuuuggucagggauucucacuagcagcgucauggccaggaugcuuuacuuauuugcaauaccaccuaguggauauggcaacugcagagcauaaaaggggcucggaaaagcaguuuuuacaaaguauuuaaaaggagaguauuuaaaucauagguaccuaaguuggagccugagguugaaauauuugggguggagauuucuagcuuuccugagagcugcugcuuggugguaguguuuucucuggaaguacagauuccugacauucuggguggaggggagcccaagugagccugaaggaguucugauuauagagucccgagccucaguuucugacugcagaagagccagagauguucauuucauuguugaccacccuagugcuugguggacugugcccuuagcuaucccacuguggcugccauugccagaaacauuuuggagaaccuuuucuucccauugcucucagagccuguucgagccauucagguaaauuggucuccauuauuaccuggucacaccagauuuucccccagacucagcaccauccagucugauuccccguuucugggcucaguuugacucuaaaucuguuuugcuauuuuaaaaagucaaaccugguccccagcagagcuugccacccggagacuuucaggagaccgugcaggcucugaagggagcucccagucacagcagccgccuacuuggagcaagggaaggcucccaagaugccuccuuugaaagccggugcucaccaagaucaguucaggaucaaucauuauccuuguagucaugccuugaucaguucugagaugaagcagggaaugcaggccuggguuaguauccugaggacacagggccccuggccuugauggcacugggcugugcucaggugaagcccacccgugucugggagagccuuggcuuuucagugggcagcaugcucaacuuuacuugaagcucccaggugccaaaccauuuagugccuuggcuguuuaucccacugccuuggaagauggacuccucucaucucugagccuuuaccuagcugcuuccucaucuaccugugguguugggaccaagccuccaauaucucugaauagcccacuccuagcuuggaaacagcuauaagggcugcccugccccuugucaaaugaucaccaauucuugguggcuuggcuggggacaaugaacagugucugcuggggucugugacacacuguuucuggaacaaggaagggauggaaggcucuaccccuccguggcagcccagcauuuggccaacucuguaucugaacuugagcuuucuauggaacaaacaauggucuuaguuuuuuaagagccucugggucucugauuccauggagagucaggaguagaauuaguggaccagaaaccaugacauuugccaucuagguacucugcuguucaggguggaggcacagaugagcagaguggggugauguugguuguaugugcauagaaguccccuggcuccagagccauccaguggugcuugguucucucuuccugcccagguauuguguguggaccaaguguuuaggaaacaagcauagaagcauuaugucacaggaaggccuggccucucacuccuucacacuaaugagccuucuacugacccaaguuucuuuuucucgggcagccugggaccacuaugagcagagagaugggagucuguguaagaaggaugcaaguauccuuugauuuggaguggacagagcagguccuugcaaaggcaguggguuaaacaacgggaugucugugggacaggccagggaaggagggcagagacagggucuccaguucaccuugccgcagaacuagccuaaucaucccugcuucuggucuuggccacuuggcaaucauggggaaguugacuccccgccucacuugggcuuggagcuggauacuuguggccacgcccaggauagguugccagaguuucauuaggccgcugggucgggcuggaggcuuguguacaccucggagcagucgggcagcaggagggccggaagccugguugguuuguauaugaccucucuugcccuugugcacuuuccuugauuuagcaaccuugaccugcacuggcccucacagcuguuggagggaaguagccucuugcagggaaauauuuuccccugcccuggaaucuccuaugugccuguuaaagauuccagggccaagaacucggcaggcugaggagcagcuagguagguggguuaugcgguucaggacugcuucuggaagggacugccuguacuucuguaccaccguugcccuuuacacuuugcucagggcggggugggggaagcauucaaacaaaacaaggaagggaacugucuggcaaagcauaaguggaugcauccagagcucaguccccuuuaaucuuuugucucugggcguucugcugccuuccucauaccggggacuggcauuccaggucagcuuggcuguggucuuagaggcagggagugccuacccaguccugccucaggagcagggugaguagcuaaauacagacuuaggcuuuuuuuuccccccuuuuaagaugcuugcuccucucccuuuucuuuuuaccacccuaccuuuauuguuagugguuacaaagugaccacauauuauguacuuugcuguaaauaaagacagacaaaaaggc

SEQ ID NO: 191161 - RNA, 44608 nt, Homo sapiens
cggaagcggaagugcgaucuucgggcugucagaguuggucuguuacucggugguggcggagucuacggaagccguuuucgcuucacuuuuccuggcuguagagcgcuuucccccuggcgggugagagugcagagacgaaggugcgagaugagcacuauguucgcggacacucuccucaucguuuuuaucucugugugcacggcucugcucgcagagggugagagcggguauuucucagacguuugaucaguccccgggaggaagggccccgggguccccugugccaccaggggaaagaucgcgagccuuacuugcuugagaggcucaucuacuccacuucagggaaucucugggcaacucgugaacaggagcaggaggggaguauggagucgauugccgaguuuucuuuggucucagguagauuucacuuggguauuuguggagacaccuucacaucauguuacuguuguuuuggcugaagagucaguuguauuagccuuugaaaaaaguuaacuauggguaaauacaaagcgaaaaguuggaauuccuccuucuccaacaguaaccacuuuguuuguugugaucauuccagucauuucucuauuaacauguugcuuuuaauguuuuaggcauaaccuggguccugguuuacaggacagacaaguacaagagacugaaggcagaaguggaaaaacagaguaaaaaaugugaguauggcaacacauuagaaauaauuucaacacgucaagcucauuaaguccauguucacaauaaauauuuuaagagcaccagcugauacaaagaugaaccugacuugaagccuauuuagaaauagaagacuuuuaugcaaaauguguaauaccaacuagagggaagugaggggcguagcagauacauguuaugugcuguggugguucuaaagaagagguucaaucuggcgcaguggcuuacuccuguuaaucccagcacuuuggaaggcugaggcaggacugaacuuagggguuugacaccagccugggcaacauagggagaccucgucccuacagaaaaaauuagcuggguauggugguacacaccuauagucccagcuauuugggagacugaggcaugaggaucccuugagcccaggagauugaggcuacagugggccacgauggugucacuacacugccuccugggcaauagugagacuugucuuuaaaaaaaaaagaagaagaggcuucauucaguugugaggaaccaugguagccuucaugaugcugauggccuugcaguuccuuguggauaguuagaauuuggauagagaaugaaauggggaaaggaaauuccagguaaagaaauaacauaugagcaaaaauauggaaaucuuaacauuuaaggcauguuuggaggaugauaugucauuaugacuggugucaagguaaguggugucuucagagauaagccgaguuucaguuggguuagaaaguugaagagguguuuaaggaaaagauuaaaaacaagaaggguuuguuaccuuugaaauaaagcaggaauuccacaggacucagcuaaagguacagggugaaugguuccuuauaggccugauuuaguuuucucucuucuuuuuuuccuuauaaggauuaaauauaacuuuuguuucuuagaauuccuacaacuuucuguauucugugacuuuuucuuauaucuucauagggguuugaaguuuuuuuucuuaaauuaccauauuugaucuacacagcaaccauuugugguuacucguauaaauauuaccuccaugucauaggaaagaaaauugagccucaggaugauaaugacaacuuacgucacagagcaaacaaagaauuagagaccagacucaggcuuuuaaaauuacagcuuacuguuccuuaauuuacucaguguugauuauguaccucagcauaucugggccaaacucguuaucuuuaccuucacaaacgugauauucuuccaggauuucccuaucuuggugauggguaccuccaugcuuccaguaguguaagccagaaaccuugauaugcuuuauuaauuuggcuccaggacaccauacuuucgguuuugcugcucuccaucuuacuagucauccuuuuuuuauuuuuuauuuauuuauuuauuuuuugagacagggucucacucugucaccccucagagcucauugcagccuggaccucccaggcuuaagcgauccuccugccucagacuucugaguagcugggacuacagaugcacaccaccaugacuggcugauauuuuggagagaugaggucuuguucuguugccagggcugaucucaaacuccugggcucaagcgauccucccggcuaggccucccaaagugcugggauuacaggcaugaaccacagugcccagcccuuacugaucauucuucugcaauuuacuugaugguuucauuucuugaccucccguuguugggagugacacaaaauuuaguuuuuuucucuacauucacuuccuuggugaacuuaucuuuuggcuguauuggccagugacucccaaauuuaugucuguggcccucucuucuuaauacaagauucauauauccacgcaucaauuuguuaugucagcuagaauguuugguggacagcucagucccaacacgucccaaauugaauacuuguuccucaugucuaagccugugucauuuguagccuucuuuaucuuggucaauggcauuucuguccuuccacuugcucaggccauaauucuuguguaguuaucuuuuacucuucuuacaacccacaucuagucugucugcagauacuguuggguuuccuuuuugaagaaacaccccaaaccaguaaagguucagaaagcuuccgauauccagaaucugaccacuuuucauuagcuccaguguuaaccacuguggucuaagcaccaugaucuuuugcauggauuauugcaguaguuuccaacaaguguuccugucucccugaagucuguucucaagaugacagccagaauaaucuuuuuaaaagccuauuugaucaugucccuuucacucagcagaaaagccagcauccuacagaugcuuccuuuuuaccauucugauauucuuucuucucacuuacccugcuucacccacacuguccagcuugcuguucuuuacacauacuagccauacucuugugcugggaccuuucuaguggugauuccuucugcuuagaaauguucuucccuacaauaugugcugggcuaauccuauuaccuucuucaaaucuuuguuccaacaucaccucugacucuuaaguugaccacucuauuuaaaacugcaaggcagggcgcgguggcucaggccuguaaucccagcacuuugggaggcugagguggguggaucacgaggucaggccuucgagaccagccugaccaacauagugaaaccccgucuccacuaaaaauacaaaaauuagcugggcgugguggcacaugccuguaaucccagcuaccugggaggcugaggcaggagaauugcuucaaccugggaggcggaaguugcagugagccgagauugcaucacugcacuccagcuuggccaacagugcaagacucuugucucaaaaaaaauaaaaauaaaauaaaacugcaaccugcccaucuccccuacuccuaauauuccuuacccuguucuauuuuuucuguugcuuuuauuacuuucuaauauacuguaugauuuacuuauuuaucauguuauugcuuauuguguauuucuaccugcuagaaugaaaacuccacuagggcacgguucuuuguuguuguuuaccuauguauccuguuuaccuagaacacugacuggcacauaguaaauguuuaacaaacauuuguugacuugaaugcuuucuucuuuugccccauauaugcaguccauuaccaagcccuauuguuguuuuccugaauaguuuucagaucauuucacaucucuucauuucucccaucaccaccuagucuaaacuucuauuauauuucauuuaaucugcugcaguaaccuccucucugguccaucugcagccacucaaauuugcccccuauaaugcaucuaggguaauuuuuuaaaacacaaaucugauuauguuacuugucuuucuuaaaaccuuucaauuucuucacauugcuuuaggauaaacauguggccuguaagguccagcacagcacaguaccacccucccuucuccuggcuacaucuuguaucauauucucucuugcucccuauucucuauucauucaugccuuuuuucuguccucugggcuagucuuaugguuuccuacuacaggcacuuuguaucuguuguuccuccuaccugcgauaaguuucccuucucauuuuguuuaguaaacuccuacucauucuucagaucucaaagccuuauccagucucccagacagggccaaaucuuccuaucauaguuuaugauuuauccacauaccucuccuuagagugguugucacaacugcaguuuuaccuauauaugauuauggucaucaggguaaugucucucuccucaacaaaacuguaauugcuaugaggacaaaggccauuguauccacaguaccuaaugcagugccuggcacauauuagauacuugauaaauguguauuuaauaaauuaucuguguagcauaacaucacauauauucuuugugaaaaauuguucugcuaugauccuaugcuaguuggcagcaugcaauggcaucccuguauacauuucuucaugucauuuauaucauugaguaguuuuaugaaauacaaaacaaauuuagcuucaaauugguuugaauauucuuauaccuuaaauauuuauauaauauggauuugccuuauagauuuugagcuucacugguaucuacaauauugccuugucuuuaauuauuuacuuuauagaaauaaaugaaaagucuccuuuacuguacacugcaauucaaaguaauacaguugaggccaggugcaguggcuuacgccuguaaucccaacacuuugggaggcugaggcagguagauuguuugagcucaggaguucaagaccagccugggcaacauggcaaaaccccaucucuacaaaauguacaaaaaauuagccugacaugguggcauguguguguggucccaacuacuugggaggcugaggugggaggauugcuugagcucaggaggcgggguuugcagugagcagagaggggagauugggccacugcauuccagccuaggugacagaguugagacccaaucucuaacaaaaaugaaacaaaguaauacauuugccaguuuacacaucuguaguugcaauuuuacuauaauuucuucauaugcuuccuuugaagguaaguaugagguagguugaugauuggaaugacucauggcauuucuuguggucuuagguccucuacucuggauaaucuaccaaaacucaguaaacguguauuauuuuuauuuaugugaucagucgacuuauuugauugcuugcuauguguuuaguuuacuguaguaaguacaauaugaaaugagcggccacaaauucugucuucuggaauguauaaucaaaugcacaacuauuauauuuagcaugaggaauauuaaaaaggaaaaauauaagguaaauuuccucuuugaacaaaugucuuaauugcaaauacagaauuccuucugauacuuuguauucagaacguaguaugaauuuaagcaagggaaguuuguaggguuuuugaagaauaucaaaaauauaaagagguuugaaucagaauuugauacagguuacuuugcuugugcugaucugguccuuggcauuuuuagaagaauacuguuguccaaaaagcaguccuacugagcugcuuuuaacaaaaggaaaugcuuucuuaaagguagugaguugguugacucagguggucacugggcuuauagauguauucuaaauaucaguaggucuucuuuuauuguguuacuauuauaauauauacuaaugaaaggauacuucaauaaaugaaaaagauuaaaauacaguauauauaacuugauucuuguaacacaguuguuuauuugagagcacuuacuaaguauaaauugcugugaaguaugagguauuucuguuguuuacgguaaaauaggauaaaucuuuuagaauaauuuauaaacuguuuggcagaacucuggaauuuagaaugcaggaauacagaucauggacagaaauguguuucauaguagacaucuuuuauuuuugucaacucugacauuucuacuucuuguugucaggugagauucugaugaauaaauauccacacaccaagguuucaucacaaccucaugaaguuugaaaaacauuagauuaauuuaucccuaaaaacaauuuaucuagucucaaucuggucuucuagaagaccagacuaauguuuauggaauugucuuauguuucuauucucuagccuucugucuuuuuauugcccuguuuucuaugcagucaugguuaaaugccaaguaguuguguuauaguccuucuggggugggaaagaaauauuuuuguuucuuuguuuaauaacaaugauaaagaacaaaacauuaaguguuuucuguccauuuugucuuuuaaaauguuauccuuauaacauuuuaauaaaaauguuauccuuauaacauuuuaauaaaaauguuauccuuauaacauuuuaauaaaaauguuauccuuauaacauuuuaauaaaaauguuauccuuauaacauuuuaauaaaaauguuauccuuauaacauuuuaauaaaaauguuauccuuauaacauuuuaauaaaaauguuauccuuauaacauuuuaauaaaaauguuauccuuauaacauuuuaauaaaaauguuauccuuauaacauuuuaauaaaaauguuauccuuauaacauuuuaauaaaaauguuuauuauuuauuuauuuauuuuuuugagacaggguuucacucugucacccagguuggagugcaguggcccaaucauggcucacugcagucuugacuuccugggcuuccaugauccucucaucucagccuccugaguagcugggaccacaggagugcaccaccauggccggcugauuuuuguaguuuugguagagacgagguuucaccguguugcccaugcugaucucgaacuccugaacugaaaugaucuucccaucuuggccucucagagugcugggcuuacagaacugagccacugcacccgacauaaaauguuauuuuuauaacauuuuaaaaugugaaauuugacauuuuucuuuuaugaucucucacuaguauguucauucaaaaucuuucucucucucuuuccauguacaugauguuuuguuuuauuuuauuuuggcgacagggucucgcucucgcauaggcuggagugcagugaagugaacacagcucacugcagccucaagcuccugggcucaggagcuccuccugccucagccuccugaguagcugggacuauaggcaugugccaccacacucggcuaauuuuucaauuuuuuauagagacagagucuugccauguugcccaggcugaucccaaacuccugggcucaagcagucuucccacuucaaccuaccagagugcugggauuacagguuugagccaccaugccuggccuguaucuuaccuuucuauuuaccuagaacaguaucuguuacuuagucuuccagaacaaacacacacacacacacacacacaaauacacaaaacacauauuuuauuuuggccagccuuuuaaauuucauuugcaauauuggagucaaguugaauuuuacaauucuuggauaaagcagugauaccaauuuugcuuuuagaauucagggacaaacuucauguacuaagggaaagaguucuacccgcuaauucucuuuaauguagguuuuagaaaugguaccuauaccguacuguuugcuauuaguauacuaagauaauauggguaacagauaauauaaauaaacuaaguaaagguaauuuuugacauaucccuaguccauuuacaggugauuaaagaugguaaauauaauauaaauacauuacacuauuucuuuuucuuucuuuuuuuuauuuuuugagauggggucucgcucugucgccaggcuggaguucaguggcgagaucuuggcucacugcaacuucugccuuccggguucaagcgauucucuugccucugccucccaaguagcugggacuacaggcacgcgccacaugcccagcuaaauuuuguauuuuuaguagagauggguuuucaccauguuggccaggaugaucucaaucucuugaccucaugaucugcccaccucggccuuccaaagugcuggaauuacaggugugagccgcugcacccggcccacuauuucuuuuucaaaagcuuauuguuauguaaucaugauaguaauugaaaugcaucagaaaaauugguauuuuuuuuuuuuuuuuugagaaacagagucucgcucuauugcccagacuggaguagaguggugugaucuaaacucacugcaaccuccaccgccuggauucaagugauucuccugccucagcuucccaaguagcuggaauuauaggcauaugccacuacgcccagcuaauuuuuguauguuuuuuaguagagacgggguuucacuauauguuggccaggcuggucucaaacuccugaccucaggugaucugcccgccuaggccucccaaagugcugggguuauaggugugagccacugcgucugucuggucuuagcuuuuuuggcucuccugauuuuccugcagugugcguauaacuaucuugucacauuacuguaauugucauuugauuauuuccccugacuagauuauucuuuagaagguagggaucauuuuuuuuucaucugcuuagaguuauuuaggcagccaauaacugagugaauaaauuucuaccuucugucauaagagaauggaauuacaauuaacccuaguuaucugagagaauagaaauuugaaaauugugcuuugaaacuagcuaagguaaucauccucagcugauggucuguuuucauuaugauuauaucaauacaauucuuuauggguauuugauuaaugaugcuuauaauuguuguuucauucuuagaauauuguaucuaccuuuuaccaucaguagcuaugagaguggaccaguuaacuuaaucaugaccauaaucagucaguguguaacuuucuugcaagcuucuuucauugguucagcugugauaaagcauccuuuguuucuuuaguauaauccaguuaauuuuuacuguguuacuauguuguuuacaguggaaaagaagaaggaaacaauaacagagucagcuggucgacaacagaaaaagaaaauagguaagaugagauauuagucaaaaugaaauuuggguuuucuuaaaaaaauuaauucuuagauaaugaaaauauaaaauuauuaauagugauaacucacauuucuaugauuuuaugguuuauaaagcacaugcauacuuuaucucacuugauucuuacccauuuugugagguguacaggacaaauuuaagcaguuccucuauuuuugcucuuagcuuuggaauuugaguuuuguaaaaugacaguuguggcuuuugaacuuggcugaggguuuuuggcauaguuuguaaaagcauguuguuuuuuauaucugagaugauuauuuccacuuaagucuuacuuguauucauuguuuccauggcuuccuuacugaguauugacuagugauggaaauccaccaagggguaggaaauuuucugaguaauuuugauauacuuggagaaauaaugaccauaucauguguuuuuaguuuuuuaguauaacuuagaauuuaaguaauucuguuuccaaaagacaauucguaaaggauuguauaugauuuguuuuuauacauuaugacauuucuugauucugaaauuaggaaaaaaauuauuaugagauuguguauuuguuuuagaaacugugucuguaucccuaggucacugcuguuacaacccaggggagaauuccaugcgauuagacuaugucaauuccuguucugauuaaaguuuuucaguuaguauagcgauccuggauguuuuuuaaguggucuguucacuuaauucuaugagaaaaugcuauugaacauuuacgcuguaugugucaguuacuccuaacagcauuggagaaacaaaguagaaaaagauucuauuuuuaugagcucuauuuagagagggaaaauagaccagaaaauaaaugauuacuaugcaggaugauaaguacuuuuuuguuuguuugcuuguuuuuuucuguuuuuguuuuuguuuuuuuuugagacagaguuucacucuuguuuccuaggcuguagugcaguggugugaucucggcucacugcaaccucugccucccggguucaagcgauuuuccugccucagccucacgaguaggugggacuauaggcaugcaccaccacaccuggcuaauuuuuguauuuuuaguagagacgggauuuugccauguuagccaggcuggucucgaacuccugaccucaggugauccgccgccucaaccucuccaagugcugggcuuguagacaugagccacuaugccggccaagagucuugaggaacagaaauuuaaggaacaacagaagaaguaaaguucugaaaaaguauugccagauaaguuggaaaguaguagugucacagaaguugagaggagagugucagggaggaggaagggccugaugaugaugguaaaugucuaagaaauggagguuauuagugcuucuagcaaaaaugguuucaguggcaugaugggggacagaagccagaucauauagaugaagaagagaaugcagacauugagaaugcagacagugagaaaaugaagacauucaacauggacaacucuuucaaguaccuuugcuauaaagaauaggaaggauauaaaaauggaaggcagauuauccucuguccuuaaauuggcaacacgguguaucugaauucaaaugaucuuaacauggaguguaaccuugaauuguuugcucaccccagaaaaacucaucagaaguuauaagaaauaauauuuauugccaggcaugguggcucacgcuuguaaucccagcacuuugggaaaccaagacgggugggucaccugaggucaggaguucaagacuagccugaccaacauggcgaaaccccgucucuacuaaaaauacaaaaauuaaccaggcgugguggugcaugccuauaaucccagcuacuugggaggcugaggcaggagaauccacuugaaucugggagguggagguuguagugcgccgagaucgcgccauuguacuccagacugggcaacaagagcaaaacuuugucgcaaaaaaggaaguaguauuuaugaagaguugcuuaucaaaaucuuauuagaaauuaugagauguaauauuuaugaagaauugcuugaaagaugaucuauccauucucuagauuuguacauuuuaaucuuagauuaagccagacuaucagaaaucuguaaaccuaaacuggauuauuuuggacuucauaaaacgcuuuuacuguauuucgccuuggcauuugcauuguuaggcuuauuaugaaaaauucagccagguauaauacaauuuguuauaguacuacuauggaauauauucaaaaacauccacaacauuacacaauugucuuuugauaagaaauuguggaaacuguuucuauuaguuuucaauaucaggaaaaguagcaguucucauaaguaauugauuuauuuuaucuuacggacacugugcucgaacugauuuuuguuuuccuuugaaucggcugcugauaagccuggaaugagacuugcucauucucaugcaagaaaaucaugagauuugcucauuugguguucaucuccagcaacuuuauaggaccaauuaaauguauuuuuauguacugauccuauauaguuucauuauuaucuaacccuuacuuuuucuuagcccagauuccucacuugagcuuauuuacaaauauauacuauauuuguauauauaguauauauuuguaaauauauauauaguaucuggggaaaagggaguauaaagaguaaagccacugcacugaaagaagggaguuuucaguaagagggaagcagccagcaauauucaguguuccggagaagcaaaaugucauugauuucacuaggugaagcucuuugauaacaauccuugagagaaccauuaaucugcaguggaagcguccuuugcuuuuuaacugaagauuugauguucccaauucuuaauuucaggagcaaauguuuugacuauuuugcauuucccucuuauaagaagaaaaaugaauuuacuuuugguauaugaauuuuauauaguuuguuuuguuguauuccaaauaaagaagucauaagggguuuauuugaaggauauacgugaugagaaacucaggcaaagcugaacuaagugguuacaggaaggcaggaaccgugguaaagcaaguccugcaagcagagcaagucuugagaaaaagcuggacagggaucuucacuguaagacuucacuaauuuuuuuggcauucagcuuuugucuucaccuaaccuucccuguguccuuccccacucccaaccccuuaggaauaucugcuccagaugcuuguguccuuggguucuaucucaguauuuucauaaugugauccauagauuaccuacaucaauauugcuugagauacuugugaaaaaugaaggguucuaaguauuacucccagacuuuacugaaucaggaucucuggaugugggacccaggagucuacuuuuuucuuuuuuuuuuuuuuuaaacaagcugcccauauaauucuuaggcaaauuaaaguuucagagccaguaccauauuauaacuuuucuauuucuguucccauaguuaauugauuuauuuucccaaaauuuucuagcauaaauuccugagagaggaaucuaauuggcccagcugaucuuuuuaugucauaggucaugggagagccuaugguuuggcugccucuugggucagcaguaguaggacagaggguguuauaaaucuucaugaggcuaacccuucaacaagguauggugccaggcagauguccccagaagguggaugggaaagggagagcagacauucugaagcuugucugagugggauaaguaucucuuuucuuuuuuuguuuuguuuugcuuuuguuuuuguuuuugaagcaagguuacccucugucagcccaggcugaaguauaguggcauguucauggcucaccacaaccccaacuccucuugccucagccuccuugaauagcucagacuacaggcauauaccaccaugccuggcuaauuuuaaguuuuuuguagagauggggucucucuguguugcccuugaacuccuggacucaagcaauccuccuaccucagccucccaaagagcugggauuacaggugugggcuaccacacauggccucuuuucuucaugacuuggauuuaaauaugagaggaaauuuuugaaauuuaauauauuuggggcccugaauuuauacacucauucuaggccuuuuucuauguuauuuggauuggcugaaggucuacugacucuguggucagaauggaugucaucauugcuacuaguuuauuccaauagccacaagaaauguagccuccauuuuuggaguauuccuuuucugaauuuuaauuuucccuuuugcuagucaccuuggaaaagaaaucauucuaaauauaaauguaucuuuugcauauuuccagauuauucucuccaugaaauuuugucaaauuucauagauguuguauucuaaagguucacuacuuagagaaugcguaguuuuuuguuuuuguuuuuguuuuuguuuucagacagagucucacccuaucgcccaggcuggagcacagugacgcguucauggcccacugcagccucaaacuccugggcucaaguaauccucccacuguagccucccaaguagcugggacuacaggggcacaccaucacgguuggcuaauuuguaaauuuuuugcagagacagggucuugcuauguugcccaggauggucuugaacuccuggccucaagugaucuucucaccucagccucccaaagagcugggauugcccagcuagaaccugaauuuuaaguucauccuaucaacuggcuuauaauuuuagacuauaugccauuuuagagaaauugaaaaaauagaaaauuuaagagaaggauaacuaauuugagacaucuaaguacaaucauuauguuauacuuacaaauuaacugauuggcaauucccuuugguguaacauaagcauauauauuaauguacagaguuaagacauuuaauaccagagguaauuucaaaaaaacacuaaagauuuauuuauuuaaauugaaauauuuuggugcucugcugcauuugaaucuucugaguacaaaacguauacuaucccagguguuuucaucaucuuauuaaaugauauugagauagagugcuuuuguaaucaccaaucagugacaguuuauuuaacagcugcuuugugcucagcauuguauguauuaaccaucucauuaauucuuugcagagagacaagaagagaaacugaagaauaacaacagagaucuaucaaugguaagagaccuaacuauaacuucaugguuaaccacauaauauuuuuagcaaaagacugauuuacaucaagugcauugcacucaccuuuucagaaauuuaucaccugugaaggcuauaaauaauaucauggguguuccuggaccaaauggaagugaaaauaugcuccugcucuuaaacuucauuuuaauacuauaaauagcuuuuuuagacugucucagaggucauaauuuguccucuucacacaguucuuaguucccucuuauguuuucaaaugaaguaguuuauuuucuuuuucuucuuuacguuaaugcugaaucuuugguuuuauggugauguguguaauuccaguauagaaguuggaacauuauaaauggcuuuuauuacugucuuguguucuuuuuucuuuuuucuuuuuuagagacaggaucuugcuuugucaaccaugcuggaaugcaguagcacgaucagagcucacugccacugugaauucuugggcucuagggacccucuugucucagccucccaaguagcugggacuacaggaguacaccacgcccggcuaauuuuuaauuuuuuuuuguagagaugaggucuugcuaucuuggcuacacugaucuugaauuccugggcacacugaucuugaauuccugggcucaagugauggauccuccagccccagccacccagaguguugggauuauaggcgugagccacugcacccugccaagucuuuuuuuuuuuuuuuuuuuuuuuuugagacagagucuugcucuauuaccaagguuggagugcaguggcucuaccucgacugacugcaaacucugccaccugggcuugugcgcuccuccuaccucagccuugcaaguagcugggauuacaggcgugugccaccaugccuggcuuauuuuuguauuuuuuguacagacagggucuugcuauguugcccaggcuggucuugaacuccugagcucaagccauccaccugccucggccucccaaagugcugggauuacaggugugagcuaccgugccuggcucuuuuguucuuuaagagaccuuuuguucucaguaucuggcauaccaugaaguauaaggaaaacugauuucacuaccaauuuccucauuauuuauuaagaguaggcuuuauuugagcauaucuuccuaaagcauagauaggcuaauuauauagcuugauuaauuuuucacuuaacuucuauauauuuaacacaggacaccugaacugugcaauaguucucuuuuacuuacugagagaccuuuugccaguacuuauuaacucauuggccagaauugggccacaaagucaccccaauauucuuccucaccggguggcaagaagaggaauuggaggugaaggguggguuacccaacauacagcuauagcuuuuugcuaaggaguacuauuuuuuuuuuuugagacggagucucacucugucgccuggggcaggagugcaauggcacaaucucggcucacugcaaccuccgccucucagguucaagugauucuccugccucagccucccgaguagcugggauuacaggcacccgccaguacgccuggcuaauuuuuuguauuuuuaguagagaugggguuucaccauguuggccaggcuggucuugaacugcuacggagauuuaaaaaaaaaaugacgugaggcugggcgcaauggcucacgccuguaaucccagcacuuugggaggccgaggcgggggggucacaaggucaggggauugagaccauccuggcuaacacggugaaacuccaugucuacuaaaaauacaaaaaaucagccaagcgugguggcgggccccuguagucccagcuacucgggaggcugaggcaagggaauggcgugaacccggggggacggagcuugcagugagccgagauugcgccacuguacuccagccugggagacagagcaagacucugccucaaaaaaaaaaaaaaaaaaaaugacaugaaaccaaaacuuuugagauaugcuuuagauguguuuuuuuuuaguguaaaaugacaauuuguucgucucauuacagguucgaaugaaauccauguuugcuauuggcuuuuguuuuacugcccuaaugggaauguucaauuccaugugaguguccuuuuauaugcuuuugacuaauaacuauuacucuauauuuguauguauguuagcaugaacuuuuuggguaaaauauuuuauuuugauguaauuucaaacuuaaagaaaaguugcaagaauaguauauccauuaccuacauucacaguuguuaauguuuugcuucacuucuuuuuuuucuuuuucucucuuuucuuucucuauuauaugugugcucauccauacauuauuuauguauuuuucuuaaucauuugagaguauguuguaggcuguaugccccguuucccauaacuacuucucuguauauuuccuaaggacauuuucuuauauaacuucaaaacaauuaucaaaaucaagggaauuuuuguuuuuugggucuuuuuuuuuuuugagacggagucuugcucugucacccaggcuggagugcaguggcgcaaucuuggcucacugcaaccucugucuuccugcguucaagcgauucuccuaucucagccucccgaguagcugguacuacaggcaugcaccaccaugcccagcuaauuuuuguauuuuuaguagagacgggguuuugccauguuggucaggcuggucucaaacuccuaaccucaggugauucaccugccucggccucccaaagugcugggauuacaggcgugagccaccacgcccagccagaauuuaauuuuuauaaaauacaauuacacaauaacuuuuuuacccuuuuaauauugaggguguuuuauguauaagacauaaggcguaggcauuauggguucucuauagagaauuuaauauguucccucuuuuucaguugcuuacuaacaugcugcuucaaaaugaagguagucauaaaaagaucuuuugcuucuuaaaauagagucuuaauaacuauaaucuuguuuaaugauaagguaaauuacuguugucuaaaccagcauauagcagaccagaguaauuauggaacugaguuugacagaaaauauccaacgaugauaguaauuuauuaucuuuuuguuguuguuguucgggacagagucucucucugucaccaggcgggagugcaguggcgcgaucucagcucacugcaacuucugccuccuggguucaagugauucuccugccucagccucccgaguagcugggacuacaggugugugccaccaugccuggcuacuuuuuguauuuuugguagagacgggguuucaccauguuggccaggcuggucucaaauuccugaccucaagugauccucccacccaggccucccaaagugcugggauuacaggcgugagccaccacgccuggcccaggcuaauuuuuaaaaaguuuuuuguacagacaaggugucacuguguugcccaggcugaauauaaacuuuaauacagaagaaugguuguuuuguaaccugcuauaauuuuuguccacacaaaagucugugggcaauuuuuaaaacaugauauauguauuaauuucuguaacuuacucuuuuuugaaaugucuuuauaauguuccauugaauggauguacuuuuuuuuuuuuuucuuuuuuuuuuugagacggaguuuugcucuuuaugcccaggcuggagugcaauggccuggucucaacacacugcuaucuccgccucuuggguugaagccauucuccugccucagccucccgaguagcugggauuacaggugcgaaccaccacacccagcuaauuuuuuguauuuuuaguagagauggguuuucaccauguuggccaggcuggucucgaacucaugaccucaggugauuugcucaccuuggccucccaaagugcugggauuacaggugugagccauugcgccuggccaggauguacucuguuuaacuaauuuuuuauuaaucaucauaaagaauuuuuagauaguauguauaccaauguauacuuauuauucccuuaggguauauccuaguauuucgugaguuaaacuuugguauauauuguuccuuagauuuuauuaauuuauaucuuuagauuauugccaucaguacuugugaauggaucuuucuccuuauacuuaucaucacuggaaauuaugauguaucugcuuaaaauuugccaauugaauaguugaaaaauaauauuucuuucaaauuuuuucauuuuuuugauaauuugugugagauuuaacaucuuuucauauacuuacuauguuuuuccaguuuuaaguuccuaguucauucccuccacuugcucccugccuucuuuuuuuugacguuuauuuuuuauguuuuuauuuacaagaguuuuuuacauauagaggcuauuaaacucuuuuuuuggaaaauauuuuuuguuguuaaagcuguuacucuuuuccauuagguaaguaaugccauucgucauaucagauuauagaaaaauuuuuuuccuguuuuuuucuauuuucuuauuuauuuauuuaaagacagguuuucacuccauuacccaggccggagugcaguggugcagucauugcccacugcauccuugaacuccugggccccagugaucccuaccucuggccucccagaguguugggguuacaggcaugagccacugcaccuagccuacuuguuauauuuaaauauuuguuucgucuacaauuuauuuugguauuugguuuccaacuuuacuaaguuuuuaaccauugucaauaucacguaguugaauaaaucaucuuuucccugaugauuugaaaugacuuguuuauuacguaucaguagcuucccaaaacuuaggcaguggaucuuaaccaggaaugugcaucagaaucauauacgggggaaaaaaucauauauggaguuuuauaaaauaauuuucuuauaugaguaauauauaaaacuuauuucuaaaaaauucaaacacuuauauagaauaaaaagugaaagugaacccaaauagauugaaaacuuagauccacacaaaaaccuguacacagauguuuauagcagguuuauucauaauugccagaaguuggaaggaaucaagaugucuuucgguaggugaaaggauaaacaaacugugguacaacuagacaaugaaauauuauucagugcuaaaaagaagugagcugguaagccaugaaaagacauggagaaaucuuaaaugcauaauuuuaagugaauaagcucuuccaaaaaggcuguauacuguacgauuccugcuguaugaaaaaggcaaaacuauggagacaguaaaaagaucaaugguugccaggaguuaggaggaagggaaggaugacuaggcagagcacagaggauucuuuagggcaaugagauuauucuuuaugauacuauaaugguagauaacauguuauuauauauuuguccaaacccauagaauguacaacaccaagaaugaacccuaaugucaaccauggacuuugaaacucacuuggaaccaauuguguucccugugaaagcagcauucucauccauauguuuuagugguacucaauucucaucaccaggaauucaaaccuuuuuuguuucccuuccucucccucuucuuuucauuagacauuacuccauaucuguccugucccaaauuuaaugauauguacuggauuaaaucugacccuuucaacuuucucuuccucucaguuaacagccccuguuuucugucuguguagucauucauucaucccucccucucuucucauucauccuagcaccagcucccauccuaguuucaaugauuauuuccuuuuuucuccuuugcuauuacuuuuugcuugguaucacaauagccugcuuucgcucccucaggugucuccucucuauccaacauuguuaaguuagccauccucagaagccuguuacucauugccuaauaacauuaucugcuacugauuaaauaguaacccauguuggggacuguagugaacuuuuuauauauguuacccuuuuacugguuuuuuuuuuuuugaaauggagucuugcugugucacccaggcugaagugcaguggcgugaucugggcucaccguaaccuccaccucccggguucaagcgauucuccugccucagcuuccugaguagcugagauuacagggacucgcccccacaccaagcuaauuuuuguauuuuuaguagacaugggguuucaccauguuggcaaggcuggucuugaauuccugaccucaggugaucugccugccucggccucccagagugcugguauuacaggugugagccaccacgcccugccuucccuuuuacuuuuaacagucuucuaagauaagaauucuaaucuuuauuuuacagaugaggacgugagacucuaagucacuuaacuugcucaaggucuccaagcuaguaaauguugagcugggguuuaacccugucucucagacucuaaaguccacacuuaucaccaugcaacccugacuauugauuuuagucagacuccuuacccuggcucucaugacauuccaugcuuuggccccagccuguuuuucaaacuauuuucuuaucauugccuacuacguacucuguuuuaacuguauuguucacuguuccuggggcacuuauucuuucaaaugaauuuuagaaucaaucaagugucagcuuccucuaaaauaaucccuucugaguuuugucugaaauuuuauuaaauuuguacauuaauuuugagguauuaaauaccuuuauaauuuuuaguauucccauccagaaacaugguauuucugccaagucuauuuuauauacuuucuguaguuucuuuccaaauaaguauaaguaauauuucauauuuucuaguuugcuacuacugucuauaaguagcuuaucaauuuuuuuuuuuuuuuuuuuuuuuuuugagacagagccucacacuguucucuguugcccaggcuagagugcaguggcacgaucuuggcucauugcagccucuaccucccggguucaagugauucuccugccucauccucccgaguaggugggauuacaggcaggcaucacuacgccuggcuuauuuuuguauuuuuaguagagaugggguuucaccauguuggccaggcuagucuugagcuccugaccucaagugauccaccugccucagccucccaaaaugcugggauuacaggcgugagccaccaugcccagcagguuaucaauuuuugugauuuuauuuucuaauuggacaucuuccugaacucuccuagcuuuuaauuugauucucuaguuuucuagauagauaaucauaugaucagacaaauaauauugucaucuuuuccaaauucucuuuucccuccaucccuuccuuucucuccaucacuguucucuaguucuauugugcaaugaauuagaacaaccagaagaggguuaaauacucaaagguaaaauaccaacgauacugcaguaaagaugggaacaagaugaagagaaugcccauaucacugcuaugauauuuaugaaauuuuuaaagaauggagguuuucaaagcuauaugcaagcauaugugauauguuauccuuaauagaguuaauaauauaauaagcacuuaucaaauauuuggugauuaaguuauuagaccuuggaccaguauugaaaugccagauuauuuuugcaguucaucaauauaaaauacuagaugcugugugugugugugugugugugugugugugugugugauauaggucuuccaagcuauagaagucaaagaagucaaguagaguaucuucaaggaggaaaauuauaugaaagcuucauuauaaucagguuucuuauaaaaggauauguuggcaggaaagaaggcuauuuuuuuuuuuuuuuuuugagauggagucuagcucugucgcccaggcuggagugcaguggcacaaucucggcucacuacgaccuccgccuccugcauucaagcaauucuucugccucagccucccaaguagcugggacuacaggcaugcaccaccaugccuggcuaauuuucuuaucauugccuacuaccuacucuguuuuguauuguuaguacagaggggguuccaccauauuggccaggcuggucucaaacuccugaccucgugauccacccgccucagccucccaaagugcugggauuacaggcgugagccaccgcuccuggccuucuuuuuuuguuuuuauguauauuauuuucagcaacuuucuuauucagaacacuggcaaacaauagcuuuuuauuugcuuguuuuguuuucccaaacuaguggagguucgcauaauauauuuuaccaauauuagugcuguauucauguuuuuguucuggucuuuguacccuguacauuuaaaaaaaauauugugucuuagauugucagcaccuagaaguuaaaggcuguacaucuauuuuuauaaacuggcauaugaaauuaaaagucuaauacauguuuugauuauauuggacaaaaguuauucagucuuuaacauaauuucuccaaguuuaacuuugaucaucuguuuuugagaccagaucuugcucugucacccaggcuggagugcaguggugugaucacuauucacugcagccucaaccugcugggcucaagugaucccccuaccuuagccuccugaguagcugggacuacagacaugcaccaugacacguggcuaauuuuuuuuuuuuuuuuuuuuuuugguagagauaggguuucgccauguugcccgggcuggucucgaacucauggcuucaagugauccuccugccucggccucucaaagugcugggauuaugagacaugagccaccacgccuggccaagacuauaagggauacuaaaagauuauguaagccaagagugguggcucauuccuauaaucccagcaauuugggaggcugaggcaggaggaucacuugaagccaggaguuugagaccagccugagcaacauaggaagaccacagcucuacaaaaaaaaaaaaaaaauuagccagacauggugcuauaccucuguaaucucaccuuccugggaggcugaggcaggaggauucuuugagcccaggaggucaaggcugcagugagccaugauugcaccacugcauuccagccugaaugacagagcgagacccugugugaagcaaacaaaaauaauaucccuuacacucuuaaaauuuguuaacagcuggcagaugcuuuaaggaaaaaaaucuaugguuagacuaagaagggaaggacuugaacucccagacugccagaaaaaggacuagauauagcuacuuauuuaguagcuguaucuacuuuuuggcaucucuuccugaaucauuuacauaaaguugaaauaacaggauuuuagaauugaaauuuuuuuuuuuuuuuuuuuuuugagauggaguuuugcucuuguugcccaggauagaaugcaauggcaugaucucggcucaccacaaccucugccucgcggguucaagugauucuccugccucagccuccugaguagcugggauuacaggcaugcgccaccaugcccggcuaauuuuguauuuuuaguagacacgggguuucuccauguuggucagcuggucucgaacucccaaccucaggugauccgccugccuuggccucccaaagugcuggaauuacaggugugagccaccgugcccagccugaaagagaucuuaaaagucauuuaacacauaacuucucuccuaauacagaaagcucaucacuaaugucucuaacagauaauuugucauccuuuauuuccaacaaugaggagcuuagugguuucugagauaacuaguacuuuuauugaguaguuuuuagaguuugaaaauaauucguuuuacugggccaaaauaugccucccuauaucuguacuugugagcagugauccugcccucuggagucauagaguaagugcacuuaaagaaauaauccaccuauuguaaaucaucucucucuuugcaccuuccuucuucucuucccaguuuuuuucuuuauugugcuagacaccaauuucuguuccuuauaacaagcuucuauuccuguaggacuuugagaggcugaggcaggcggaucaugaggucaagagaucgagaccaucaaggccaacaucgugaaacccugucucuacuaaaaauacaaaaauuagcugggugugguggugcacaucuguaaucccagcuacucgggaggcugaggcaggagaaucgcuugaagcaggagguggagguugcagugagcugagacggcgacacugcacucuggccugagugacagagcgagacuccaucucaaaaaaaaaaaaaaggaauuaucagaagauuuuucagauuuguugcugguuuaaagucucaugcauguucaacuucauauaauuaaauaacuuauauauaaagauauaaaagauuuuauaucgcuugaacccgggaggcgaagguugcaaugagccgagauugugccacugcacuccagccugaccgacacggcaagacuccgucucaaaaaaaauaaauauuaaacauuucucauuuuuaauuucuaauacaguaaauauuaauaacuauaagcuacagaaacacaaaguuuuuaggguccuaaauaauuugucaguauauaaaggggucuugauaccaaaagaauugagaaugacuaauuuaggaaaagauugaugagaauaaucuaggcucuucuuuacaucaccguacaucagguucauguguauuuuuagcaugucacccucucuuuguuuuucagagaucagagacuuaaagcucuauuucugucccagauucuucuuuggaaguaagaaaguugucagucuuccaaagauaacaauucuuuuuuuuuuuuuuucuuuuagauuugaugguagagugguggcaaagcuuccuuuuaccccucuuucuuacauccaaggacugucucaucgaaaucugcugggagaugacaccacagacuguuccuucauuuuccuguauauucucuguacuaugucgauucgacaggugagugaucacaucuaccauuuaauauguauauuuuuccuugcugucauaccaauuagcuuuuacuuuuauaauacuagaaauguuuacccauuguuccugaguucuuucaguugcucauuuuagaauuucaguguaucuuccaaaagccauuuuaaauggcuguaggucuagaugacugauccuuagggaugagaaguagugauaaaaccaaacauggauuccacaucccauucuuagagcucucaggcuccuucuuuauuacaacugccuaaagcugcaaaaguagagaguggguuuggucuucccaguaccauuucuucauuauauaccagcaccauuuagcggcucaggagcacaaguaaguuuaacaaugugguaauuuuagguuauucacaguugagauaaaguuuagguuauagaauuuacauuuggccaacuuggugauuugacauucguagugaaaaagagugagaacuaaggaguaaaaggguuaugaaggcccggaagagagcuauaacauucgauuaguggggaaagguucaggcagaaagguuuagagaaugaaguggcuuucgagaugggccuauggaagugaaaagguggccaggugccguggcucaugccuguaauuccagcaauuugguaggcugaggcgugagaaucaccugagcucgggaauuugagaccagccuaggcaacauugugagauuccaucucuacaaaaaauuuaaaaauuagcuggguaugguggcaugugccuguagucccagcuacccuagaggccgaggucggaaggucacaaaagccugggaauuugagcuugaagugagacuugauuacaucacuggacuuuagccugggcagcagagcgggacccugucucaaaaaaagaaaagggggggagccgauaauuaaggucucuggcugaacaauucuuuauuuuagggcauuauucaguuucugaacauauugccguucggcaggcuuuguaguggaaagguuugcacaugcaguaaauaggaacauaaaauuuuccuuacacuuacacaagugauucucuuuuucuccccuccuucugaauacugucuguggcagaagauuuuugguugcccuguguauuaguuuguucuugcauugcuauaaagaaauaccugagacuggguaauuuauaaagaaaagagguuuaauuggcuuauggcucuguagauuguacaggaagcaugaugcuagcaucugcucaacuucugggaaguccucaggaaacuuagaaucauggcggaaugcagaagggaagcaggcaugucacauggcaagaguaggaacaagagagagaggugggagguauuacacacuuuuaaacaaccagaucucgugagaacucacucacuaucacaagaacaguaccaagggggauggugcuaaaccacacaauuugacaugagauuuggauggggacacagauucaaaccauuaucacccuggaaugugagaaucaaugggaaaucaaauuauaguucauggcucaccaagaucuuugucauuguauugcuuaauauuuuuucccaauucauaucccaucacauccccacaaauacagcacuuugcccauucuggcuugcuuaauaguuuucauguuacacucacucagauguacuuuuugcuucuguuuuuccuuauuucugaaugccucccucuucuuccuuuuaaacacaaucaaguuuuaaggcuuccuuuucuggcacauauuuucuggcacuuacugcauugugaagguuagcuauaagaggagcaugacuaaaauacagaaauaucaaaagacuauuauaauaguguagcaaaaaaucauuauguuauaaacuauaacagugaaaagagggaugaaaagaaugggaaaagauugagaaauaaauagaaggggaaaccagcugaacuuaguuauugauuuaaugugaaggagaaaggaaaaacuaagaggacuuucagguuuuuuauuuuggugaccaaauggggacuaguuucacuaagagacugggaauagaagaaagaagaguauguugguuagaagacacgcugaguuugagguguuuguugaauagcuaaaugauuauguccaccaauaaguuguacucuugcuuagcugagguauauacuuaaauuuuugaaauggucucuguaauagagcugcccuagcccauuuucuguugcuguaacaguauaccacagccuggcuaauuuauaaagacaauuuagcucacaguucugcaggaaggccaagagcauggugcuggcaucuacugagggccuuccugcuacaucauaagaugguggaggacaucacauggugagaaggcaagagcgagaaccagagagaacucacuuuuauagcaaagccacucgugauaaggaacccacuccagugauaaugacauuaaucuauucaugagggcagagggauuacauuuccaccacaugaacuuuucggggacacauucaaaccauagcaggaguuuauugugaaagcuaagguaaugacaacacagaucucuuuugguuuagcacagauccuuugaucucuguggaauauuggucuuuaauuuguuaagucugaaauuuuaaaauuguggcuuggguugacaucuuaauaaaacacaauaugaugggccaggcgcgguggcucacgccuguaaucccagcacuuugggaggucgaggcgggcggaucaugaggucaggagaucgagaccauccuggcuaacacagugaaacuccaucucuacuaaaaaaaauacaaagaaaauuagcugggcguggugguggucacccguagucccagcuacucgggcgacugaggcaggagaauggugugaaccuggaggcggagauugcagggagccaagaucacgccacugcacuccagccugggcaacagagcaagacucugucucaaaaaaauaaauaaauaaguaaaacauaaaaacacacgauguauauauuucacuuuaagcaacaaagagcaauucugaguuuguuguuguuguuguuguuauuauuuugagacagaaucucacuccaucacccaggcuggagugcaauagcucgaucucggcucacugcaaccuccgccucccugguucaagugauucuccugccucagccucccaagaagcugggauuauaggcacccaccaccaugccuggcuaacccuuuauauuuuuaguagagacaggguuucgccauguuggccaggcuggucucgaauuccugaccucaggugauccacccaccugggccucccaaauuucugggauuacaggcgugagccacugugcccggccccauucuguuuuaauuucaggcagauuuuguuacuuuacuugugauggaucaauaguaaucuuagaugcaccaaaaagucaccaucuaaaacuguagaguuuucaaaaugaaauaaauguuguuaagaauuaucauuuagagccaggcacaguggcucacaccuguaaucccagcacuuugggaggccaaggcgagcagguagcuugagcccaggaguucaagaccagccugggaaacauggugagaccccaucucuacaaaaaaugcaaaaauuuaacuggguauaguggugcaugccucuacucccagcuacuugggagucugaggugggaagauugcuugagcccgggagguggagguugcagugagccgagauugcaucacugcacuccagccugggcaacagagccagacccugucucaaaaaaaaauuauuuaggaaguucaacucaagcuggucuuuacacuccuuuuaauuauuucuaaaaaugugaugaguugugugucaguuauuuuaucaggaaugcaaagcucauuuucagugcggaucggcaaacuguuucuguaaaggucuagauagcaaauauuuuaggcuuuguggagaacugaaguguacgguauaugcuauuaaguuaaaauaagaaaaucugcagauccuagacugguacagccuacugaaacaugcuugcugaauacaaaaaagagggggaggugggcagcaaaaaacacaaaaaauuuucauauguuuguuuucaguuaaggaggauauauacuaacacuuuuuauuuccacuuguccagguguaugcaaauucagugucuagugagggccuguuuccugccugguucauagagagugccuucucucugcaugacacgcaugagaaaaaaagucuauaaggacuauaguauugcauagcuaauguaaaacuguuguauuugaaggaucuguucuuuugguauauaguugucuuccccaagaucccagcugaauucuaacuacuuauugcagcauccucagugauagucaucuugcagauaauuuuauuacuuaaauucuaaaaacaaaaauagucugaaauacuuaaagcuuggaaaaaucacagaagucaccuaccuuuauacuuuuuguuuuauuaauuauaaauuguuucucuaccuauuacucacuguuagcuuaugcacaagagaauuaugaacauauuaauauauccagucugaaaugccuuaacagcauuugaaguguuaucauggaauauaugcuucuuccuuugaacuaaaauccuuauuagccugcuauuuccacauguuuuauuugcuuuuuaagaucuuagguuacauguuguuguuuuauuugcuuuuuaagaucuuagguuacauaagaauugacucuaugguugccugcgaaaugaauagucagaauaugaggauuucagaaacucaaauuguagacuguaccgugauuuucccaugaaugccauuggcaaagaaauaggccugguuuuucgguuguuuuguuguuguuuguuuguuuuggagacagagucucguucuguugcuccggcuagagugcagugacgcaaucacagcucacugcaaccuucaccucccagguucaagcaauucucccaucucaguuuccugaguagcugggauuacaggugcaugccaccacacccagcuaauuuuuguauuuuuaguagagacaggguuucaccaugucggccaggcuugucucaaacuccuggccuuaagugaucugccugcuguggccucccaaagugcugaacgccuggcagcuuuccaaucuuaaguguucuuggcauaggaaacauggaggcaugaacguuuguaauggauauagggacuacugaaucuagagcuguuggugggcuguaacaggaagugaagcuugucacugagaaggauugccugaaucuucaccucaugguauagcauuaaggaauuucauuuuucuuucuugugcuucuuauagugcaagucugcuggugacaaauucucuuaaucuucauuuaucugaaaauaucuuuauuuuaucuucauucuugaaggauauuuucauuggacauagaauucugguuuggcuuuuuuguucguuuuaaccuuuaagcauuuuaaaugccuuuccacuguuuucuggccuccauuguuucugaaaaguucuucaugucuuuguguccucguaaguaaugucacuuuucucuagcuacuuucagauuuucucuuugagauugguucucagaaauuugacugugaugugccuagaguauuuuuauuuaaaguuuuuccugcuaggacuuaugguuuucauuaaauguagggaaauuucaaucauuauuucuuuaacuguuuucugccucauucucucucucuucuucuucuggaacaccaguugcuuauauauuagucauuuuggguauuguccaacaggacacugaagcuauguugaauuuuuuuaaaucuuuuuuuuuuucuguucuucagaugggauaauuucuguugaucugucuucaaguucacagacuccucuaaucuguguuaacccuaagccuacccaaugauuuuugaauuuuagguaauauuuuucaguuucagaauuuuugcuuuauuuggcauccuuccugagauuucuuguuuguuaauauauuaugagccauauuuuauguccauaauuauuuagcugcuuuaaaaaccuugucugcugggcuggugugguggcucaugccuguucagcauuuaggaagcugaggcaggaguucaagaccaagagcccaagaguucaagaccagccuggauaacagagcaaaaucucaucucuacaaaaaauacaaaaauuagcugggcacaguggcauguaccuguaaucccagcugcuggguuauggggacuuaagugggaggauugcuuuagcccuggagaucggguuugugguaagcugugaucgcgccuuugcauucaugccugggcggcagagcaagacucugucucaaaaacaaaacaaaaaaaccuugugugcuaauuccaacauuuggaauuuggacuccauucccuguucucuuuuuuuuguuuuuuguuuuuuuuuuuuuugagauggagucuugcucuuauugcccaagcuguagugcaguggcaugaucucgguucacugcaaccuccaucucccaguucaagugauucuccugucucagccuccugaguagcugagauuacaggcacccgcuaccaugcccggcuaauuuuguauuuuuaggagagagcggguuucaccauguuggucaggcuggcuagucucaaacaccugaccucgggugauccaccugccucggccucccaaaguguugggauuacaggcgugagcccccgcgcccggccuguucucuuaaguaacaguauauuuuccaguuucuugauauaucuaguaauuuuggaucauauccuggauaauguaaacgauagguugaagauauucuggauucuuuuauucuuuggaagaaguguugauauuuuuguauaggcaggcaguuaaccuggcauuugucuuaguccauuagggcuacuauaacaaaauaccauauacaauagaaauuuauuucuuacucuucuagaggcugagaaguccaaaaucaaggcaaauucggugucuggugagguccuguuuccugccugguucauagagagugccuucugucugcauccucacaugguggaaggcacagggcagcucuucgggaccuuuuuuuugaaaggacaaucccauuaaagagggcagagcccucauaaccuaaucaccuccaaaaguucccaccuucuaacaccuugguaguuuggauucaacauaugaauuuguaagggaaacaaacauucagaccauagcagcacucaaacuccaaacucuccuuugugguagauggcagcugaagucucaggucaguuauuuuagucuuaacugggcugcuuauuggcugccuuguacauaguuuaagaauuaagcagacccaggcgugguggcucaugccuguaaucccagcauuuugggaggccagggcggguagaucacuugaggucaggaguuccagaccaaccuugccaacauguugaaaccccgucucuacuaaaaauacaaaaauuagccaggcaugguggugcaugucuguaaucccagauacucaggaggcugaggcaugagaaucgcuugaaccugggaggcagagguugcagugagcugagacugcgccaccgcauuccagccugggugacagggcaagauucugucuccaaaaaaaaaaaaaaaaaaaauuaagcagagauuugggggcagaguuuauaugcaaaauuugaggcuccuuuuuuguugucucucuguuuuccaggauucuuucucuauuuccaguagcugugguuuuccaguagcuuuuugauucuucaaaccaguaagauuauaguuuauucugaguuuuagacacucuucacagugccaacugggguuaugcccuccauuaugagauuuucaaaaaauaaaacauuuugucuuucugcacuaagcuaaaauucagaauauucuccuugacugauccucaaagaaggagcuaaaagagaucuagggacauuuucauuggaaagauacgggagaaagaggaaaggaaggaggaagugagagggagagaaagagauugucacuuaaucuccugaccgcagcagaaaagaccuuuauuacaaagagggccuuugaucaaccuaagacagaaaauauucauucaucauuacaaaggaagugacauuacucuagugcagauuugaugugcuuaucuuucagaauuuuuauuuccacuuuauaagauauguguuaagaaggucccagaagggagcuuccguuuucuacccuauuuuauuuguuuucuguauugggcuuuuauacaucacauuuuauuuuucaaaaggcuucuguuaaucucugugaauugugugcaaaaaaacaaaacaaaacaaaacaaaacaaaaaacgaugggccgagcgcgguggcucacaccuguaauccuagcacuuugggaggccaaggcagguggaucacgaggucagaaguucaagaccagccuggccaagauggugaaacccugucucuacuaaaaauacaaaauuagccgggcaugguggcaggcgccuguaaucccagcuacuugggaggcuaaggaagagaauugcuugaacucaggaggugguggagguugcagugagcugagaucacaccacugcacuccagccuggacgacagaguaagacuccgucucaaaaaauaaaaauaaaaaagaauagaaauuuauuuuaaaaauuaaaaaauaaaagaguuauuaaaggcuuuaagggucugaaaaugauugaucuagucaacccucuuuuuucuaacaguaaggacauugagauuugguaaaaugaaaagauacuccuauuguuuuauugucuaguuugucagcacuguaacccaaguuuucugauugcuaacccaauaauauuucagcgauaucaagcuuguacgauaagguuuuuuuaguaaauauuuaaucucuacauuauuuuucccaaauagucuagucagauauaaugugagagcccugguaauauuggaaagggucguuuugaagugauuagauuuuauauacagcuuuguugauagaguaaagauuacauugugggaauuaaugagauauugcgauuaauuggaagugaagacugguugccagaugucagagaaacuaacagagugaacugaggauugccauagguguguuauuuuagcuaaaugacuaaggaauaaaauucagcagaauguguuuauugccauugaccugggucuucccaaaauauccaguuagcaaccaacaacuuccguuucuugaucacugguucuuaaucaugguaaagaggaaagaacacaaauccuguguuuguauuuuucagguuuuccugccaguagaagacacaauuaugggaaaauguuuuuccuuuguuuuucucuucuggguauacauucuucauuuguuacccuguuauacaggacuggacaggaauucaaaauaauuguuuuacauuuuuccaaaacuugauugcaucuuacuauauuuugcauuucuauuuucuuucauagcaucuuuauuauauauuaaaacuccuaucuuuuagcuaaaugcauauuucuuucuuuuuuuuuguuuuuuuugagauggagucuugcucugucacccagguuggagugcagcugcacgaucuccuacaaccucugccucccggguuucaaaugauucuccugccucagccucccaaguagcuaggauuacaggcgcauguggagacggguuucaccauguuggccaggcuggucucaaacuccugaucucagaugauccacccaccucggccucccaaggugcugggauuacaggugugagccaccacuccuggccuaaaugcauauuucuaaacuaaaucuugcuaauuaacaaggccugaaaacuugaccucaagaagaaagaaaaauugagagauuauaggaaagcagucagguuaaguuuaauggaugagauuguugaaagauguaaugagauaauauauacaaaagugccugcuguacagugugguauucagugaguauuuauugaauuacagccugaccauugguaucuuauuuuucuuaucuacaugcaaggauaaugauguccaccucauuaaguugugaggauuuaaaugaggacauacauauaaaggucuuagaacaaugccuugcagaguguaaguacucaguaacuguuaaccauuauuauuguuguuauucuuuuuuuuagcuucauacuaugaccuucacuuuaaaauagcacccacaggaauauuuuucuuuauuuuaaaaguauuccauuuagcaguauuucaaaaaguuggggaaggcaagauaugagaaaaaguauacaacuauuauuaauacaacuguuaucuuacuauauauucuuaaauacuuuauauucccuuuuauagaccuuauuuuuuagaacaguuuuagguucacagcaaaauugaguggaagguacagagauuucauauauaugccuugcccccacauaugcauagcacaccccucuaucaacuuucuccaccagagugguacauuuguuacaauugauuaaucuacacugacauauaauuauuacccccaaauccauaguuuauguuaggguccauucuuugcauuguacauucuauggguuuuuugcauagcaacuauauuuuauauguguauguuuauauauauauauauagagagagagagagagagagagagagagaaaccauuugcucauuuaacagcauaauugugauuuuuuaaaaaaauaggccuguuacacgauuuuuuauuccuuuuuuuuuuuuuuuuugcuucuuuaugugauuuuuuuauuccuaagauaacagucuguuacagagagguggcuuaauaaaggaaaacugcacuuugaguuauaucaguucacuuucugacuuguaaccucucccuacaucaacuuucucaucucaacagcagggauaacuaaggacuacuaucuaguccuuagaacuguuugcaaacuuuaaaguguguagaaauguaggauguuacuacuguagagauauuagugacgucugguccuuuuaccuguggcucuugcaucuugagaccaucacuuaguuccuacauggguuuuaggggaaaagauuucacugauggaaaagcaggggaaaucugucugagaaaaauggaagaccuagguuucaccugugagacuauaggaauuuaaacagauuaguuuagaauuucacgaaaggauaaaauugcaugcaguaaaugcagaauguuuguguuaaaauacaaauaccuguguaauguaacaccgauacauuuaauuuaguguucccaaaacgggucuguggcaagagccacaaggaaaggaaaguauagaguaaaggaaaguauagaguugccuggauuuccauguacuuuggcuguggcuacugaagugucucauuuuuaacacuuuuuuguugcugcuauugcuauuugagauauucccgucuagagcaguggcuuacccucaguagucauuuaaauauuuugaguuaguaaaugaaauucaacagacuaccaguucaguuucuuguuucuucaaaauauuauuuuuuauuuuuucaaucaucuucuuuaaaucacgguaaaccuauaaagggcauccaacauuuuuacauugguuuuuaaucucuaaaaugauaaggacucaucuauuugacccuucagaauaacugagcaagaaucccuuguguauuuugucuaggcuauauuacuguauuuguuaacuagacaaauauguuuaucagcagcuaauucuguaugucuuacuguuucaaauuuuaucuuuaaagcaauuucccuuaaugccuagcuuagugcuaaauacauuguaggugcucaggaaauauuaauuaaauaaagaaauugcaaacuagugacaucauuuggucuuuuuacugcuuuguguaauggguuuuuuagaggugagcuuuaaggagcuauuuuuauuauaaaaguaaugcaggccagguacgguggcucaugccuguaauuccagcacuuugggaggcugagacaggcggaucacgaagucaagagaucgagaccauccuggccaacauggugauaccccgucucuacuaaaaauacaaaaaauuagcugggcaugaugaugugccccuguauucccugcuacucgggagguugaggcaggaggaucgcuugaaccugggaggcggagguugcagugagccaagaucgcaccacugcacuccagccuggcgacagagcgagacucugucucaaaaaaaaaaaaaguauugcaaaguaggccgggcauaguggcucaccccuauaaugccagcaccugggaggcugaggugagcagaucacuggagcccaagaguuugagaccagcguggccaacauggcaaaaccccaacucuauuaaaaaugcaaaaauuagcugggcaugguggcaugccuguuagucccagcuccucgggaggcugaggugggaagaaugcuugagcccgggaaguggagguugcagugagcugugaucacaccacugcacuccagccucagugacagagcaagaccacgucucagaaaaagaaauacaaagucugaucauucuccaucuuuacuaaggagagguauccuaauguacuaacgauugauuuuuuucuucacucauuucagaugucuucuuaaagaaugagcuauaguauuguugaauguauguacugaaauauuuuaugguaaauauaauuuagaugaguccuuaaaguuauguccuccauauuuaaacauucuguuguauucuaacaguguuaccucaauacacauucuuuuuuuuuuuuuguuuuguuuuguuuuuguuuugagacggagucucgccgucgcccaggcuggagugcaguggcgcgaucucggcucacugcaggcuccgcccccugggguucgugccauucuccugccucagccuccugaguagcugggacuacaggcgcccgccaccucucccggcuaauuuuuuuuuuuuuguguguguguauuuuuaguacagacgggguuucaccguguuagccaggaugaucucgaucuccugaccucgugauccgcccgccucggccucccaaagugcugggauuacaggcgugagccaccgcgcccggccguccucaauacacauucuuauccauaguagucaucauucuucaugaugaaggauugaggguguguaugcuuguagagaagccugguuauggauauucucacaguaucuuauaucuaguagguacucaguaacuacuggaugaauaguuuaaugcaugcaaaccugccuaccacagaauggaguuuguucugaagagcagaacuuuaacacagaaacuacuguguaagagaauccauuagauuaagggucgaaacacaacagguuuaaauucuaacugugcucuuaauuuagcuuuguaauucuggauaagccauccaucauaccuuucugaguuuuaguuucuucaaauauaaaaugaaggaacugggcaagaauaaucaggaucucuaagguuuuuuuccucuuauaaaaugcuacauuggcugggcgcaguggcucaugccuguaaucccagcacuuugggaggcugaggcaggcggaucaccugaggucaggaguucaagaccagccuggccaacauggugaaaccccuucucuacuaaaaaaaauacaaaaauuagcugggugugauagcaggcaccuguaaucucagcuacuuaggaggcugaggcaggcagaaucgcuugacccaggaggcagagguuacugugagccgacaucgugccacuguacucuagcuuggaugacagagugagacuccaucucaaaaaaaaaaaaaaagaauuaugagaacaaaguauguuuuuaaaaacugaauaaaaguauaaaagugaguuucuuaaaaaauugcauuagauguaggugaaacaauggaaaaagaugacaggguccugaaaauuuaggagaauucugaacucagagugcuuugcagguuucugaguacuuucaacacuguaaagaaauugaaacugguuuuuuuuuuuuuuuuuuuuuuuuagacagaaucucacucuguugcccaggcuggaaugcaguggugcagucuuggcucacgcagccucugccuccuagguucaagggacucucaugccucacccucccgaguagcuaggacuacagguguaugccacaaugcccagcuaauuuuuguauuuuucuacuaaaaaguagagaugggguuuuaccauguuguccaagcucgucuugaacuccuagccucaagugaucuacccaccucagccucccaaagugcugggauuacaggcgugagccaccacacccggccgaaacugaaaauuauagacagugcaguaaugacaaauccagccagcagacccguacucaaagaaaaugcccauaagaaauagcuaaugaauauucuucauaugcuucuuguuaaaaaaauuaucuccuuuuaugauucucuacucgaaaaaaaucaaccacuuucauuaguagaccaaggucucaucagguaaggaaggcuuuuacuguucuaugauuuucauuacauuguaggccuuuuuaaaaaauaacauagugauugccaggugcggugacucccuccuguaaucccagcacuuugggaggccgaggugggcagaucaugaggucaggagaucgagaccauccuggcuaacaugaugaaacccugucucuacuaaauauacagaaaauuagccgggugugguggcgggcaccuguagucccagcuacucgggaggcugaggcaggagaaugacgugaaccugggaggcagagcuugcagugagccaagauugcuccacugcacuccagccugggugacagagcgagacuccaucucaaaaaaaaaaaaaagugauaaucauccuauugcaggucauaaugguuccuuuaaucuauaugaguaugaguucccuuugccugagagcuacauaaaacacaucuucuguauauuugauauuaaaacccaauccuuacugugcuuucuucacagaacauucagaagauucucggccuugccccuucacgagccgccaccaagcaggcagguggauuucuuggcccaccaccuccuucugggaaguucucuugaacucaagaacucuuuauuuucuaucauucuuucuagacacacacacaucagacuggcaacuguuuuguagcaagagccauagguagccuuacuacuugggccucuuucuaguuuugaauuauuucuaagccuuuuggguaugauuagagugaaaauggcagccagcaaacuugauagugcuuuugguccuagaugauuuuuaucaaauaaguggauugauuaguuaaguucagguaauguuuauguaaugaaaaacaaauagcauccuucuuguuucauuuacauaaguauuuucugugggaccgacucucaaggcacuguguaugcccugcaaguuggcugucuaugagcauuuagagauuuagaagaaaaauuuaguuuguuuaacccuuguaacuguuuguuuuguuguuguuuuuuuuucaagccaaauacaugacauaagaucaauaaagaggccaaauuuuuagcuguuuuauguacaaggagagaucuguuucauuuuguuuugccguauuucuagauauaaguuuuagcaugggccaggaaggacuaaaauaaaaguuuuuaagguacuguacuuuuugccauacuugacucauauacucaaaauacagaguugucuugguguaggaauuggaaagcaagaguggaaaggaacguaauaacucguuggaguuuaaaaaugagggucuuggcaaguaacacugaugucugaaaaaaaauuaaauauaaauaaauaaauaaaaaugaggguccucagcuguucucuucauauccuauuacagucucucagauucuugugggggcacucuuagaucucccuuggagacaagguuauaguuauauguuguuaaucucgcagagcuuccuuuuagucacaauagccuucauuuucugccaugccccuucauaagggagaaggauguuuguaccaugauccuccccgcauaaucuauggaauuaggaguccuguguggagucuuaucaauaaauaugcacauucaucaaaugucuacuuaaaugugaguauucuaccagugagaaaaaacacauaauuuucaagguaaucauuguuaaaccaacagcaaacuucuuucuuaucagcaccauaaaguccagaagacaguagaaaaguaucuucaaagugcugaggaaaauaaguaucaacuuagaauuuuauguacaauauuggaggcaaaauaaagacauguuuagacauacaaaacuaagagaguugaauuauuaaagguuauauuccaaggacaaaaaagaggaucugcccaaggugaagguauggcauacaagaaacaauggucaacagagaaauaaaauauauggaugaauauauggauaaauuugaguguuuuauggauuaucuaauuuaaggauuaucccaagacagcccuacaagguaauuacuguucuuaccuucauuuaacagaugaggaaacuggggcaggggagguuaguaacuugcucugcaucacagagcuauugaguggcagucaggauuugaauucaaccaguguaaagccuaauaguccaggcugucaagcucuauauuacagccuccucauggguauguggugauucucuucucaucccaucuccucaacuagagugugugagcucucuaaaguuggacuuugucuuuuuuuuuguucuccuuauuacaaaguagucaacguggguggaaacacagcaggagcucaauaaaagcagaugaaagggaacagaagucccuauucugagacuaguuuuaucagaaggaugucugauaauggaugguaaugacuuuuaauggucuuuucuccauaucauugaccacucuaagcaaaauaauaauucgaaugauaaugaagaaaaugaugcccaugauaacaauaaugacaaauaugaaauggcuaaaauaaaacaugaaaccauccucaaaauucugccaucaccuuuuuaaagugagaauauauagcacacucuaucacucauacccugaggcuuugaaguuggugcuuucuaaucagacuucuuauggaccagguuuucauauacaaauuauguuuccaugguaaggaauaaauaagagggagaaguuaaaaaggagagauuacaucuauucacccuauucauuaaaauuuuuuuaaauuuuuuuccaaauauguucugcuuauguauauucacucuauucuuaaaagcacaauaacaaagauauauuacagaggaaauaaaacuaucacaagaauuaaauucaaggaguuauuaagggcuacugcagccucacaauuaguuuuuuaaaauuucuuguccugaagaaauuucaagacuaguuauuuggaugacacucuagguccacagcaucaccagaucauuggagaugacauuucaagacaggccucugaacaucucucauaacacauaauuugguuauuuucccuauguaagauggauugucuccugucuagggaagaaaaacagccauuacuaauaucugcauuagucuacucagguugcaaucauaauaugcuaaaguaguaaacuuuuaaaaaugacaguaaaccugaguuuauuaacagguuacauucuaaaagcuaagcuaguuuggaaauuggaaagcaaauguguguagauauucauauguccuugaccagacugggccuuucucuucccagguaagucauucucuccaauggggccaguuacuuaaaauuacaucagacaauugauagagcuucuagaucccccuucuaaaacaaaagcauuuugccacaaacuaggauggaguagguuuuuuucagacuauuuauacuuauuuuauguauuucaauacugcccuuuaaguaaaaguacuauauacuuucucuuuuuuuagauuaauucugcuuaagucagucuuuuaauuuauucuaguuugaguuuuuaaaaaauuuuagaaugaaaaaucucaaaaauauacuauuauguauauacacuauuuuauauauauauauauauauauauagagagagagagagagagagagagagagagagagagagaaagagagaauaaagaacaccuagguaacccauccuccaccuucgacaauuaucagcuccuagcuaauuugugucaucuguaaccccaccugcuucugcccuuucuguauuauuuugaagcaaaucuuaucauuuaucuguaaauauuucaggacuuuaaaaaauauguguaaucugaauaccauuuuuacaccuaagaaaauggacaauuccuuaauauaauguguugucuauagaugucaaaaauuuuugcaguuuuuuggaaucaggaaccaaguaagguacugaauauugcaguuagcugauacacauccuaaauuucuucaauuguugugguccucaaacuagaguguaucagaaucacuagagccuuguuagaacacaaacugcugggccccaccccagagcuggugaucuguaagucugcuguggagucugggaauuugcaucucuaacaaauucccaggugaugcugaagcugcagguuugggguucacucaccuauugguucaucagcaucucucugcccucuuacaauauauuuguugaagaaguuguguuguuuaccuuguagaguuuuucuuaguuuggauuuuggugauagcaugcugguuuuuucauacuauugguugucucuguaaugcgagcagcuuuugaucuauuaauuaaugagauauuaaaagugaugguauucuaa

SEQ ID NO: 191162 - RNA, 4322 nt, Homo sapiens
agcggaagcgagaccguccauccagaggaaggcaaguuuuuggcucgggcggcugagaagaccgcgcggggcuggagacagguagcaguacgggggcggggcuucaugccggaugugauagucugcagucguuucgguuggcagccuggcgggugggagaugcggcggccaccugcugcaaagaaccgaagggaagguuagaaguacgaaggcaguuuggagcuggggcuaagcagcugucgcacggucagaucaugggcuccaccaagcacuggggcgaauggcuccugaacuugaagguggcuccagccggcgucuuugguguggccuuucuagccagagucgcccugguuuucuauggcgucuuccaggaccggacccugcacgugagguauacggacaucgacuaccaggucuucaccgacgccgcgcgcuucgucacggaggggcgcucgccuuaccugagagccacguaccguuacaccccgcugcuggguuggcuccucacucccaacaucuaccucagcgagcucuuuggaaaguuucucuucaucagcugcgaccuccucaccgcuuuccucuuauaccgccugcugcugcugaaggggcuggggcgccgccaggcuuguggcuacugugucuuuuggcuucuuaacccccugccuauggcaguauccagccgcgguaaugcggacucuauugucgccucccugguccugaugguccucuacuugauaaagaaaagacucgucgcgugugcagcuguauucuaugguuucgcggugcauaugaagauauauccagugacuuacauccuucccauaacccuccaccugcuuccagaucgcgacaaugacaaaagccuccgucaauuccgguacacuuuccaggcuuguuuguacgagcuccugaaaaggcuguguaaucgggcugugcugcuguuuguagcaguugcuggacucacguuuuuugcccugagcuuugguuuuuacuaugaguacggcugggaauuuuuggaacacaccuacuuuuaucaccugacuaggcgggauauccgucacaacuuuucuccguacuucuacaugcuguauuugacugcagagagcaaguggaguuuuucccugggaauugcugcauuccugccacagcucaucuugcuuucagcugugucuuucgccuauuacagagaccucguuuuuuguuguuuucuucauacguccauuuuugugacuuuuaacaaagucugcaccucccaguacuuucuuugguaccucugcuuacugccucuugugaugccacuagucagaaugccuuggaaaagagcuguaguucuccuaauguuaugguuuauagggcaggccauguggcuggcuccugccuauguucuagaguuucaaggaaagaacaccuuucuguuuauuugguuagcugguuuguucuuucuucuuaucaauuguuccauccugauucaaauuauuucccauuacaaagaagaaccccugacagagagaaucaaauaugacuaguguauguuccacacccucugcuacuguguuacauucugauugucuuguauggaccagaagagagcuuugggacauuuuuucugaacauucuaagcauucuagugaaaguucccauguuccaacagaacuuaaaagcaauguuugccuuauauauaaaagggacacaauaauugagguccaccuucuaggaaauccuaggacucguuuauuugggacauggugggaauaaaggucacauauuggaaaauggaaaggcugaugaaacuaucagauacuaaaacauucuuaaaauagaggaauauaguuagagacaucagguuuaagccaguauuuguuccuguuuuacaaugcuucugucuuaagcugugucuuaacuuuuaacacccaucuuuucuuucuaaagcuuuccugacagcugugaaaauccaaaaaauauucuuaaacuguguaugguggcccuugccuguagucucagcacuuugggaggcugaggugggagggucgcuugaguucaggaguucuagacccaccuggggcaagauggugagaccuagucucaaaaaaaaaaaaaaaaauuagccagguguuguggugcaccccuguagucauagcugcaugggaggcugaggugggagaauugcuugagcccagagcaagacccugucucaaaaaaaaaaaaaaaaaaaaaaaggaaaggacaacuuuuuagauagaaaaguauuaaauaauacuaagaugcuuaguaguauuauuuuagagaguuuuaaacuucuauauuaaauguggggucuuacaagauaauccaaagacuuugggaggccaaggcgggcagaucacgaggucaggagauugagaccauccuggcuaacacggugaaaccccucucuacuaaaaauacaaaaaauuagccgggcguggugggugccuguagucccagcuacuccucgggaggcugaggcaggagaauggcgugaacuccggagguggagccuguagugagccgagauggcaccacugcgcuccagccugggcgacagagcaagacuccauaucaaaaaaaaaaaaaaaaaaagauaauccaaagaauuuaaauuguaaucauguuucauguauuuguuuuauuacuuacuuuuauagcacuuagucccagugguauuagacugcuauuugguuucauacaaaaaggauuaaauuuaaauucauucauguuuagacuugaguuauuacauuuuuaaaacuaucaucuugccuuuaauguuugugguccuacacaaacuauuaguacauuucaguauccucuuaccccuuuguuuuuaaguuuuugauugcuaaagcaagacuuuuuucuucuagaauuuaagucaaccaaguguuaucuauguuguaaaaauggauaauaguagauuuuaggugauaaaacaacuuguuaguaagacauuuccuagcuuaaaaaaaaaaaucaaaaauuccaugauagaaaugcagaccugugagggaaacuccugaaaagcauaagaagcaucccagagagccauggguuuucuagaccagagaauuuagagggagauuguggaacugaggcuuagguggucagaucguuucccuuaucacuguaauauuucugggggaaaaaugcuuucugaguuguuuaaacaagcauccuuacauuuuuuuuuuuaauuaaacagccugucuaggcuugggauucccuaauacuacaguagcaguauaugaauaugauuuugugauuguguuuuuuaaaagauaaguaauuugaugaacuguucuuuugcagucagaaaacacucacaaaaagacaaaaaaaguuccacaguauuauauuucaugucaguucaggccuaaaauccuuugcaaauaagauguuuauaggcuggucacaauuaacaauguuauuauuggcagcacuucuuggauggauaccuuuugggaccuuucauuagaaagagggaaagaauggggugguuuuguaugggcuccuguuugggguaaaaauagcagagucaguugcugaggacaaugaccuuccuuauaacauuuaguuucauacccauauuaggucuugucuugaggacccuuuauaugugcuuguuuacuaguggccuuccagccauagcauucuuaccuuuuuuuccuauucuaagaauuaaaaaaaaaaauuauagagccagcaagggaggaggcaggaaacagaaaucgaauuucaucauuccaguauaguugucccuuuuuuuguauuucugacuugguuuuauaauuauauuuacuuacuaauuauuguuuuuuaacauucuuuauuguggcuuacucuucauacuuagaauugaaauuguuggacaucacauguauauucacauuauaaauacaucauucuuccacuguuagaccuuuagauugcuuccaguuuuuaauauucuaaauaagacuuucaacauuuucuguguuuuagcucauucucuuaggacauucuuagaaguuagaaacauuucugcugggaucguuggagggaacuucaaacuuuggaaucuuuccugcaagaaauucuuuaccaaagaaaggcagguguuucuuaaagggaugcaaaagauauuuugcacuuuguauguuccaaaacauuuaguaaguuaacuaaaaaaaugaguuaauuugguuucuugggggauuuuaauuuuuuaauuuguuuucugguuauguaaaaaaaauguuuuuuuuuugcuucuuaucacaauccuuuuguuuccuuuuuaauccuuuaauaacaccuucaaauuuuauaag

SEQ ID NO: 191163 - RNA, 244087 nt, Homo sapiens
agugggugggaagagcccccaagagcucugugcgggauucuaggcuccccugugacagccgcggcaggaagcaggcgggcgcuccccggccacaggccuguuguucucggaagggagaaagcuggacauuuccccacguaacucccagcucugggccuagagugcgugcauggcgaaguccccggagaacucuacccuggaggagauucuggggcaguaucaacggagucuccggggugaguugcuccaaaccucugucccuagccccgaggugcccagggccuagugggcgggagcagaccaggugcguuuccuaacaccuggguucugccccguccacgcuacagaggagcaagauggauguugcuguggucuugaggaggaugaaauaguuugauuuaguuuuuacaguuaagcaacgauguuuccucagauucccguaguuaccucaaucaacuccuugaucuuaacuuggcaucuuucucaaccggcgacagcagaaacucuuggauagcucuaugccauuuuuguucaguucccauacguugcuauuuaauccaauaaaagucugauucacaguuuuuacacauuuaaauuauggcacaguggauugaaugugauuuaugggaucaguggggggaaacacuaauaauuauuuuaaucacaagagcccccuuuuaauugauuuaggcuauuuacauacaguaaaucaucugcagcuuacaccaaucgugugaauauuuuacacauggggaaagcgaagcucagagagguugaauuacaggccagagcccacacagcugguuaguugcagagccagguauuaucaggcuugccuucaaagccuauguuuguauuuacuaaucaagccauaauuacuauuaucaaaaccuuauuaauuuagauuuucuuaccacauuaccauaugagcaaguaucuguacaaauaaugucuguauuuauuuuccuuuaagcucuguuggacuuaaugucuguacuuuuagauggcgcugucaacuuggacagcauauauaacaucuagaaauuucgauucuguuauaauggaaguuauggaauuguccauaggguuauuguggggagcaaaugaaauaauccccauaaagcagugauuuuaagacuucuuaaaauguuuaccuauaguaagaaauaaauuuuauaugggacauauguguacauauaaacuauaaguuucacugaagaauuuuuauucuacuaaauguaauaaacucugcuuucuauucuguugcauuuucauaagccucuaggucaugacuguuugcgacauugagaauacuaaguuaugaagcauguguuguucugcauaauaugccuacuaugugucagugccuccuacuauguguuaagcauacuaggugcuaggcaugcaguaaggaacaagacaaaguuccuauccccauggagcuucuggauuaguuggggagaaagacaaaaaaaaaaaauaauuauagauuacuaugauagaaaguaaggguaaagaucagugcuuacuagacaagcacucauuaaauguuaauuguuauuuauacuuguuacuuaaagcaaagugaagguuuuucaauauuagaaaguuuaucuucucaugacucuagauuuuauaaggguuacuauguauuguuacaucugucaauuguguuaacaaacugucgacauucucaguauucaaacugcaggaguaaaaaaaucgguuuuaaugaacaccuuccucaaccuacugauguuucaagagcuguuagauacaaaauaagcacuucuaacuuuucauuuggaagcaagaaaaauacugugcacaaugauaugaguaauuguaauuuuuaagauuggcaaaaauuuuuuguuuucauugaaaguuuuuccugaugcuucucuuccuuugaccuuauuuuaagucuuuauauaauugucggaggcuguuuaacauuaggcauuuugacgcaguaaagggguucauuuuaaauuaauguuauaguaauauguuuaauacuagugguacugcuuucaauaauuacagaaugaaggguuuucauuuaaggauaauacauuuuaaaauuaguuugaaauaaaauuuaaauuuagugugauaacaauauaagguaguggaaacauuucaccaagagcaaauacgaaggauagaaaaaguuaaacaacuuaaaaaaaaacguauucauaauuuuaacagugaaucaggaaauguaaccugaaauguuuauggguuuuucaggacauaucauuuauuuaguagcacuuuuauuuuuguauguuagcuuauauaacagcuucuggaaggaaacaaaacagaauuaacucugaacuuaaguacagucagaaguucuucacaaauauaaauugcuauuuuugaguaguauaauuuauuuauuuagagauggagucucacucugucauccaggcugaaaugcaguggugccaucucggcucacugcagccucugccuccuggauucaagcaacucuccagccucagccucccaaguagcugggauuacaggcacgcgccaccaugcccggcuaauuuuuguauuuuuaguagagacuggguuucgccauguuggucaggcugcucuagaacuccugaccuuaagugauccgcccacuucagccucccaaagucugggguuauaggcgugagccaccgcgcccggcugauaauucccuuuaaaguaaaguauucuguuccuuaauaaacaaugcuggaguuauguggaaauuccuuauuuugagugugccuaauaauuuaagaauuguauuacuauguaguaagauaaaaugcaguuuaaaguucuaugucuuauuuuguuuugguuuuguugguuuguuugguuuugucuacccaccauuacuuccccaaaugccuugcguaguuuaugauuaauggaagccuaauaaacagucuuggucuuuccucaccgguuuuuccucuagcuuguaaauaacugcacauguagucacuacuaauaucccuucauugauauucagccaggaaguggccgcauaaaaaugcaaaaugcuuucccuauuuuccgugaucguacuuccauuuuaaaaagaucuuuuccuggggccgggcgugguggcucacgccuguaaucccagcacuuugggaggcuggggcgggcggaucacgaggucaggagaugggagaccagccuggcuaacacggugaaaccccgucuguacuaaaaaaaaaaauacaaaaaacuagccgggcgugguggcgggcgccuguagucccagcuacucaggaggcugaggcaggagaauggcaugaacccaggagguggagcuugcagugagccgagaucgcgccacugcacuccagccugggcgacagagcgagacucugucucaaaaaacaacaaaaacaaaaacaaaaacaaauuuccuuauuucuuuaauguugguacuauuaugguauaucaaaauuugaaguucuaaugugaaaacugagucagcauuuacuuucuuguuuuuaaaaugagguugggcgcgguggcucacgccuguaaucccagcacuuugggaggccgaggcgggcagaucaccugacgucuggaguucgagaacagccugagcaauauggagaaacccugucucuacuaaaaauacaaaaugagccaggcgugguggcaggcgcguguaaccccagcuacucgggaggcugaggcaggagaauugcuugagccugggaggcgcagguugcggugggcggagguugcagugugcugagaucgcgccacugcacuccagccuggguaacaagagugaaauccuaucuccaaaacaaacaaacaaaaaaagauauuuuccucauuucuuuaauuuugguacuauuaugguauaucaauaauuugaaguuguaaugugaaaacugagucagcguuuacuuucuugcuuuuaaaaugagauccuugccucauuuugaccuugaugaucuuggagcagcuccacauucaccuuucauccauucccuuacacuuuucaguggauuugcuguuugacuucucuaaagauaucucuugcuuugggucgccuaugcccuuuuacaagaaauuggagacauuuaaugauucuucuucaaaacgagaguucuggcagaaaaaccggaaggcuuuguugcccccacagaucuguuguauuauuccuacauaguaaauggucugaaaguuuccagugugguuaaaaguguauguguccuggguauccugggaaccacagaauuuaaucuagaacuggaagugauuugggaggucucuuggcaguaagguuagguguucauuuacucuauggguaguuauaauucaacaaccacagaauggccgagaacuacauuuguaagugggcaagauagcacaugcgccuucucuaaauucaauacaucguuguauaaagccaagagguaugaaaugaacuauuucauagccaagaaagggugaaaaaagccacaauuauaggcaauccaggcucuauuuuaaguacugcacacuugaguguaaggggauaucagaaaggagaaaaauugcuagaaaugcaguauuuuagccuuaauaacagaaucaugucucaucucuugcugcagcguugggaauagauaacaauuuuaucaacaacaccuguauacaugacucaccuauucaccucauuccuagccaccuuugguugggugaguauaaggaaaaaugaaacaaacuucuuguaugacaggaacucaugauuuucuauauacauuuugcauucugguuuuaccuuuuucugucaacauuuugguguuucagccuuuagaugaauuuaugggaagagugugguggggucagaggagagaauguggagcugggagccaggucacugcacuuacuuuugcuuugcugacaaccaucuggguaaccuuaggcaagugaaacacacuguucuuggauucccguuuccucaacuguaaaacgaaaaguuuggacuggaugugagaauuauugccuuuaggugccaagcaaaugaucaaaagguaugauggagucaguggaagacauuaagggaaaugaugaggcuuauggccaaauugggcaguuucugcuuuuucuaaaaacauuucaauuucuuccuugcucccucccucuuugcuuccuuuuuuuucuucucucuuuuucccucuuuuccucccucuuuucuuccaagaaggaagccaagcaaaacacacccagagccugauuccccuuuagacaccacucucugacccuuugaucauuaauguuccuuccaucagcacuuguuuggaccagaugaaugauuaagggcuauguuuuugucuuauggaaaugagaguaaggaguugaaccagguacacagaaagugagaggaugaauaugagaagaaaauauauaaucucagggaugggccuugucuuuacgaauugauguaguucaagaaaaccaaagauaagguugacuuucuauguuuugcuuguauaugauuagcacaucuauccaaauccugcaaaguggcucacaauuguagaagggcuguguuagucuuacuagccaacaauuuggucaguguauuagccagcagugauaucaucuggcugucuuaagaaaacauauguguaacucaaauaaguauuccuguuuucuuauaaaacuuguauuucuuuuuugcuuuucucaaauauuuucuggauuuuuaaauauuguuugccauaugcacuauauaggaauauacacacauaaacaugagggguuuuuugcugauaaaauucaaauuauacauauucaucuuuuguuuuauauauucauguggcuuuucuuuuucuuuuuuuuuuuuuuuuaaucucagcucacugcaacuuccaccucccagguuuaagcgauucuccugccucagccucccgaguagcuggguuacaggcacgugccaacacaccuggcuaauuuuguauuuuuaguagagacgggguuucuccauauuggucaggcuggucucaaacucccaaccucaggugaucugccugccuuggccucccaaagugcugggauuacaggcaugagccacggugcccgacuuuuuuuuuuucuuuugagacagggucuuauucuuuugcccaggcuggagugcagugaugugaucuuggcucacugcaacuucugccuccugaguucaagcgauucuccugccucagccucccgaguagcugugauuacaggugccaccaccacgcccggcuaauuuuuuuauuuuuaguagaggcaggguuucaccauguugcccaggcuggucucgaacuccuggccucaagugauccaccugccuuggccucccaaagugcugggauuacaggcaugagccauugugccuggccucauguggcucuucuuagugccuuuaacuuuuaugaucuuuuauuuuacuagaacuuaaaaguacaaucucaauuuuucuuuccuacuacugaugagauaaaauuggcaaaagacaggauuuagcaaccagaaaagaaaugaguguucuacaaguaaauagucaucccuggaauaaucuaaaucaaagguauguuucaguguuaggagauuguagggguacuuuuucauguucuuugucagaaauagguauagaguaaguuuuuuucaaacuauugagauacugagaguaauaauauucucuccugggauguuuaaagacuuauggucugaucacauugccaguuugugcuaagauuuucaccauuuuacuugaugauaacucuucucagaguccaaaaguagacaagguagcuagaaaugcccuugugcacuggcugaagcaauccugaugauggcggaacuucaucaaagcccacuggauacuuaaagggauggccuuagggcaaauauugcuuuuaggcccugaaacaaaauaaagcuaaauaugaaucugagcucuugcuucugauagauauaacaccuauuccugacaccuggaucagaugugucccaucauggcacugucggucucaggcuguguccuccccaccagcacuccuguggcagaauagcucacugucacgcucauuuuccaucaagaggcggcaacacuuacaauguaauguggucagagugauagcaagucuccccucaacacugaaaacucuuguuuuauugaucucguuuuauugacuugaaaacugucuuguuuuauugauuuuuuuuuauugucacaauuggggguggagaugagugcugcuggccucugguaggcagaagccagggaugcuauuaaacuggcacaacacagccccuuccaaaagagaauuaucagguccaaacugucaauagugcugagguugagaaaucacgaucuagaaguacaggcuuugcuuguagcccuugaucugcaagaauccuacuuuacaguaauuacaaguaaggauauacagauuguauuugcuggugauuuuaccuauguucuuugccagccuggcuagguuuacuucuuuuaucaguggaaagugacaggugcaucaguccucuccacugaugccaaagaaauaccagguguaucccuuagaaugcauauagccaaucuccuggauuugccaacacccacauaucuuuaauggucuuccagacauugcuuucuuaagauguuuacauucuuuaucagauuaucuuuuacuccuggcgccaaccacuuuagcauguuuucaguuauuagagucuuaggauaguauuuucuuugagauucaaacaaaaaaguauucuacauaguacuuguaaucucuuucacaauuguaauugccuuucacaaagccgacauugucugauuuuuugauucugcuguuuauaucuugguaguguuaccuguugguccccuaguaaacagugacagcaaucuucugaaccaggcugaggcccagucaaguguagauagacauguauuucuuaucucacugugguuuuauuuuucugcaugucugcccuaaucaaagcuugugcugggagcugcagugcaucucauaucucggccucgggaggaaugguucauugcauauucucucagagacagcugggcgcuucgcagggaguggucccccucccugucaccagggcaauucucuuucacaucucccaggacagauggagaaugaagaaauuaauaauucauaguguguauuuaaguggugauucuuccuagacugagacauacuugcauuuuguucaaaaacaucuugaugaagacaggcccaguggugaccuaagaguuagaacauaggaaguagggaaacucuuacuaagaaaauggacaauacaggccaggcaggguggcucacgccuguaaucccagcacuuugggaggcugaggcggaaggaucaccugaggucgaggguuugagaccagccugaccaacauggagaaacccugucucuaccaaaaauacaaaauuacccaggugugguggugcaugccuguaaucccagcuacucaggaggcugaggcaggagaauugcuugaaccugggaggcggagguugcagugagccgagauugcaccauugcacuccagccugggcaaccagagcgaaaacuccaucucaaaaaaaaaagaagaaagaaaauggacaagacagacugaaauuagcuagcagccauuagcucagguaccuuuuaagugcucauuguacugauugauguuuggauagugcauuagcagaaauauuaucuacuugcacuuacguucaugugaucuguaggacucagggguccuguuugugucuguagucauaguuaaguuuauagucaguuccugguuggugcuggggaaaagaaaucaggaugcauucauugugaaauacccuuacuguccucucaggagagaagaggaaaugaguguguucucucucuugguuagaaacagauaaagcugugucccauuagcaguuggauaggaaacgguaacuggaaccuucugucuaaucugguuuccuuaaauguaaggagcagauaacugcaucuggggaguagugcucuuaauaaggauuaugggggcuucaguugcaauggcuccaguugaagagccaugggauuucaucuguccugaaucaucugaguguuauucuucuucacauuaacuguguuuaucuguuauaguauauaauuaugcugguuuguuauguauuugaaaagcacuuagcauguuuugaaauguagcguugaaaugacuuuaaaaugucaacucuguaguuuuaguuuuagggcacaguucuugcaaauuccugcuuuuccucucugacccuaguaacucugaaaucaguaguugcaaacaaacaaacccuaaagccuugugugucacuuuucuuugggauaguuguugaauucaauagcucauuauuucacguaauauuauguucauagugcaauuuaacauguagucuuugaauguuauaaauucuaaaagauuaaacaagaacauuagaaaaggaaugaaaagugcucuuaaaauccugcccuaggccgggcaugguggcucacuccuguaaucccagcacuuugggaggccaagguggguggaucaccugagguuaggaguuugagaccagccuggccaacacggugaaaccccaucucuacuaaaaauacaaaaauuaggugggugugguggcgcaugccuguaaucccagcuacucgggaggcugaggcaggaaaaaugcuugaaccugggaggcggagguugcagugagccaagaucgcaccauugcacuccagccuggggacaacagggagacuucgucuccaaaaaaaaaaaaaacuccugccuuucuuguaaucugaugaaagaacucugccuacagaggcuuuuaacuaugcaaauucuuuccauauuuuuuuucuuuuuccuaauauaguuuauuagcuuuuacucagacuagguauaaauaaauaauuaucccuugccuuagaggugaagucauuugaaagcuccauggaauacauuucuucuuuaaaaacgcaacaaaaauuuuuuauuguaaauugacaauuuauaauuguauaaauuuauggguuacaaagugaugucauaaauuguggauacaauguggaauaauuaaauaaagcuaguuaacauauccaauacuuccaauacauuucugugaugagaacaucaauuuugaaauguguaauacuccauuauuaaguauaugcaccacacuguacaauagaacucaaaaaaaguauaaaacauauucuuccugucugagauuuuguacccuuugaccaucacugaauuuuuuuuucuuuuucuuuuuuuuuuuuuaugagacagucucacucugucacccagccuggaaugcaguggugugaucucggcucacugcaaccuccgccccccggcuucaagcaacucuguugccucagccuccccagcagccaggaccacaggcacacaacaccacaaccugccaaccuuuuuuguauuuuuaguacagaugggguuuugucacguuguucaggcuggucuugaacucuugaccucaggugauccacccaccuuagccucccaaagucccaggaccacagacaugagccacugugccuggacuaaaauuuuuaugagacaaaauaucaauuucaaaacagcaucaaaaagugaguaggccaggcacgguggcucaugccugcaaucccagcacuuugggaggccgagguguauuuuucuguacuaaaaauacaaaaguauuugucucuauuauaaauacaaaaaaaaaaaaagaaauuagcugggcacuguggcacaugccugcaaucccagccacucaggaggcugaggaaggagaaccaucugaacccuggaggcagagccacagugagcugagacugcacuacuugcacuccagccugggcaacaagagugcaacuucgucucaaaaaaaaaaaaaaaaaaaugcugggcgcgguggcucacgcuuguaaccccagcacuuugggaggccgaggcaggcggaucacaaagucaggagaucgagaccauccucgcuaacacggugaaacccugucuguacuaaaaguacaaaaauuagcugcgcgugguggcguguaacuguagucccaguuucucgggaggcugaggcaggagaauggcgugaaccugagaggcggagguuguagugagugaagaucgcaccacuacacugcagccugggcgacagagcgagacuccgucuuaaaaaaaaaaaaaagaaauauacaugauaggaauuccaggaaucuuauggauucuucuuuuaaggucccggucacugggcgugguggcuuacgccuguaaucccaagacuuuuggaggcugagacgggcggauuucaccugaggucgggaguuugagaccagccugaccaacguggagaaaccccgucucuacuaaaaaaaaauacagaauuagccgggcguggugacagguaccuguaaucccagcuauuggggaggcugaggcaggagaaucgcuugaacccgagaggcggagggugcggugagccgagauugcgccaucgcacuccagccugggcgacaagagccaaacucccucucaagaaaaaaaaaaaaaaagucccggucaacugugggcacaauguaacacuuacacacacuuaggcugaguuacucucuguacuaagcagucaugugcauagguuccuguguguguacaugguaauuguucaaaucuuggauccuuggcgauccuuagagccacucaauacuucugccccaauuucucaauuucagccauuacacaaucaguuauacaagggauacacuugacaugcagacagcccaucauugacugcacuaaguccaguuuggcuuuuauggaaaaguugauaaaguugguaucaacgaggaugugguaaggugggcccagcuguguauuauauuggcaaaauaaucaggaaagguguugcggaacuucucuuuccuuuaacgcgcugggauccuucuuuucuuucucuuuagguuuuaaucuauccuuuucuuuaagccucugaucucugagacuaagcguuugcuucaugguuguauaguuccucauuuucuuuugcuuccucauggucacaccacacuccuguuucuuccguaaucaccaacggugcaaugcuuuuaccuggaauacauuuuuauguuagucaaacugucucguuccuuucuaauagauucaauaaagauaaguguuuuauucguggauuuaagggcauaaaucuaaagcuccaugaacugaauugcuuaucauguaacacuuugauuuuccuuuuccaugaccaaaucgcuuuucuauucuauuuucuaauacuaaguuauuguaaaacuaucacaguuucauauauucccaaaaccaggaaugcgucuuaucugaacuuccuuaaacucaugaugagucagaggaggccaguuuucauuaguaaucagcgccaaauucauuucaaagaaagaucuguguggacauaggauugguauggagaaaaauauggugauaaauuaacugugucucuuguauaguugaguaauagaauuucauugucgaacccugaccugaaauacauguuuucuuuuaucaaaguagaaaaugaguugcugcaaguaaagaaacuguauuagauauuguauaacagagacuuuuuuuuucuauuaaguacuaacauugcuuuuguuucuguuccaaacuuugaaaucagugcacuuggacaaaauggaaacugcuuuucaagguccuacagaauauauguuuauaaauguauuuuuauacaugguugguaaugaaucaggucucuuucgugccauugcaguuagagggccucuggugcuggaguccucuggaggacugggcugucagaguggggcagcggggugcagcgcggggagggcuuuucucuuucuucgugccucuggugcuggaguccucuggaggacugggcugucagaguggggcagcggggugcagugcggggagggcuuuucucuuucuucauggggucucagggccucucucuuccucuccacguaugcucuucacaggucucuccagcaggguagucagauaucuuacauagcggcuuagggcucccaaaagcaaacauuccaagaggaagcagaagcugccaguccuuuuaaagaugaggcuugggugugacaugguauaacuuuuauugcauucuauugguuaaugcagauuacaggcccagucaguuucagauuagaagagaacaagggaaugaggcuggguuccuuggaggcuauuuuuuuuuuuuuuuuuuucugaaacagucucgcucucuugccaggcuggagugcaguggugcgaucucggcucgcugcaaccccuuggaggcuauuuuuagagaugaacuaucacaguaauauaccuuaaaauacuucauuuuagacaguuuuuguguguucuagggguggucaguugcacuaaccaagaaucuaugaggugugguuggccagcaguauauagaaagagcuguaccgccggggcugccacuauaagcacuucagcuaugcaaauuuugaucaaaacuaggccagacauguggaugucucuuggugggggagggauuuccuguccccagggacaaugaggcuucccuagguuggaacugggugugacgcagucccuuuugcuggcucuucccaccuccccacugcuccuuucgucccccucugucuccaaguugguaaaggagucaggcauggugggaaggagagcacuucccuuagcaaguuauuguuuaaugggagcuggugggaagaguucugucauuuaauccuugccgguggugcuauauguagugaaaucaacugcuacagugguaggggccuuagagaucaucaaguccuaccucuaaaccaugaaguuaaucuucucucaccaucuuuggcacaucccucagcaagcuagaaacagaacucugcguuuuuuccauaaaguacgagaaauaaugauuucaccuuuaaaaacugccuuccugaguaaguguccguuuggucaaccagacuccauggguccuaacuuucgucagguuguucuugcagaacaugccagcagaagcauucaccaacugacaugugcccugaaagaaggcgaugucacuauuggagaagaugcaccaaaucuuucuuuuagcaccagugugggaaaugaggacgccaggacagccuggcccgaauuacaacagagccaugcuggugagugugaaugucaauccuagucugaaugaugcauagugaauuuuuuaaacuccguagaauaauaacuccauucauucuucauucugcugcuaugauguuauuccucaaacacaaaucagauaauuuaauucccucgcuuaaucuuguuuuccuuugacuucccaaugcuuauaggcuaaaguccaaaauucuuaguuauaaaauaacaguguuuuccuaagauagcucuaaccugccucuucggcucaucuuuguguacuucucaugcuaaucauccaucucacaacucauauucuaguuauaauaaccuccucucuaugcuuuuaugcuuugacaugugcagugacuucuaacuggaauuuuucuuauccuuuucugcuuggugaacuccuuccuguuuauccuugcaguguuaucuccucugugaaaacaagcacaauuagcuucuuccucuucuuguagcacugugcauagcuuuaggucuacauacaaacuuauuuuauaucuauuagugucucucucuuccuugcuagauucuuagcucuuaagggguagaaauucuuuuuuuuuuuuuauguuggucuuguauccccaguugauagcagaauucuugaugcauaauauaucagcaauuuuuauuaguuggaaggauggaugggugguaagaaaccauggaucucaaauaagguuaauaaacccucugcuuuugcucuauaguuaaucagcucaaagauuuguugcgccaacaagcagauaaggaaagugaaguaucuccgucaagaagaagaaaaaugucccccuugguaaguaucaacuuuuccaaguugacaaagcauuccuguguuuuacuguauuguguuauuuuguaguacauguugcagaaaaaauuuaagcauggcauacuaauagugaaaaacauuaaaaguaauucucuucccucugauuauuuuggcugaaaaaauagauuuccauggcagagggaaucuugauuuuuuaaauuuauuauucacuuggaaaaugggagcaagggaauaguuuggagaauuuauuuugcaacuguuagcaaaauauguaauauaaauauauaauauauaauaaauuaauauaauaaauuauaugucagaauauauguaaaagauaaagucauuauuuuaguaauuucuuuuuuagagggucauaucuauuauugaucauuuuuagaaguuacuuaauuauaauuguagcccuacuuuguaauauuuuuuaaauuuugagugucaaaauaauacauuuuauuuuuaauuaauuaauuaauuuuuuugagacagagucucauucuguugcucaggcuagagugcaguggcaugaucucgccucacuacaaccucugccucccugguucaagcgauucuccugccucagccucccuaguauuuggguuuacagaugugcacuaccacaccaggcuaauuuuuuguauuuuuaguagagaugggguuucaccauauuggcuaggcuggucucgaacucugaaccucaggaaauccaucagccucggccucccaaagcaccgggauuauaggugugagccaccgcgccuggccucaaaauaauacguuuuaauauguaauguucuauauguuaaaauauaugguuauaaaauaguaugauauauaagaaguggugcuguauuucuucugaaguuguuuguuauugcuuugacagaguguauuauuucugauuaaagcauuuuauaugcuaaaggcugagauagaugugagugaaagcacucuggaccagauuuaaguggacaaaauaauagucaagggcuuaguucuaucuagggucuaucacauacucucuaagauauugugccugucucacagaguuuuuggaauaaugagauaagauuacauacuuaaaauucuuuagaaaccuaugaaguguuacauaaacauaacaugcauagcagcaaguaaccaccucacauuuucaauguguuuucuaguucaauacaaugccuguaugcugaaaaguguggagacaugucacuuucuuuucuucaccacugaaauaucagaguaucacucccauacgaacacuccauuccaggcugacacauacuuuuaagcuuaauuccuacuuuagagaaauguacuucauaugcauauucuaaauuuauagauacagauuuuauaauuuuaguaaaacaucucaucauuuaaugaauuuauuacuauugacaucugguuucuagcuugcucuuaagcacagacugguggaaugcuuuuaaaucuacuagaugaaguugcuuuaucuguugaaugcucagacaugcuuauuugccuuuuaaagucugagcagugauauuauggagcuuacugaauccagacaggcaggaagaccuucacuaagagaaucaguuuaguacauacagagugcacuuuaaaauacacaagucuauuuauauggagcuauguaaaagaauggaacuuagacucuauauguauacagccuacauguaauaauuauaaaccauaauaguaauaauuagcuuuuuaagauuauaccuuuagaaugcacuuucauagccaguauaacauauuagaaauacaugcauauauugagaguaaaacugaggcacuguugagauggaaaaaaaguuauuacuuauugucuuaaaauguagauaucuaaacuaaagcccuucaaaguagacacaaaugauuucaugugaacauuuuucauacaauauuggcuugagcuuuuuauuuuucacauugacuuccuccuguauacucauaguaguaauuuauauuugccuaucuucugaaccuauugcuauuaauggaggaugauuauaauuguuugauuucuacucaggacagauaauucauuuaauuagaguuacuuugguuuuuaaauuucuuaaauauaccaaaaaaccaaagcucuauuuuauuuuauucugccaugauagcugguacuugauuaucauuuaaaaugucugcugugcugagaaagagaguggcugagaaacagacacugugccucauuucaagcuuuccucuggcuuuguuuaacugguugacccuuguuuuaccuuuuccugauuuccucauccuuuaaaaaaaaaauuaugugauggguauaugauuuuacaaacuauuuuaggauaagguaagcuauacauuaacagucaguuccaggaaugcuacagagcuaaaauagcauuagcguuuuuuugaaaucucuucguuggaccccucaaugcagugugucucuacuuuaggguucuacucuuggagguucuaugcuccagaacaccauacacuugaauugccuucaauacuagagccaaaaaucaaaaacuacauuuugcuaauguaucuuuuuugagauggaauuucaucgcauugacacuggcuuggcaucaaacgcuuccuaaagaaucucuccuucacggagcugcugcaguuuuagcuagcaaauccucuuccauggcaguuucuuggagagaguugucccuuguaucucagcauuacugaauggaauguuguuuuuccaauuuguuaaaauaguuuauuccaagccaguuauacuacugcuaccccagcauuuuuccauucacuauaugugcuuuuuauaaccacuuucaccauccaucuuuaaaaaaaaugauauucacauccaugaaucuuguguauuuguggaauuuauaggauagagaagcaaguauuuguauuaguccauucucguguugcuaaaaauaaauaccugaggcuggguaauuuauuuaaaaaagagguuuaaucagcucaugguucugcaggcuguauaggaagugugauacuggcaucucacucuggugagggccucaggaaacuuucagucaugguggaaggugaaaggggagcaggcauuucauguggugagagccagagcaagaagugggagaggugucacauucuuuuaaacaaccaaaucucaccaaaacucagagcaagaacucauuaucaugaggauagcaccaagauucauucaucaugaccgaaacaccucccaccaggccccaccuccaaugcugggggccacauuucaacuugagguuugugggggacaagcauccaaacuauaucaagacuauaagcuacauugugaucgauucuauguuuauaucacaucagugcaaaauugaguauggagaagguaacaacugauucuuugcuaaauccaaacaugcuuaauuuggcuuuuuaaaauuuauguauuuauguauuuauuuauuuauuuuuugucauagaggucauuagaacaugaggaaaccaauaugccuacuaugcacgaccuuguucauacuauuaaugaccagucucaauauauucaucauuuagaggcagaaguuaaguucugcaagguaaguuucucauuaagaauuuaaaacuaaauaaaugaaagcuuauauuaacuauagauuguauuaaaauuugcugcuauaaaucuucauguuuguagcaauacauugacaauugcuauucuuacgugauugagagacugaugugucacaagagcuugucagacuugggaaugaugcucuugaccauaccauuucugauugcuugauuucccaguaguucauuacuaugucuaaugauuucauaauaugcuuucauauuucagaaguuuuccuucucaccccgcuugcuguagcccagcaaauggcaaaugcuuuggaauacaaauaccaaucauucucccauacuugucaaccuacuggagcagugguacagcaaucagggauucuaaacugguagaccaauucuucuccgcugucaguauuaaggcucuuacuuugacuuugaaugagaaugguucauaggguacugacaguaaugaucaagaaaccaaacacaucauauauagcuuaugacacuagaagguuauaugcucaacugcgugcaguuugcuaaugucauuaaugcuaauagagccuuuucaucuucccgaaguaugucguguuuuacuuuuuuuuuucuguuucuuucucucuuucuuucuuucccucccucuuucuuucuuucuaguaucaguguauucgauuguaugauauuuuuauaggaaucacugauaucucuuguaucauguuuuuauauauaguauaugauauuauguauuauauuguugacauuuuaagaugcaaggccaguauguaacuuaaggaggcuuuagauguuucacuguccugauuuuaccggggaguuucugaucuuaacauguaauuuccuguuuguucuuggaggacacaguuauuaauauacacgugguccuggauuaccaguaaagcugaaauaauauccuaggaacuauuucauuaacaauacucuauuaaucccuaagauguuguggauaaaacuugaaagauauaaagcagaauaaauuuacuaucuaguugagaagacagaacuauucccuauuaacaccauaaggagcacauuagagaacauaguauaggccuuuacuuuuugguauaagcuauaauuauaauaagagaagaagguuaggaaaagcuacugucuuugggaauguuucuaugggagagagagaucuugaaccaauguuuuuuuuuuuuuuuuuuuuuuuuuuuugauggagucucgcauugucgccagacuggagugcggugucacagucuccgcucacugcaaccuccgacucccugguucaagcuauucuccugccucagccuccccaguagcugggauuacaggccugcgccaccacgcccagcuaauuuuuguauuuuuuguagagacgggguuucaccauguuggccagcauggucucgaucucuugaccucgugauccguccgccuuggucucccaaagugcuggaauuaccgguaugagccacgaugcccggccuaaaccagucuuaaaggaauaggaucauuuagaucagcagaagggagaugaguuucauaaagagaauggcaacagugaaacacaguauucaggaugaauaugguuugugggggccauaagccaucuacuuuaucuuccugcaguggagaaugucucauagaaauaaugaaaguaauccugaacugguaaaauggaagauuacggaagccuugacugucagacagaguguaaauuugauacauuuuaguaagagaagaauagaauuaaaauaauguuuaagugguuuagaaagauuuuguuuauuuaguuaauggacuuuauuuuuuagaucaguuuuagguuuauagaaagguugaauggcaaacacauagaguccuguauccuccuuucagugacaucccucaccuaauaguuucccuuguuauuaacaucuugcaucaguguggcacauuuguuacaacugaugaaccacuauuguuaaauuauuauuaucuaagucucucaguuugcauuagcuuuguguuauacauucuacgaauuugacaaguguauaaugacauauauccaccauuacaguaucauauagaauaguuucacugucugaaacauccucuugcgcuucacuuauucaucccucuuccccuccgccccuucccucccauccccuggcaaccauugaucuuuuuacucucuccauaguuuugacuugcagaaugucauauacuuggaauuauucuguauauagccuuuucugacuggccuauuauacuuaguaauaugaauucaaguuuccuccuugucuuuucauaacuugauagcucauuucuuuuuauuauuaaguaguauucaauuagaugaauauaccauagcuuuuuuaucugugcaccuaugggagggcaucuuuguugcuuccaaguuuuggcaauugcgaauaaagcuacuguaagcauuugugugucaguuuuuguguggacaucuguuuuuaccucuuuaaaguaaauaccaagaagcucaauuucugcaucauaugguaagacuaauuuuaacuuugcaagaaauugccuaacuuuucuaaagugguuguaccguuaugcauuaugcaguaaaugagaguuccuaauacuccauauccucauuagcauuugguguugucaguguuuuagauuuuagcuguucuaauagauguguaguggaaccucauugcuguuuuaauuucaauucccugaucacaaaugaugcugagcaucuuuuccuaugccuauauuccaccuauguaacaucuuugagugaggugucuguucaggucguucacccauuuuuaaaaucagguuauucguuuucuuaguguugaguuucaacaauucuuucuguauuuuggaugccaguccuuuaucagauaugucuuuuucaaguauuuucucccagucuuugacuuggcauuuacuucucuuaacaguaucuuucaaugagcagaaauuuuuaauuuuaaugaaguuuaacuuaccaauuuuuuucuuucauagauuguacuuuuaacuuuguguuuaaaaauuuauuaccaaauccagguucacuauauuuucuccuuucuucuucuaguauuuuauaauuguuuauuuuacauuuagaucauguuugaaggauaguuguccauauuuuugggucuauuucugggcuuuccuguuccauugauuaacuugucaauucuuuggccacuaucacucuaucuugauuacuguagcuuuacauuaagucuugaaguuggguaauaucaguacucuaauuuuguucuuuuucaauauugugaugaguauucugggacuuuugcaucucccuguaaacuuuagaaucaguuugucgauauccacaaaauaggauuuggauuggaauuguguuggaucuauugaucaaguugggaauaacuggcauuuugauacuauugaguaucccuauccaugaacauggaauaucucuauuuacuuagaucuucuuugauuucuuuaaucaguguugugguuuuccucaaauagaucuucuacaaauuuugugagauuuauaccuauuucauuuuauuuuugagguggagucucgcucugucacccaggcuggagugcaauguugcagucuuagcucacuacauccuccgccucccggguucaaacaauucuucugccucagccucccgaauagcugggacuacaggugugugccaccacaccuggcuaauuuuuguauuuuuaauagagaugggguuucacuauguuggccaggcugcucucgaacuccugaacucgugauccacccgccucggucucccaaagugcugggauuacaggcaugagccacugugcccagccaccuauuuuauuuuuuaguguaaugguauuauguauuuaauuucaaauuccaauuauuuauugcuaauauagaagaaaacaauugacuuuguauauugaccuuguauucugcaaccuugguauaagucacuuauuaguuccagcauuuuuuguugauucuuugggauuuuccucauugacaagcauauugucugcaaacgaaagacaguguuauuuucuccuuuccaauauauuuagauuuuguguuuuuuaaauuuuucauuuauuuuaauuaauuuucuugaggaagggucuugcuggagugcacaggcuggagugcaguggcauaaucauggcucacuguagccuugacauccugggcgcaagugauccuccuaccacagccucccuaguagcugggaccacaggugcacaccaccaugcuuggcuauuuuauuauuauuauuauuauuuguagaauugaggucucaucauguugcccaggcuggucuugaacuccugggcucaaacaguccuccugccugggcuucccaagguguugagauuacaggcuuuagcaaaugugcccagccagauuuuauuuuuuuaauugucuuauugcauuagcuaagacuuuuuggaaugauguugaaugguugugagaggggccaucuuugccuuguuccugaucuuagugggaaacuacuuuccuaccauaaaguauauuagcuauagguuauuuguagauguucuuuaucaaguugagaauguuuccucuauuccuaguuacugagaguacagaugccucucgacuuaaaaugggauugcguccugauaaacucguuguaaguugaaaaugcauugaauauacuauagauuauugguuguuuaccucugugauugcauggcuaacugggagcuacagcucacugccacugcugcugcccagcaucaugagagaauauuauacuacauauugcuagcuugagaaaauaacaaaauuugaaacuugaauuaugguuucuacugaaugcauauugcuuuugcagcauaauaacgucaaaaaaaucauaagucaaaccaucacaagucagggaccaucuguguuuaucauagauggcugccgcauuuugucaaaagcuuuuccugccucuacuguuaaaauuaugauuuuucuucucaacauuguugauaugauggauuacauuaacugauccucaaaugucgaaccaauguuguguaauuagaauaaaucuuacuuuauccugguguauaauucuuuuuuacauuguuggauuugauuugcuaguauuuuauugaggauuuuuucaucuauguucauuagacauauugaucuguaauuuuccacucuuguaauguuuucacuugguucggguauuagguuaaugcuggccucauaaaaugaguuaggaaauacuuccucuugaauuuuaugaaauauauuauagauaauugguauaauuucuuucuuaaauauuugauagaauucacuagugaacuuaccugggccuggugcuuucuguuuugaaagguugcuaauuauugauuuaauuuucuugauaaauauagguuuauucagauuaucuauuccucccucugugaguuuucauggauugugucuuacaaagaauuggugcauuucaucuaggugacuaaauucaugaucauggaguuguucauaguauuucuuuguuauccuguuuuuuaaacauuucuuuauuauccuuuuaauguucaugggaucaguagugauagccccauuuucacuucugaucuuaguauaugauagaaucuaauugauauuuucucuuuuuuucuuaaccuguauauagucuuaucaauuuuauucaucuuuucaaagacccaacuuuugguuuuguuguuuuucucuguugauuuucuauuuuuaauuucauugauuuuuacucuaauuuuuauuauauguucuuuucugcuuacucuggaauuaauuugcuauugguuuugcaacuucuaaaguagaagcuuagauuauuuauuugaaaucuuucuucuuuucuaauuuuuuuacacuccuuuugcugcauccuuuuaauaaguauauagcuuuuuaucaguuguauuuuaauuuuuacuuaguugaaaauauuucuaaauggcucuugauacuucuuugauucaugugugucauuuagaagaguguugugucaucaucaaguauuuggggaguuucccagcuaucguucuguuauugauuucugguuuaauuccauuguugucugacagcauacuuuccuauucuuuuaaauuuguuaagguuuguacauuguagucugucuuggugaauguucugugugagccugaagaaaacguguguacugcuguucuuggaugaaguagucuauaaaugucaguuagauccaguugauugaugcuguuguucauuucaauugugcccuuugugauuuuuauaauuuuugacaggggauguugaaauuuccaacuguaauaguggauucauguguuuuccuuugccucauacauuuugauacacuuuuauuaggcacauauacauuaagacuuguaacgucuucuuggugaauggaccucuuuaucaucauguaauguaccucuuuaucucugaucauuuucauuggucugaagucugcuuugucuaaaauucauauugcuacuccaacuuucuauugauuaguguuaacaugauacaucuuucuucauuuauuuuaaaucuaucugugucuucguauuuauaauuggcuuuuuuuuuuguuuugagauuucuuuuuuuuuuuuuuugguuagagauggggucucacuauauugcucaggcuggucuugaacuccugggcucaagggauccucccaucucagccucccaaguaacugggauuacagauaugagccaccuugcccaguuauuauaggcuucuuguagacaacauauaguuuauuguucuuuuuuuuaaccauucugacagucucuaucuuuuaguugguauauucagaccauuauauuuaaagagauuauuguuaugauuggaucaauguauaacacauuuguuacuauuaucuucauugucuuuauuuuuuguuucuuuaaaaaaaauucacucuuuuucugccuucucuggcuuuuuuuuuuuuuuuuuuagagauagagucuugcccuguuaccuaggcagugacguaaucaaagcucacuacagccuagaacuccugggcucaagcaguccuccuaccgccucccugcugaguagcuaggacuacagacaugcaccacuaugccuggcuaauuuuuauguuuuuuuacagagauggggucucacuauguugcccaggcugguggcgaacuccuggccccaagugauccucccaccucagccuuccaaagugcugggcuuacgaggugugagccacugcaccugucccuuuuguggcuuugauugagcauuuuauaugauugcauuuuauuuuuuauuuuuggagacagagucucucucagucgcccaggcuguagugcagugacuccaucuuggcccacugcaaccucugccuccuggguucaaucaauucucaugccucagccuuccuaguagcuaggacuacaggugagccaccacaaccagcuaauuuuuguaugauugcauuuuuuuccaauucacauaucaauugaucaauuguacuucuuuuuuuuuuucuuugcugguagccguugauugaugcuguuguuauuugcaguaaauauuuauaacuaacuuaaguuuacuuucaaguaaaccuaugccacuucuugaauaguauaaauugcuuauaacagaauucccaagcccucucucauccuuuauaacauuucugccauuaacuucaguuauucauaaacuaaaauuacuacaaacacuauugcaauuaugauguugaacacaaagugucaucugucaaauuaauaagaaaauauuuuaucuuauauccacuuauuccuucuuuaauacucuuuuuuucuuuauguagauggcaguuucugacuuuaucaccuuuucuccuuucugaagaacuuuuuuaaacauuucuugcaaggcauauaugcuagcaauaaauuccaucaauucuuguuugucuaagaaaauauuuuucuuucucuuuugaagguuaaucuugcugaauccagaauucuagguugguggguuuuuucuuuuaacacuuuaaaaauuagauucauuuuauucucuuccuguuugcacggcuucugcaaaguacucccagguaauucuuauccuugcuucuuuguagguaagguuuuuguuuuuuuguuuguuugauuuuuguuuuuuaauuauuauuauuuauuugagacugagucucgcucuauagcacaggcuggagugcaguggcgaggucuuggcucacugcaaccucugccuccuggguucaagcaauucucaugccucagccucccgaguagcugggauuacaggugccugccaccacaccuggcuaauuuuuguauuuuuaguagagacaggguuucaccauguuagccaggcugguuuugaacuccugacccucacaugauccgccugccucggccuuccaaagugcugggauuacaggcaugagccaccgcacccggccugauuuuuggguuuucuuuguuuguuuguuuacuuuggcuuauuuuaagauuuuucucuuugucuuugauuuucugcaguaucaauaugauauuccucaguguauuuuugggggguauuuauccugcuugguguucggugagcuuccuagaucugugguuuggugccugucauuaauucaggaaauuuuucagucauuauugacugaaauguuucuucuuuuccuuucuuuccuuuuuugugucccuguuuauuuauauauauauauauacauguauauauauauauuuauuacacaauuuguaauuguacugcaguucuuguauaauuuuucugucuucaguuuuuuuccuuauugcacuucuuuuuuggaaauucuuauugacaauucuuaaaguuuacuaaugcauuccucagcuauauccagucuacugaugagccuuucaaaggcacucuucaugucuguuaauaguuuuuuauuuugagcauuuucuuuucauagaguuuucaucucucugcuuauauuaccccgcuguucuugcauauagucuauuuuuucuauuagagaccuuaacauaguaaucauaauuauuuuauuuauuuauuuauuuugagacggagucucacucuguugcccaggcucaagugcaguggcgugaucuuggcucacugcaaccucugccuccuggguucaagugauucuccugccucagccucccgaguggcugggauaacaggcaugcaccaccacccccggcuaguuuuuuuugcauuuuuaguagagaugggguuucacuauguuggucaggcuggucucgaacuccugaccucaggugauccucccaccuuggccucccaaagugcugggauuacaggugugagccaccgugccuggccuuaaucauaauuauuuuaaauuccuggucugauaauuuuaacaucuuugccuuaucucagacuguuucugaugcuuguuaaaucuuuucaaacuguguuucagucuuuuagcaugucuuguaauuguuugaugaaugcuggacaugacauauuugguaaaaggaacugagguaaguaggccuuuagcaugagcuuuuauguuuaucuggcuggaagcuaggcuguguuugcugucaccguacaugucagaggcuaaaauuuccuucaguguccuggucuugucucuucuguugucuauggauuacccuagugaguucuuccuaaauauagucugagauaugcaguucuuucuguugaauuucucugucaguauacgggagccauagugauguggucguuagaugugggaguagagggaagcguucaauaguccuaugacuagaucuaagucuuuuaguaaagccuuugccuugggcugugacguucacaagugcuucucagucuccccugcccuuuaaguuagacgagauagcuagaggaagccggaggcccccucucccacacggaaugcaagagggggcuggagcuggauuucucuuuuuuuaggccgguuagguggcagcagcccuccagucaguuaggcucugguaaagucguuucccuugaggcaggccuguuacaaggaaugcaacaugccaagcauauuucaaacuggcugcuuuucuucuuccuuuagguugcauaaggggauuuuuuucuaguuuuuacugugaaaaccugguaguguccuggagauaaaauuggggaaguggggcaguccuucuaugacugggucuuccuggaauuuuuuuuuuuuugagacggagucucgcucugucacccaggcuggagugcaguggcgugaucuuggcucacugaaaccuuggccucccagguucaagccauucuccuaccucagccuccugaguagcugggacuacaggcgugugccaucacaccuggcuaauuuuuguauuuuuaguagagaugggguuucaccguauuggccaggcuggucuugaaccccugaccucaugaucugcccaccucagccucaaaaugcugggauuacaggcgugagccaccgcgcccggucuggaauuuuuaacucucaaacuugcugacacugagcuuccagcaagucaucaauuaugauuuagauuuucuaccuccuacagagguuucugauuuccuccuguaaauucugugucucagcguccacccaucucuucaguuuuggggcagcaguuuucccuaugacuucauuucucugauggaucuaagaagaguuguugauuuucaguuuguucaacauuuuuccuguugggaagaugggagugagguguuccaagcucauuacauuccagacugaaaauucaaaguccacaauauuuuuuaaauuacagcuuuuuauuauagcuuuggguuuuuaaaaaauaauaauugagaggaauuuucacauguuguacaauagcuuuugauugcacuaguagugaauauuagguuaaguauuauaugauugauauguugauauuauugaaacguuuuuccagagacugaggugccacucaauagcuauucuaaugauuguugaccuguaauuucuuauguuacauccuguaauuuuaauuguuauugauuuguaauucuuuauauuacacccugugaggccaaggaaauacucuuucacaauucuccaugaaauguuuuacuacaauucucucuuauuuggcuaccauuucauagauaaucaucacucccgucuaugccuuucuaucucagagccucccucuauuuaaucuuccaucaguuuuuaacaaguugaugguauuugaucaugaguaauaauauaucuuauuuuucagaaucuacuccauucuuuaaaaucucuuggauaacccuuuuaauuaaggcuuuucuuugagccucgauuccuuggagaaaaggaaauugucagaaacgacacacuucugugauaugccaccagcaggcccauuacuauauaccccagccuucucuuuguuaucuagcuaauguuaggcugccuuguuugucuaaacauauaauuauauuucaggaaaaggagaacauaagucuuccguacuuuauaucaugcugugcccucuaauaaucaacaaauaaaaacacugcuuaauaaugcuuaauguguuugguuuuguuuauuauaggaggaacucucuggaaugaaaaauaaaauacaaguaguugugcuugaaaacgaagggcuccagcaacagcuaaaaucucaaagacaagaggagacacugagggaacaaacacuucuggaugcauccgugagcauuauuuuaaaucauaaauuuuauuuuagugugaauauucccuucugcccucucuccucgccuucuucgcugcuuagauuuucucccugaaguguggccaaaguacuauguugguauuuguuugagaccucaaauaucaaacuucacugugguggaaugaauccucagaugaaacgaucuugugauauuuugcuacaguuuccucucugagcauaccguuucugccuuaccauauggaaagagccggucugaaagcaggaaguguguuauacaggaaggacuuugcuaagucuagaaaccguucagaacuuuaacuuagauuucuguuggauuucucuaaauuuuccuugaggucugaaaucuaauaagucuaauuagcugcaugauguagcagaaaaaauguuggccuuaggauccaagaaucaaaauguuagucuucccauuucccuaagaaggcugguguuuagcaaguaauuuuagaagguuuuacauagcuuaaucacguauguccuuuauuucuuuauugguaauuugagaagauuaaccuauaccaggaguuuucagugcaaauuccuggacuccauccccugugagucugauucacuuggucugguuggcuucuaggaaucuaaacuuucaucaaguugccuaagugauucuaaugucaguggcccagaguuugaagaacguugggucagauuaucucuauaauucugugacagagaauuauuguggugacauuuaaauagugcuuaaaucuuaugacuuaucagaguacuuuugucuuaaacuuuuuguaacuguuuugcuauaagauauagucacagcuuguucugcuuuuugggacaaauucaacuuuccauguggaaguuuucauacuugccuauuccagcuucacuuugcaguuuacuuuggugguuuugacuuugucgucauuaguaaaucagcuguuaagaaaacaugaaagucuugauguuucauugggauauccucuaauuuucguuuuugaaguuuuuuuuuuuuuuaacuugaauugauaguugguuuauaauccuggaguuguauauguuaggguuugcuauugagaaguauaggaguguauuaacucugauaaaugaagugggcuaauuaguauuucaguuuaauuuucugcaauugcauuuaaguuugugaucaguucuuuucuccucacuguauaacuuuuuccugaagauuuguauaauuauuagugguaaaaacuccaucuuaguugcuuaugauuuuaaugucaauuugaggaagauaucaccauauagaaaauacuuagaaguagcuuauuuuaaaaauauucauuugcuuuucuuccaaacacguggucacuuagcaagcagugauucaauuauucauaguccucaguauuuauguaaugccaaagaaguggaagaaggggaagugaagugagaaaggaaauuaggcagacaagugaaucagagggcaagagaaaugaguaaugcaaaaggggaaggaaaugauggucagagcacacaugccuugcagcaugagcaaagaaaaugugcuaaacaaaacuacagucagaaucauagaaaggauaagguuuuagagagguuuuguuguuuuuuaaacauucaugugagcuaaauauaaugcagguauugaaaugauuacugcagauaugccagaugaccuugauaucuauuuuaauguuaaucuucuguuauuuguuguuguugaauuguuacccccacguuuuaccuguguaagugaauugaaauauuucaaggccagauacagugucuuacgcauguaauuucagcaguuuggaaggaugaucacacgaacggauggaucacuugagcccaagaguuccagacaagccugggcaacauagugagaccccaucucucuaaaaauaaaaaaaaaauuagccgagcaugcugauguacaccuguggucccaacuacuuuggagacugaggucagaggaucccaggaggucaaggcugcaguaagcccugaucacgccacugcacuccagccugggcaacagagugagaccuugccucaauaaaaacaagacaaacaaaaaaccagacauuucaauaauacaugcauggugcuguguuacaaguuguaacaugaauaaaaauguuuaggauaucuuaaauauaaaaaaucaagaaauaucuucuuuuggggggaagggguuuuuguaaugagucaauuaaaauguuggugcuaaaucuucccuugcuauauugaaguuugcugauuucaauauagauuuucaguguuucauaaugccuuuuaagaaagauaauugagguggccaggcgcaguggcucacgccuguaaucccaacacuuugggagaccaagguggguggaucacgaggucaggaaauagagaccauccuggcuaacauggugaaacccaacucuacuaaaaauacaaaaaauuagccgggcgugguggugggcaccuguagucccagcuacuugggaggcugaggcaggagaauggugugaacccaggaggcagagcuugcagugagcugagacugcgccacugcacucuggccugggcgacagagcaagacuccaucucaaaaaaaaaaaaaaaagauaauugaaacauuuauaugguguauuagguucucucaaaggacagaacuaauaugauauaauauauauauaugaaggggguuuauuaaguaguauuaacuuauuaacugacacaaucacaaggucccacaacaggccaucugcaagcugaggagcaaggaagccagucugagucccaaagcugaagaacccgcugucugagguacaagaacaggaagcaucuagcacaggagaaagauguaggcugggaggcuaagccagucuaaccuuuucauguuuuucugccugcuuuauauucgcuggcagcugauuagauggugcccacccagauuaagggugggucugccuuccccagcccacugacucaaauguuaaucucuuuuagcaacauccucacagacacacccaggaucaauccuuugcauccuucaauccaguuaaguugacacucaguauuaaccaucucauauaguaauaacuaacauuuauugaugacuacaugguuauaaugugcgaggcacugugucaaacuauuuacguuauauuacuucagauuugcaguacccacacaaggcagguguuauuaucucuguuuucagaggaguaaauuaagguacacagcuguuaaguaaccuaaguaauuggccuaaugucacagagcuagauaauggcaaagcaaggauucaaacccaggacuaucuaauucucuaaauacaccccguagaaccuuaaauuauaccgccuuucugcauaaguuaggaagagcuugucgacauugaaccaaaccaucuuuguuugcagaggauagaaguuuucccuggcagaaaagagaagaaucuccuuuuuauugucuccugcuuguagcccuggacuuugaugguagccuguaagacuuucaacuuuuggucuaguuuaugaccuagaaguuaaagaagcaagccauucaaaguauauuucauuccuguccugauuuuucaucacuuugccuucucauaaaauauuuccucauggaaagcuuuucucuagaguucacaaaaucaaaauaauacgaaaacauguuauuuauucaacauuuugucauguguccuucuuuaaagauccaggaguuuuuucuuaaggagaaaauuucucggccaauauuuuucacguuuguuuucauccccugucuuaccaccgcucccgccccccgauccccugccacccaauuaagaaaucaaagguuuugaaugaucuucaaggauuuaacauacuuagguuuuuaaaaacaucuugguuaaguagcauucaaguuuuuuaaaacuaucugugaaagaacaaaauguccguuagacuagcaauucuuuccaaagaaugauaauauuuuauaucauaaguuagugaucuguggucuacaugcucccuccaauuucuccauagaaaauuaguaccacccuccuucauugaucucaaaaacaacuuuaaaugcaaucauaucuuaggggauuugacucuaccgagagaaucaagugcagacucauuccauggugugguauacucucaagucccuuacuugauucuuuagcuucaucuucugacauucaucaccuuauguuuugacgucuaguaaugcugaauuuucugagaccccccugcaggcaccaugcuauuccauaccucugugauguuuaucaugagguucucucuucuucgaaugcccuuuccaucuagcuuacccuuacuuauccuucaagauaccacaccagugucaauuuuuuucuggaaaaccuuccuuggauuucugggugcccuuaguaucccuccuguguuuuggcagaggccccugugcacaccuuuggccuagcacucacauuauuaaauugaaauuaccugccuaggugugugucucccuuauuagacuguaaacuccuuggagcuaagauugaucuugcucauuuuuguccuccaagcucuuagcacagugucugaacaccauagguguuacacaaauguuugcacuaaacugaacuuccagaagaauauaaaauagacugucagaguacuacuuuaggugaauguaguuuaccacguucgagcaugaugcgacacugcaguaugggucagugucuggggaccuguccugucuugugacuacuaccauauccuuuggcccuuagcaagugcucaauaauuauuuguugaauuaaauuaauauacguauuuuaauccuucuuguacacauaaauuccccagaucauugggcugcuuacuacauugaauguugagagggugacagagguugcaacuaacaauggguacacuaaauucaacucaggcauguuugguuuguuugauaaauuuugagccaguguuuaauaguguuucacaugaaggaccagauaucugguaauaugaauuuucacugccacauggcagugauugacuggaauugaguaguggcugcuuccuuuggaugguacacauuucugugguuugucacagagccuacucuucuuccuuuuugaaucccuggcaugcaggcugcaugucaacucuguuuaucaccauacaugcacuguuucuuuuuacugaagauaaauauuuuucuggaaaggcagaagaucguaauaauaaaggacuuuaaaggaaaaaacuguuccuuuuucucauaaugcuucugacaccaaauguuuggguuuguuuucuccuacaccuggccauucucuguuucucuguagauaccaacuagguguccagugauucaauucaauucugacacucacuacacaguaucagacccacagguuaagggcucaguaccacaugacugccugcuacuuuagauaccaacugcaaauaguaggucucuugguuauccacaauucugucugauuugucuguaaauuggggauuccuacaaucccuuccuaaugugugauaauuugcuauaauggcucacaaaauucagggaaacacuuugcuugcuauuacugguuuauuauuauauaaaggauauaaaugaacagccaacugaaaaggcacguagggcaggguccaggcuggucccaaguagaagagcuucugucuguggaguuuggguacaccacccucuuggcauguggaugcauucgccaacccagaaauucucugaacuucaucauauaggauuuuuauggagguuuuauuacauaggcaugauugguuaaaucaauggcuguuggcgauuaagucaaucuccaguccuuuccccccuugaggugggggaguggggcuguaaguucuagucuucuaaucauggacugcagccaccagucaucuuauuagcauacgaaaggauacucuuaucaccauggagauccuaagggucuuagaagcacuugugucagaaacccgggacuaagaccaaauauuuuaacgaaagaugcuccuaucacccaugucacucaggaaauuacaggguuuuaggaauucugugucaggaaccagggacagagaccacauauauauuuggauucagauugacagguuucagauucuagugcugccacuuauuagccacuuccuaccucugugacccucagcuacucuaugugacucaguuuccuccuguauaaaauggaggcaacaaugaaaccuaucuaucccauagaacuguaaugauuaaaugaguuaauauauaugacauacauaaaacagggucuggaacauagaaagcagcauuuugauaaaaauuauuauuagccaugcauuuaugaaacauggaacaugaaagacaaacuaagagagaggugugugcuucaagaguauaugucuucagaggaguaaagaauaauuccauuuguugaaugcgcugaaaucuagcccucuuugcccauauuuagauuacugccuguaccugaaggaauuuuacuuugcaacacuuguagaauaugacccuaauagccugaaaaugugaagugauucuugaccuguaguguagaagcauaugcuuuuucuuuucaucauagguaagaauagguauuuuauuuguaaaauaugcauguuuauuuaaaguugaauucaguugcaguuacuggcacauuuuauuuuagggaaacaugcacaauucuuggauuacaacaggugaagauucuggggugggcgaaaccuccaaaagaccauuuucccaugacaaugcagauuuuggcaaagcugcaucugcuggugagcagcuagaacuggugaguauuugggugcuuuucucuuauacaucuuuuuuuucuuuuucucuuuuguacuuuuuuaaaauucugguaaaauauauauaacaaaauuuaccauuauaaccauuuuuaagcguacaguuuaucugcauuaaguacauucaugucacucaaucauaaacauuauccauuuucagaacuuuuugaucaucucaaacaaaaagucuggacguauuaaacaauaucuccauuccccucccugccaaccccugaugaccucucuucaacuuucggucuguauaaauuugccuauuucagauacuugacauaaguggaauuaaacaauacuuguccuuuugugucuggcuuauuucccuuagcauaauauuuucaagguucauuuuguuguagcaugugucaaaauuucaagacugaauaauguuccauuguauguauguuaccaaacuuuauccauucaucuauugacugauauugggguuguuucuaucuuuugacuguuaugaauaauuaugcugugaacauuggcauaugagaaucuguuugaaucccuguuucaauuauuuuaaguauauacccagaaauagacuuauuggaucauaugguaauucuucauucuuuuuucuuucugcuccucagacuugaucauuuuaauugucguuucuuaaaguucaucaauucguuuuucuaccugcucaaaucugcucuugaauaccuuuaauaaauuuuuuauuucaguuauuauacuuuuuagcuccagaauuucuguuugguuccuuuuuauaauguguuuuccugauuuucuuuaguucuuuguccauguuugucucuuggcucuuugaguguguuuaacacagucauuuuaaagucuuuccccaguaagucugaugucugugguuucucgagcguaguuucugucagcuuauccuguucuuuugagugagcauguuuuccuguuuccuuguauuccuuguuauuguguuguugaaaauugagcauuucccuauuguaaugugauaacucuggaaaucuuuaacuccuucuuuucuagaauuugcugucuuauuuuacuuuugaaggcuguaauacuccuuuuguuuugagacauuuccauacuauuuuugugaagacuauuccauaucgugugauuauugaagucuuuguucuauuagcucauguucagcuaauguuugacagagauuuccuugaauuccaggagcugaaaacaaacacccuccacuccccccaaaagguggggggggggagagagagagagagagaaagagcgagagagagagagagagagaacaacccaccucucccagucuuuucagauugggucugugcugggacauucuuuucccauuuaaccaggcuugcucugagccuagggaucagccauaggugaaagcuuacagucuucucaggauguuucugaguguguaucuuuccuaggcauacugugacuuucuaaauucccccccccccccacagcugccuuugaacguccuaauuucccaaagcgucaaaaacaauucuauuuuaagacuaaauaauacuuuucaauccuuuuauguauguaacagacguuuauucuucucuugcuaaccugaagucuucuuugcauuaaauuugacaugucagaguugaucaacaaugaugaaagagugagauuaacacuguaaauggaauguuccaggggaagauagaaugaaucauaguucagguucucauuauuauccacagaugauauaguuuucuaaagauucuuucugcccagucacccucuccugucuuagucccuaauccaagcuucauucuacuugggaaagaguauccuucuucaaaaaagaaaauuggaaagacuaaguaaauuguaucuuuuuuuucccucucugaauaauuuacaguagcuacuuaauaccuauaggauaaagaccaaugucucaagucauccacaauuugcgucaaacuaauguucgaacuaguuucacacucuucuccugucuuuuguuuuuuguuucuuguuucuuuuugagacagagucuugcucugucgcccaggcaggagugcaguggugccaucucagcucaccacaaccucagccucccgggugcaagcgauucuccugccucagcaccccaaguagcugggacuacaggugugcgccaccaugcccggcugauuuuuguauuuuuaguagagacgggguuucacuauguuggccaggcuggucucaaacuccugaccucguaauccacccgccucggccucccaaagugcugggauuacaggcaugagccacuguacucggccucacucuucucccgucacucuuacaaaucuuaucuguaggcaugcagaccacucaccaguugcugcuucauaaauuuauaauccacuuucauuucucuuugaagaacuggcuuugguuuaugcaguccucccuccccaaaauguucccuucuuacccucuaccuauugaaauguuuccagucuucaggguauaguugaaaugcgcccucucauucugcuuucccgaauagcauguuuucucucuucccuuuucugcauuagaauuccuuucucuuuuaugccucccccuagcacuguguuuaugacuauuggagacucaucuuuuuuccuuguuuaugaaaaaggucaauuucugcauuugugugcucuaccucacaaguguuuuucacuuuuuccaaggguuucauucugggacuuuucuuucucuuguaucuuuucccuaucaaugguuuauucuuuuuauuuuauuuauuuuuuugagacgggaucuagcucugucacccaggguggagugcaguggcgcaaucucagcucacugcaaccuguaccuccuggguucaagcaauucgccugccucagccacccaaguagcugagacuacagucaugugcuaccacaccugguuaauuuuuguauuuuugguagagaugggguuucgccaugcugcucaagcuagucucaaacuccuggccucaagugauccaccaucuucagccucccaaacugcugggauuacaugugugaaccacugcacccggccaauaguuuauucuuagcagaauauauucuuuaauagcucccauaaagcaaacaaacccaaaauauauucuccugacccuacauucacuuccaacuaucacccuacaucuacauucuccuuuucauaccaaacuuuuuccaagcaguugucuauauuuaugucuccacuucuuuaccuccuauucuugcuucaguaugcuucaguugagcuucgucccccuguaguccaccccaacugcucuuuuuuuuuuuuuuuuuuuuuuuuugagacggagucucguucugucgcccaggcgggagugcuguggcgcgaucuccgcucacugcaagcuccgccuuccggguucacgccauucuccugccucagccucccgaguagcugggacuacaggcgcccgccacugcgcccggcuaauuuuuuuuuguauuuuuaguagagacgggguuucaccguggucucgaucuccugaccucgugauccgcccgccucggccucccaaagugcugggauuacaggcgugagccaccgcgcccggccccaacugcucuuuuuaaggucauuaaugacuuccagccaucaguccucauugcucuaaaccuaguagcagcuuuguauaacauguacauugguugauuauacccuccuccuuuauauuuucuaagacacaauuuaacauaacauucaguaaaguacacaaaacaaaaauuuacagcucaaagauuuaucuguaaaugaacaccuaugugauuaucaccacuuuaugcuuccuccuaguuacugccccuucaugccauuaaagcuaaucaugauccugaauuuucugaaaauacucaaguaugcaucauuaaacacuuuugaguucuguuuuuucaauguuauauaaguggaauuguauaguauguauucuuuguaucugguuucuguuguccaccauuauauuuguuagauucauccauguuguuacauuggccgaaguuuguucauuuucuuuggugggucugcuauaugaacauaugacuuuauccaucugcugucaaggaacguuuguguuguuuccaguuugcagcuauugugagcagugcugcuaugaacauucuuucaucuguugguguguaugacacaaauuuacguugcauauguauguuggaguggaauucuugcucucaggauaugucuguguucaacuugaguagguaaugacaaccuuccaagggguuuuaucaguuuacacuccuacccauacaagggguuuuaucaguuuacacuccuaccaguaguacaugagugauaccuuugcuccauauccuuacuaaucauauaguauugucaauuuuucuggugaacuuauagugcuaucuugugauuuucauuugcauuucccuaacuacuagugugauugaguauuguuucauacauuuauuguccauuugaugccucuucugugagccgccuauucagauauccuucuuauuauuuuuauuaagguauguaucugacauauuuauuuggggaguucuuuauauauucugaaugcaagcccuuugucaguauacauauuauaaauauauauucccacucuguggcuucgcuuguaacucucuugauaguuugcuugcuugcuuugauggcuagaacuucaguuuguuuuccuuaauuauguaguuguuuuuuauguccuuuuaaaaaaguuuuuuuccaacuacaaucaugaagcuaauucuucuacauagucuucuagaaauuauaguuucacuuuuuuuuuuuuuuuuuuaagacggagucucacucugucacccaggcuggagugcaguggugcgaucucagcucacugcaaccuccaccucccugguucaggcaauuccucagucucaaccucccaaguagcugggauuacgggcgcaugccaccaugcccagcuaauuuuuuuguauuuuuaguagagacggaguuucaccaugucggccagacuagucucgaacuccugaccucaggcaauccgcccgcuuuggccucccaaagugccgggauuacaggcaugagccaccgcacccugccuuuuuuuuuuuuuuuuuuuuuuuugagacagaguuucgcuuuuuuugcccaggcuagagugcaauggcacaaucucagcucacugcagccuccgccucccggguucaagcgauucucccaccacggccagcuaacuuuguauuuuuaguagagacgggguuucaccacguuggccaggcuggucuugaacuccugaccucaagugauccaccugccucggccucccaaaaugcugggauuacagaugcaagcuaccaugccuggccuaugguuuuacuuuuugcauuuagaucuacaaccuaccuggaauuuauuuuuguauauggggucauaguuuguucuuuuccuauguguuuauacauccaagcaccauuucuuggaaagguaguccuuugccuuuaugauaguaccuuucuccuaaauaaguuguccauauauauuugggucuauuacuggacuguguuuuaguuaauugugcuaauacuauacugucuugauuguuauagccugaaaucuggcagaccaagucuuccaacauuguucuuuauccuuuggccuuuagcauuuccaaauacaguucagaauugugaaguuccaaaagucauuugggauuuugauugagauggcuuuaaauuauaaauuauaggucauuugagaaucaacauuuuaugauauuaucuaauccuuguaaacugcauaucaguccacuuauuugagucaucuuuaauuuuugucaauaaccuuucauagucuucugagugaagguuucauacaucuuucauuagaauuauuccugacuuuuuauuuuuuaugcuaucauaaaugacacauaucuuccaaauuuuuauuuucuaacuccuaauugcuaguguagagaaaaacacaugaguuuuguauuuugauucaaugucacuuucuuuugauuaguguuagcaugguauaucuuuucccuccuuuuacuuuuaacuuuuaaccuauuuguaucuuuuuugaaguggguuuuuauagaaagcauauaguuggguuuugcuuuuuuauccaaucugacaauauuugcuuuuuuuucucccuccccacacaaaggcaggguuucgcuuuuguugcccaggcuggagugcaauggcaugaucuuggcucacugcaaccucugccucccagguuccagcuauucuccugucucagccucccaauuagcugggauuacaggcacaugccaccacacucgacuaauuuuuguauuuuuaguagagacgggguuucaucauauuggucaggcuggucucgaauuccuaaccucaggugauccgccugccucggccucccacagugcugggauuacaggcaugagccaccgugccuggccauauuugcuuuuuaauuuggguaucuagaccacugacauuuauugugauuauuuauacaacucaguuuaaauacaccaucuugcuauuuggcuucuucuuuaccuaucucuuauuuguuccccuuuaccucuuuuucugucuucuuugaauuaauuuuuuuuuuuuuuugagacggagucucacucuguugcccaggcuggagugcaauggaauggucuugacucacuacaaccuccgccucccagguucaagcaauucuccuaucuuagccuccugaguagcugguaauauaggcgcaugccaccacacccagcuaauuuuuguuuuuguaguagagacgggguuucacuauguuugccaggcuggucuugaacuccugaccucgugauccgcccgccuuggccugccaaagugcugggauuacaggcgugagccacugugccuggccaugaauuaauuauuuuuaugauucccuuuugcuuuuuuuuguuggucugaaaaaaaucuuuaguaccaguauucacuugauugcucacuucagaaacccaggauuauuuuuaguguauuuuucuccccuauaucuauucugucauaaaauucucaguuuuucucuuaaauauuucuauacuaaauccuuucuuuuuaguuccuacugcuugauugcuuuuguucaugugcuuaucucuuaccuauguauuuguaauuacugguuucccuuucuucacacuucaauuaugauuuaagacucaauucugauaaaaagcuuucaguggcccuccaguguuucuucuagagggaaagugcaggagacauguguaccaaauaaaagucuugauauuuuuauucuucuuguggcccaccuuuaccuauuuugcccaucuccaaucaccucuccaccucacauuuuacauuccugugauacugaucuacuuacuuuccaaacaugguuuggacaaccucugugccuucugcucuacuggaaauuauccuucaaaucuuaacauuuccucugugaggccuucuuuacuuaucuuuggcugaauuaggaguuccugccucucuaaauuuuucaguuuccauauacuucacuagagcaauuuaugaacaguuggcccuugaauaagauagguuuguauuguguggguucacuuauauguguauuuuucugaagaaauguaccagaauuuuuuuugagauuuguggcaauuuaaaaaaacuugcagaugaaccauguagcuuagaaauaugaaaaaauuaagaaagagguaugucauaaaugaauaaaauauauguagguaauagucuauuuuaucaucuacuaccauaaaauauacacaaaucuguuauaaaaaguuaaaauuuuucaaaacuuauguacacuaucacagacuguacacggagucauucucaggaggaaugcaaaaaaacauaaagaugcaguauuaaauuauaacagcauaaaguaaaauguaguacauacuguacuacuauaagaauuucauaaccaccuccuauugcuauuguggugaguucaaguguuuugagugucugcuuaaaacaucaugugacaccaguuaaucucugcauaaacaguuugucuuuccaguaaauugcauaucacaguaaaaagugaucucuuggugguucucguguacuuuucaucauguuuggugcaauacuguaaaccuugaauaacaccaugaggcccaugcaaagugccacuagugaugcuggaagugcucccaugaagcaaauucaugacauuacaggaaaaaguuacauugcuugauauguuccauagauugaagucugcauccccauuucaagucuguugccccauuucaagauaaauuaauccaauauaaggaccauuguacaaaaagaaaaggaaauuuguagagccaucacugcagccgugccaacacgcacaaaaacuuuguacuuuugcacaaugccuuuuuaucugucauggaaaaugcagauuuuauauggguacaggauuucuauaagaaaagcauaccuguagacucuaauauaauuugaggaaaaaaaaagucauuuuaugacaacuuaaaacaaaaggaaaguaaaggauauaaagcuggagauuuuaaugccagcaaaggaugguuugauaauuuuaggaagagauuuggucuuaacaaugucaagauaacaagagaagcagcuucuguugaccaagaggcagcagacaaguuccaagaugcaauuaugaaaauuauuuaggagaggcugggugugguggcucacacuuguaauuccagcacuuugggaggcugaggugggcggaucaccugaggucaggaguucaagaccagcuuggccaacauggagaaacccugucccuacuaaaaauacaaaaauuagcugggcaugaugucacgugccuguaaucccagcuacucgggaggcugaggcaugagaaucacuugaacccaggagguggagguugcagugagccaagauugcaccagugcauucgagcuugggugacagagugagaaucugucucaaaacaaaacaaaacaaaaaaaaggacgaaaauuauuuaggagaaaugauaucugccugaauagguuuuuaaugcagauguaagugcucuacucugggggaaaaaaugucacaaaggacauuuauuaguaaggaagagaagugagcaccaggauuugaugccggaagggauaggcuaacucuacuguuucgugcaaauguacucagguuuaugaucaggacugcccuuaucuauaaagcuccuaacucacgagacuugaagggaaaagauaaacaccaacugcuagucuuuugguugugccacaagaaggccuggacaaugagaaaccuuuuucuacacugauuucauugauacuuugucccugaaguuaggaaguaccuugccaguaagagacugccuuuuaaaguuuuuugauauuguacaauggcucuggccacgcagaaccccaugaguucaacacuaaaggcaucaaaguggucuccuugccugcaaacacaaugucucuaauucagccucaagaucuaggcagucauaaggaccuuuaaggcuuauuacauauggguacucuauggaaagcauuuucaacacaauggaagagaaccccaguagcaagaacaucaugaaagugugagaggauuacagcauugaaaaugccauuauuguuguagaaaaagccaugaaagucaucaaacccauaacaaugaauuccugcuggagaaaacuuuguccaaauguggugcaugacuuuauaagauuuacaacagucaaucaaggaaaucaugaaagagauuguggaugugguggaaaagguugggagugaaggguuucaagauagagaucuuggagaaauucgagagcuaauagacaccacacaaaggacuuaacagaagaugaguugauggagaugagugcuccugaaccagugccagaaaaugaggaagaagacauagaagaaucagugccaggaaacaaauugacaugagauaaucuggcagaaggguucugauuauucaagacugcuuuugacuucuuuuaugacguggacccuucuauaauauaggcacugaaacuaaagcaaauggaagaaggauagauaucauauagaaacauuuuuggagaaauuaaagagcauaacaaagugagacagaaauuaccacguguuuccauaaaguuaacuaaguuugccugccucuccugccuucccuccuaacuccugcaucucuucugccucugccaucccugagaagacaagaccaaccccuccuuuuccuccuccaacucagccuacucaaugugaagaugguagggugaaggccuuuaugaggacccgcuuccauuuaaugaguagaaaauacuauuuucuuuuccuuaugauuuuccuaauaacauuaucuuuucucuagauugcuuucuuguaauaauauaguauguaauacauauagcauacaaaauauguguuaauuguuuauauuauuguuaagucuucuagucaauaguaggcuauuaguaauuaaguuuugggggagucaaaaguuauacauggggccaggcgcaguggcucacaccuguaaccccagcacuuugggaagcugaggcgggcagaucacuugaguccagggguucgagaccagccuagccaacaugaugaaaccccaucucuacuaaaaauacaaaaauuagccgggcgugguggcacaugccuguaaucccagcuacuuggguggcugaggcacaagaauagcuugaauccagcauguggagguugcagugagcugagauugcgccacugcacuccagccuuggugauagagugagacucugucucaaaaaaaaaaaaguuauacauggauuuccaacuguacaggggucaaugacccuaaccuccauguuauuuaagggucaacuguaauugaaauucuucauuuuucuauuccuuucugggauauuucguaaguuccuugcaguucaagccaccuucaucuuagauacacaauaaauauuuguugaaugaaagaauaacuggauaccaacagaggcuuguaggaguuagucuaucaucaugugauauaaaacuuuacuuuugaucauucaucuagcacauauuuauuauaugucaaauauucaacagccacaaugaaggauucuaauaagauuugaucuuugcccucauggaccuuauggguuauaacuguuuuuccccagagucacacuuuuagggauaagaccugauauaugcaauuuugaaagacaaagaaaaucaauuuuaugacucagcgguucuuugcaggcauucacacaauaaaaauagaaaaauucaaguggacuagggaaaauauuuucuaagaagacauguuucccccacguuggguaaaaagaaaaaaauugaguuuaauauuaaaaauuaaaguuuacuuauaaaauacaggacauagagaaaaauguacuucuauuuuucuuuucuauaggagaagcuaaaacuuacuuaugaggaaaagugugaaauugaggaaucccaauugaaguuuuugagguaaagugaaaucguccauuuauagucauaccaaaagcauaaugaucuuaaaauauauuugaauguuugcugaacuucuaguuuuagucauuaucagacuuacuugaugacauuuuaauacacuuuaaaaaauuuccucagauuauuaaaggaugaaaggccuaaaauugaguucuuuuccaaaucacguucccauuucuucaucaguuguaaaauauuuguguuuucuuguagaaauaagaaucacggccgggcgcgguggcucacgccuguaaucccagcacuuugggaggcugaagcgggcgaaucacgaggucaagagauugagaccauccuggccaacauggugaaaccccguuucuacuaaaaauacaaaaauuagcugggccugguagcacgugccuguagucccagcuacuugggaggcugaggcaggagaaucacuugaaccugggaggcggagguugcaguaagcugagaccacgccacugcacuccaaccuggcaacagagugagacuccauuucaaaaaagaaaaaaaaaaaaaagaaauaagaaucacuaacugcucuuauagaaauuaugauauucaaguaaaauaaugaaaauaaagcacuuuaguuuucaaauuauuaguauuuuuucucuguagauagucuucaucuaauuuuaaaauugcaaugauaauauaauaguuugaguauuuguauacaugaugaauuugaguauauaugaugaauauucauguacuuuuuauagaaucuauuuauuagagaucccaguaagaccuauauauuauagauuaaccauuagugauuuauguauaaugaguagaaaaagacagcaggaauuaauauuuuuguuguuaaagauuauuuuuaaauaguaguaaugaaguaauuuuaaaucaaauaaacuuugaaauauuguuuauaauuuuauuuuaauaaguccaauuugaaauuuuaaaaucuuccaggccauagccuaucuagagacauaacuagaguaauacuaagagccagaacucagcugauugugguggcuuacgcauguaaucccaacacuuugggaagccaaggcggguggaucauuugaggucaagaguucgagacuagccuggccaauaugguaaaacccugucucuacuaaaaauauaaaaauuagcugggugugguggcacacaucuguagucccagcuacucaggaggcugaggcagaaucacuugaacccaggagauagagguugcagugagccaagaucaugccacugcacuccagccugggugacagagggagacuccaucuaaaaaaaaaaaaaaaaaaaaaaaccgagcuggaacucauagcuuucacuguacaugguuguuuauuuuuuaaauguucuuauguuuuucauagauuacccugauuaguuuuaggauuucucuuagagauuuuuacuuuuuuacaaagaaauguuaacauuuaaaaaauacucuaauuuuugcuuucuuguuuuuuguccuauuuuauuuuauuuugauuuuauuuacgacuugauucuuuaguuuuuaaagugauguauuucuagaucauuguacuuaagggaaugugacuuauuuugucucauucagaauccagauauuucaucuuuaauuacauuaaaauaccaacuuguaaugaauuagacuuuguucucugaauccuucuguuucuucauuuucuuuuacuauaauuuaagauuauuuaaagaggcauuuucauaaauaaauaaaaucagucuucuuuucaacuuucuuuuuaacuuucucuuuugccauuucuaguaaccaaaucuacuugaguguuuugaguuuggagcugaccaaaauuaguaauggggacccuuugacuuuggaaugugcuucccaaguucuuuuuauaaagccuuugaaagucagacauucccuacaugauauugaaaaagaaaacuuaucaucuugguguuauuauuuuggggauaggguagacgcagcucauuuuucuuccccucaacuuuggaaugccauuccaaaguuuuuuuuuaacccuuagauugccugugggucuuuuaugccucuccugcguugcuugaaagcccccaaaaucucaacaguugucugacagccaggcuguuggcuucuccucugugacagugagccaguuaagauggccacagcaccugagcguggagacuuugacaaugacaacagagaguagacagagauggagauaaaguuccugccuucaguagucucauuuuucagcuagaaaguuuuuuuuuguuuuuuuuuuuuuugaaguacaaaagaaccaucuaggcaaggaagcucaguugccaaggugacuuuagcgcagcuuuacugggauaagguaggaaaauacaacccauguacuagucaauuaauccuuaaaaagucaccuuggagaaaaaccucauccagaggugagcugauaaaguaaaaacaaacaaaaacuacacccacacccacaccacccccacccccaccauuccccagcccuuucuuuagcagccuguauguuuccagcuaauagcuacuaccccugaaaucuuaugacuggcaaguucuauguaacuuccuucuguaacuuacuuucuuuugaaacagaucuuuguagaaguuugucguuagauaauuaucuaucuaacaguaauguuuuccuccugaagaaaaaugggcaguaauaaacuagucaaggauaaaaauccauguuuuuuuaugugaacuuuuaagacacucuaaaaauuuuaagagauuaaugcuugaaauaggguauuuuccucaccucaaguauguugucuuauauuaccccaccccuuuuuuaaggaaaaugauuugggauuuauauuuggaguuuuauuuuuguuuugugguuaauauaacauuaauggagguuggauccugggacaagagagccagugucaggcggauucuaaucuauauuaaaaucuuacaagaaccuaagcuaauuauguaauuuauuccagucucaucauauucaacgugucaauuagaaucaccacaccaaaguuucagggucgugguaaaaauuaauaagguauuggacguaaacuaaagcauaaggugaguacccauaaacgauaguaguaguuaacauuaugaugauucauuuuaaagucauguaauuuuaccuggccauuuucuagaauuuuuucacccucuuuuuaggaacgacuuagcugaauaucagagaacuugugaagaucuuaaagagcaacuaaagcauaaagaauuucuucuggcugcuaauacuuguaaccguguugguggucuuuguuugaaaugugcucagcaugaagcuguucuuucccaaacccauacuaauguucauaugcagaccaucgaaagacugguuaaguaaguaugcuucuacgcgcacggagacuuuggcaauauggaaaauucugccuuuaaaggggcauuguguucuucuagcccuaugcuaagucacaugugauuauuguuaaucuucaaauacaguggauuuuaaaagguuccuucauuauagcuuccuugaagacaaauggguggguucugccaugucaccaugucacuuugaacagaaaccaugccacuuugaacagauaauaguaucucuugguuucaguccaucuucaagugagagaauugaacuagacaguucuuuacgauucuguccaguucuaugaaucuaugauuacaaaucuaauacuauucuuagcaaaacugaguguaauagaaauuccuuugguuuugccauaucuuggauuuuucugcuguacuucagguagaaugaguuauuaccacaucuucaucaugugucuguuguaaggaguauuauaaggacccacuguaucccacuauugauauuugaggguuaacugagaacaaguuacagaugaccuuuuguguuguccaaguuuucgucuaagcugagugaaacaauucucuucguacaucuguuuuguuguuuucacuauuccagaggaggccuuuuccugugaaaauuuuauucuguggaaauugagaauuauuauguaauauagaacccaguggcaguuuauaguguauguucuuccaugcccccuacuuuucuuugugcucagugucaccucucucuaucugcugugcucacuuaaauaaccccagaucacuuccuuuuagaagaagucucucaucagcucugccccauuuuguccucaacugacuuagguuccuuucuucuguggucauuaaggucagaccgauuuugcuccauguccugaccuucaacaaauuccuuuucuucucugagccuggcaucuucuguuguuuggaggaaaauaccugcuucuucagauuuaagaccuuuuugggauuuuacuaaggcagguuagccugugaccagaaguacugcuuuugaaacugacugcuuggguucauauucugguucuacugccaacuuaccauggaaccuugcaaaaguuacuuaaccuuuuugugccucaauuuucucauuuuuaaaauggugacauaaguaccuaacucauagaguuaccuugaggggucacuagagaaaaccuauauaguacuuaaaacacuuccugacauauaguaaaugcucaguaaauauuaaaaccauucuguaccuucuauacucccaagaaugaucaauaugucuucuagcugugauuuccacacauggcuaacucacucagguugggggugaguugcuguuguuuucgaguuggggucucacuccuuugccaaggcuggaauguaauggcacaaucauagcucagugcaacuuugaacuucugugcucaagcgauccuccugccucagcuuccugaguaacugcggacaugugccgccacacccagcuaauuaaaaaaauuuuuuuugguagagauggggucucacuauguugcccaggcuguucuugaacuccugugauccucccaccucagcuucccaaaguauugggauuauagacauaagccaccacaccugaccuaaccuacuaauuguuauaugaacauagaauuuccaguguggacugacugguaguuuuuuauguuuguuuguuuuguuuuuguuuuuugagacggagucucucucuguugccaggcuggagugcaguggcgcaaucuuggcucucugcaaccucugcuucucggguucaagugauuuuccugccucagccucccgaguagcugggacuauaggcgcccaccaccaugcuuggcuaauuuuuguauuuuuaguaaagacgggguuucaccauguuggcuaggauggucucgaucucuugaccucaugauccacccgccuuggccucccaaagugcuggaauuacaagugugagccaccacgcccggcccgacugguaguuuuuaugaccuauacugcuugguucuguuuuuguuaaguauuuuaaguauucaauauguuguuaauuuauucauauagucucaauauaacuauuaaacauguauuaacuauuuucagauacaacuaaaaaauguaguaaacauuuauuauaugucaacgacugugcuaggagauuuaagaacaucauuuuuaaaaaucuucaagcguucaugagguacauauuauuacccccguuuuauagcuagggaaauugggguucagagaaguuaaaaauuugccuguuuauauuugaaaaacaagaacagagcuguaccuuacaaaaauaaauucaugguaguuuaaaggcucagauacaauucagacuauaaaagcauuagaaauaaauauaaaaaauaucuuauaauuguggguuauaguccuaaggaugacgugaaaaguggaagucauaagggaaaaaaagauacauuuguuucuauuaaaaaauaaauucccuuacaauaaaacauuacauauucaguuaaaaggcugagaaaaaauauuugcacuauacaugacaaaagaccaauagaauaaauuuccuuugaaacaaacaaaaaggacaagcugccuaguugcaaaguagguaaagaauagaaaucagugagcaauaaaagaggaagaugucagcauaugaaaauguauuuauucuauuaguauuugaggaaauacaauaaaaaaauuaaagaacaacccgucagacugacaaaauagaacaagauugauaauuucaagaguuggugaggucaugaguacacaaguauuuucacucugcugguggguucauaaauugguggaaauacuuuggaaguaaauuaguccuguccauucauauucaaauugugcacuucacuuuucaaaaucuacccucaagaaaaaacucaaguacaugcauaaugggguauguauagggaaugcuuuuugcagcauuguuuauaauuaugugaacaaccuaaauaucguucaaaggagaguaacuaaacaugguuuagauaaacuaugucauuuugugcauaguaugaaaaacggaaguaguucuauguguauuaauguuggaccaucuccaaaauauauuguugcaagaaaacaaaacaaaauggcuaaagauaaaucuaguaugaaaccuuuuguauuuuuuaaguccauauacaaccauacuacauuuuuccccuucgagguucauagauaugcacagaaaaauauuugaaaguguaaacacuaaauauuuaacagagauaaccacuagagagguggacgaaggcaaugaaauugaaagggugucaaauaggccuuuaacaauauugguaacuaauuuugcaaggagaauauaauuuaaaaauuaauuuuagaaagaggaaagcauauuaaaaguugcaaauaaaaagaggcagagcuuaaaacuagguagucuagcaaaacuaauaagccaggcauaguggcucaugccuguaaucccagcacuuugggagccugaugcaggaggaucacuugaggccagguguuugagaccagucugggcaacauagggaaacccugucucuacaaaaaauuuaaaaauuaaaaaaaaaaacucagccaagaaauaacaaguuauuauguugccuuuuauauuauccuucuagauuaugaaaaaauauuuuuaaaggaagcuauaauguuuugguuacuuccaagccuggcagucauucagaaauuaagauucuugaucaguuauguauuccuuugucucuauccuaaauuugagcucuuagccucuuaaaguaaaugucaaccuacuuaguucaauuuucugccuugucagcauaucauugucucauguucugcauuaaugacagaaaggauauuaaaccuauuaacacugagcggauucugcuuuuauugucaaugaauucuucuucuguaucauucucuuggccuaacuuaacuaaugcagagugcugaauauugagugcuaugcuaacuuugaagaguguccagcaccuuuuggguuuggauuucuaguuuuauguauaguuagaagccugcccccuccauaagcuguuaucauauuaccugaaugacuuuaacauggaauguuuaaaaaugauaccuuaaauaugauaaaucaaaaguuuccuuguaaaugugguauugugacagcagcuuucagcuccuuuguugcauccuuuagcauuuacuauuuugaauauauauucaugaaacaagaauggcuugauggccaggcaugguggcucacaccuguaaucccagcacuuugggaggcugaggcagguggaucaguugagaucaggaguuugagaccagccuggccaucauggugaaaccccaucucuacuaaaaauacaaaaauagcuggauguguuggugcacgccuguaaucccaguuaccugggaggcugaggcaggagaauugcuugaaccugggaggcggagguugcagugagccaagauugcgccacugcacuucagccugggcaacagaggaagaaccugucuccaaaaaaaaaaaaaaaaaaauaauggcuuguacaguugacaaggaggggaucaggcaugacuuggagaccaggccacccauauguuucuggugguuucuuaggacucaaggacuuuuuggagaauauacuuaacaacuauugaugacauuggauauauuuuuuauguugauuugaagucuucauauuguuuccgaccuuucgccuuucacuuggccucuuuaugccauaagggagguaagaguaacaguaaccucuuuuucuugcuuaaugaucaaaguaccuucacaugguaaccaagauggaacugcuuaaauuccuuucuguagcucacaguaccuuggagaaguuuauacuuuucaaaaaagagaaaagauuccaaggguacuuuucuggggcuuuaguccagcuugugauuuuggaguggaucauuggccugcucugcauagcuggcuuuaaaagacuacagcaggaacuucccagaaaugaggaacaaagaaauguuguagucagccuucuagacuuucuuuuuaaaaacgguguaguaacacuuauuagugauaccuaauaaugcuuaaaauuaauaauaacuggaguaauuuagaaauuauaagacauuucuuagccacuccacauuucaagguggagcucaugcauauacauuagaccaacucuuuugcuuaaacacuuggcugagauuguuaagggacuuucucaguccuuuuggcccugauugcugcgcuaaguuucuuaaauauuacaugcucauuagugcguguaaguacaugcuuuucaccccagaacacucaugaucuuuacgucaucuuucugccucagcugcucuuucaucuggaucauggaauguugcaggguuaacacaguguugcuggcuuugcgucaagaagcuccuugauuacauucaucaacacauucacaugguguuuccaagcacucauagaacauuugccauggaggaugguaauuuggagaacugcccuuucacucucacauugauaugccacaugugucuguacagcuucccauugugagagccucauucagguguggcucugggcuggaccuguggauugcgggaucuagagcaggacuguagcuaacugggcaguuacccuggguggcuggaaucggcuguuucugaaaggcagauuauauaaguagcacuguuagucccaggggauaagugggcuaaaaaaugaaagcucagacaagaugaagccagauggccacaggaauggaguaggaagcaaggccuuguguugaggagaggggacugccagcccagagcucuuucuaaaaaaauuauuugugggguugcuugcugcuauuuguuauguggacuggcugagucaaaacaaaaccaaaccaaaaccaagauuuaguaacaccugagugaaugaguagauaauccuaaauugccaaaaugacuaccuaccugcaagcuucccaggugggcucaaagcuaccuugaagcaugcguugcauuugccuuacagaaaggaggagugugucagcccagugguuacguggaguuugaguguaaucguuuuguggucucacuguugaaugaugggccuaacaagacaucuguauauuggaguuuuaucuuugauaauuuucugugguuccauagucuaaauuuggugaguuaauauucugaaacacuuuugaaccagaacgacugaacucuaguuucuaauucaaaauagguaauguuuucaguuuagaucaugaaauauuagaacugagagggagcuuuaccucaccucuuuugacaccauccuauagcagacucuuuauucauuuauuuguuuucuuguuguuuauucuguugagcaucuacugugugacaaacacuacucuugacaagaggauauucugaaaauagauaaagucuauuaaacguaaguuucccauaagcagcaaguuuguuagauuuuuauccuguuguggaucugucuguuugcauacuuauaaacacugagcuuuuuugaucauucuuuuuugagauggagucuugcucugucaccuaggcuagagugcaguggcacgaucucagcucacugcaacuuccaccucccagguucaagcaauucuugugccucagccucccaaguagcugggacuacaggugcgcacuaccacacccagcuaauuuuuguauuuuuaauagagacagaguuucagcauguuggucaggcuggucuggaacuccugaccucaagugauccgcccaccucggccucccaaaguguuggaauuacaggcgugagccacugcgccuggccuuuuuuguucauucuuuuuccuuggaacuuuggcuuuggugacugcaugguaucaggaacagauaagaaucucauugaauaguuacuuuugcucuucauuaagucuuagugauuuaagaaaggugacuguaagaugccuauauugacuugcuguccuuaaagagugaauuuuucuuuucuuuuagaaucauagauccuaacuggauugcauauccuugauaaagcuagaccccuuuuacguuauagaacuuuuauggaaaugcaaauagacacauauucaauuuugcugguguuuauuuuuuuacuuaacuaggauaauuuaaucuugccuugauucuuccacuuuuuuacauaguaauuguguuugauuauauucgauuaaaacaauuuacuucuuuuuucauuuccuuggaagaaaaauuauuuuuaucaauuuaaaacaaaucaggaaauucuaaagugaagaucacucugcuuccaugaauuuuauauuugcagcaacuuauucuuuuuuaaacaaaaagggcuuuuaugaaacugcuaauaauuguaacuuuguucaguauuacauguuucuucaaauguggcugcuuuccaaauaccacaaauaguuuauuuuaccuuuaagagauguuuuaaauugaaucauugguuaauucugaaaguaauucaagcagaguuuauaauccucuacacuaugacucuuuaaaacuugcuaauuaaaaaaaaaucauaguuggcccuuuucucauaguuuagaccuuggcaaugaaaaggaaacugcaagcauuuauuucaaaugaauuugaaaccgugguuuagucuucaacucuuuaacaaaacagggaacaccauauguaacaguccagcauacauuuuuugcuuuuuaugucuugaaaguuuccugccucacuuucucuuugucuacuggauauuuuuauucaguugauaaauugcaaauauccuagaauauuuuauaugggacuuauuuaaucaaugagauuguauccuugcuauuuuacaugccagagcauuuuggcauuugguucacuucuacucccaauaaacagcuuaggauagaguacuucugagaauugcugaagaagggugggucuuggcaaugaucaaacccagugggauaagauuguguuaaauugugaauguuauaugcauagccaggagauuggaggaguucaacaguacuaaucauugagcaacaacaaguguucauaaguaacugaaagaauguaauugaaagagaagugcaaaaaagaggauuguggagaaagauaaaaaggaaaggacauauauuuguucaaguaaaugagaggagaaucugcugcauggacaaagccucaguccuuccuuaaaauguugacugcuaccuugauuuacaauucguaccuucccuacuuugcugcauuuuuccuuuucagcaccuccccccacuuuuaaaaaacuaauuugcucuucucugggcuuuccccugcagcccucuccacaauagaugauugucccgcacagaugccguccugccacgaaggcucuuagccuuucuggcugcuccgcccgccgcucgccaagugaggacagagggucuuucucuggggugugcuuuauuucauaugugcucagccggccuacccuggcucuucuaauacauauuaaugcuuuucucucccugacuuaugaggacaggaucguuugaucauuucuuguuuugaauguucuuuuugugcugacagagaaagagaugacuugaugucugcacuaguuuccguaaggagcagcuuggcagauacgcagcaaagagaagcaagugcuuaugaacaggugaaacaaguuuugcaaauaucugaggaagccaauuuugaaaaaaccaaggcaagucuaauaagaugcaaauaaaagugucuuucuuuuuuuuuucuuuuuucuucugaguauuuauuugguuauucuucuauaacuaaacuuuguuuuucaaacacacaaagugaauuaucaaucuguuaauguugacuuuucugaauuaaacaaauuugcuauuuggagaauucuuacugcucugcaaauacuguuguuguaucacuguucagagaauguaguacaguauaauacuuugagagaccuauaugcuuaaucuuuuuauuugcugauaauuugcaaugcugcaaaaaucuuaacacccaggcauuaguuuguauguguucguauaugacuaaagacaaauguuuuuccucaauaauugggaaguuuugagaaaauccaaauauaccaaagacaauaauauauacauauuuaguagcauuuuuuuuuuuuuuuuuuugagacagagucuugcccugucgcccaggcuggagugcaauggcacgauuucggcucacagcaaccucuuccuccuggguucaagugauucuccugccucagccucccaaguagcugggauuacagacacgggccaucaugcccagcuaauuuuuguauuuuuagcagagaugguguuucaccauguuagccaggcuggucuggaacucaugaccucaggugaucugcccaucucguccucccaaagugcugagauuacaggcgugagccacugcgcccggucuuaguagcaucuuugagucuggacuuacuguaagguaacucaaacauacuuaaugagaauaacaguuuauacuuagugaucggacgguguuauaggcacuuugaagaauaggagguuacuguugauucauuacuguauuugggggccacaccguaauccguuaaaguugcauguauuuucccuagacacacuagcauacaauucaaguucuuaauggccacguguagcaaauauuggacagugcagauauagagcauuuucauuaucaugaaaaguuuuguuggauagcacuggucuaaaccauauaugaaucucaguguuuuauuaaaauauuagggcuacauuacugaguauaugcccagaggaauauaaaucauucugcugcaaagacacaugcaugugaauugucauugcagcacccuucacaauagcaaacguaaacgauggaauugauggaaucaaccgaaauugacggaaucaaucuaaauguucaucacugacagauuguauaaagaaaauguggaacauggacaccauggaauaguaugcagccauaaaaagaaugagauccgaucuuuugcaggaacaugcauggagccggagacaguuauccuuagcaaacuaacgcaggaacagaaagccaaauacugcauauucuuacguauaagugggagcuaaaugauaagaacuuaugagcacaaaguaggaaaccacagacaguggcaucuccuugaggauauagggugggagcagggagaggagcagaagagaucacuauuggguacugggcuuaauaccugggugauaaaauaaucuguauaacaaaaccccgugacaugaguuugccuauguaacaaaccuucacauguacccccgaaccuaaaauaaaaguuaaaaaaaaauuagggcuauucaauucugcauuaagccucuugucagccauugcuauguccauuugucuuuauccaguucauccauaacucuucccguuugacccucaugccuuuugaaacuuagguucaguuaugaccaaacuccccaacauacuguuuccucagacucuccuguuucuucauuuguugugagcucuagcugucccucaaugccauguuucaaaaccuucagugaaggcccuugugucagucaagucgucucaggugggugugauggaggaaaccgcaguuacuucacuccugacugccauuuccagggcuuuguuuuggcacuuacucucagguccuauuccucuuugaaauuaagcuaccgcucuguguuaaucuguuuugcauugcuauaaagaaagagcagagauugguaauuuauaaagagaaguaagugguuuauuuuggcucauguugugcaggcugcauacgaagcauggugccaacauaugcuucugguaaggccucaggaagauuucacucugacagcaggcagaggggagcaagccucacaagggagcaggacugagcgaggaggagaggggccaggcccuuucuaacaaucagaccucaggauaacuaauagggcaccaagccauucaugagggauccacccccaugacccaaacaccucccaccaggccccaccuccaacacuggaagucacauuucaacaugagagauuuggagaggacagguauccaaaccauaucacacuccucuuugaaaucaguguugucucucuccucccuaaucaauaaaaucucucaauugagaaggcucucuuugacccuuucuauuuuauuuuuauuuuuauuaucauuuuuuugagacagaguuucauucuuguugcccaggcuggagugcaauggcgcaaucucagcucacuguaaccucagcuuccuggaaucaagugauucucccaccucagccucccaaguagcugggauuacaggcaugcgccaccaugccuggcuaauuuuguuuuuuuaguagagacaggguuucacaauguuggccaggcuggucucaaacuccugagcucaggugaugcacccaucuuggccucccaaagugcugggauuacaggcgugagccaccgcgccuggccccuuuuuaaaaguuuuaacaucugauccuuuuccucuucauucuaucucuuucaucauccuuaaauguuugaauuuccauguugcugauacacaaaacacuaauacucuucagcuuccuuaacucuacuauauccccuacuucuacgcuaacauccugcaugaacugaaaugccccuaagaucucucugaaaccacacucucugacuagggccuuugcucuucuuuccucccuaucaaaguuaaaucuacuccaugucuucauuuucaccucuaguucuucagcauucuuucuuuuuaucucucauuuuaucuguuguguccaggcuggucuucuuuucuucccauuuaaacauaaauuuuaccaucucaaauugaacucacacauucacucucccaaaucugcugccccuucuguauucucuuacuggauggcacuuuuacucacuaacaugcucugaucagaaaacuggauuucacccuguccuucaccccuaacuuuuaaccagucacuaaguacagaucugaguuucuaacguuuucuugaauucuuucccucauuaacacuuuucuuauggaagcuaaguaaucucuggauuuaucuauuacacuucuuccuagcuugccucccuccuucguuccacucccuacacugcagccagaagcgaucuuucuuaaagacacauuugaucaugugacucugauuuaaaauucuucggugaauuuucacugccuucaagacagucuccacauucuuucccaugcccguggucuguccuaauguggcucccuuuugcccuccaaggcugcugcuuuuuuccuccucucgcgcccugucucccaguacacucagcuaucgucaaaggcaggagggcuuagggggugaacaugggcuuacuagaguuagccagacuuagauucaacuucuggccccaccauucacuggcugugugaccuuggacgaguuacuuuaacuucucugugccccaguuuuuccucaucuguaaaauggagaaauaugugacuccuaggauugugaaugaggacugcauuuuaaaauguauauugguuaucuuauacaaacccaggcaggcacaaaauauuucucaauaaauagcggugguggugauaacccugcugauuaucccauccucucuccagccucugagucuuuguaugugccaugugcauucuucucugcuccacugccuguauauuacuuuagccuuacuuaucuuagccuacaugguacucccucuaggaaaccucuuaucucuucugucuagauucgauguacccuuuauaugccuuuauagcaggguuuuucaaccuuggugcuauugacauuuugggcuauguaacucuuugcuuuggaugcuguucugcacauuguaggauguuuagaagccucuaccuacucaaugcuaguagcuuacccuccucccccaaguugugacaacugaagaugucuccauacauugccaaauguccucuggugggcacauuuaccuccauuugagaaccacuacuuauauagcauuuaucaaaauguauuauuauugcuuguuugucuguauccuucauuaaacuuuuaaaaaaauauuucagcuuuuaguuuugaaagagggguacauguguaggauuguuacauaugguggacccagguauugagcauagugccccauagguacuuuuccagcccaugccccccucucuccucccccaaguugucugcagugucuguugcugccacgcuuauguccauguguacacaauguuuagcucccauuuauaaaugagagcauaugguguuugguuuccuguuacugcauuacuuugcuuaggauuaugucuuccagcuacaucuauguugcugcaaagcacaugauuucauucuuuuuuauggauguauacauucccugguguauauguaccacauuuucuuuauccaaucugccauuuaugggcaccuaaguugauuccaugucuuuuuuuuugagauagaaucuuguucuguugcccaagcuggagugcaguggugugaucuugguucacuguaaccuccgccuccagauucaagugauucuucugucucagccucccgaguagcugggauuacaggugugcaccaucacgccuggcuaauuuuuguguuuuuaguaaagacagcguuuugccauguuggccaggcugguauugaacuccugaccucaagugauccacccgccuccgccucccaaagugccgggauuacuggcgugagccaccaugcccggccucuaugucuuugcuauugugaauaaugcagugaugaacauuugaguugauguaucuuuuugguauaaugauauauaucccuugggguauauacccaggaaugggauugcuguguugaaugguagcucuauauuaaguucuuugagaaaucucuguuaaacuuuaaaauugucaccaagccaagggcuugcuucccuaugcacauagaagccaaugcuacggcacuggcuuuuaagaaaagaaaaggcuuuauugcaaguugacuggcaaggaggcaagaggccacacucaaaucugucuccucguucugcggcaagaucaggaagauugguuucagagguguuucuaaguagccccaggugauaccagugcagccagucugccaggguggugguaaucacaaugaggagguuaaaccucucauguaccccagaaauauaugcaucuacuauguacucaacaaaaauuaaaaauaaaguaaaaacaauuaggagguuaaagcuuuuucccauugcacaugccuggacuacaugacuugcaauuuuggcucagugcuaucuguaacaacuuaaacaaugguuaaucagucugcacuagucccuugguuacaaaaucucugguguuacggaauuucuccacccugaucacuguuaaauccguagcaucuugcguagaucucaacacauaauaaauagguacucaguaaauauccacugaggaaggaaauugcaacucaguucucacuagcacucuacagugccuuuauucuuaucuuuccagcuuaccuacuuugccagcaaaaguacccagugaaaauuaggcccaaucacacuuuuuuuuuuuuuuaauagcuaguucaagccucccaagcauugcuaaaggaagucauuuaacaaagccacuuaauagccgggcgcaguggcucacgccuguaaucucagcacuuugggaggcugaggcaggcagaucacgaggucaagagauugagaccauccuggccaauguggugagaccccgucucuacuaaaaauacaaaaauuaacugggcaugguggugugcgccuguagucccagcuacucgggaggcugaggcaggagaauugcuugaacccgggaggcagagguugcagugagcugagaucacgccacugcacuccagccuggcagcagagugagacuccaucuuaaaaaaaaaaaaaagccacuuaaugaguuccacugaagaguaauacuagucaccuucagugguuguagguacuguugaacaauucuuuucucugcaguugaagaccuuauauacucuagucaggaacuccacuuuccucacuuuuccaacuccacugcuggcacgucacuuucuucggaugaccuacuucucacuuuacuaagauuaggaccaacugacaagagccuccucagcaucuucucaucccucgaaugucuccucuccuuauuucuccuuucuuuucuggcccucuuauuucccaagaugaacaucuuucuccccguuuuugaugucucccacuucuaugucaucacauuuuucuugcauccuuuauccuuuucucuccacuguuuuucccccucauccugcccacagccuuuguuuaaguaaacaaaaagcagcuuuccugugaucaucuuucacuucguuuauuaccguccauuccucauuucacuggcagacaucucacaacaguuguccacccugguagcuuuccuuucacuucugagugcaucgcagccaggcuuugaacaaacuguagccugauuuuauguuacugaagugcucgcuucaugaucacuggucacuuccugauuaccaaacccagugaccucaucucaauccucauuggacuuaaacucuauagauuuggaacccuguuaacuggccuaucauaacauaccaucucuuucccuugauuuagcugauauguuacucucauggguccacauuguaccauucuugucuacucuuaagucucuuuuaacuuguuucuugguuuccacaagucuuaaguguggacguuccucagaguuaguucccagcccuccucccauguugccuugacuuccugggauucauuucuccucacguggccaaauauuaccagugaauacacccacauuaugccuuuagcuuuaacugcucuccugagccccagcccuacguguuuugcugcuacuagaucuuuuuuuauggaugauacacugcuggcgucugaaacucuacacaaccaaaccguucauuggcuccgccuucccaucuaccacuccuuuucuuucuaccauuuucucuaugaucgucuucaaacaaaggcaucaccaucuucaccgcaguccuggcuugcauucuuuaaaacaucucgguucuucccuaugcuugcucuugacauuccaucaguucccaaggucuuucucucucucuucagagucaaauuucuauuuaacuaugccuaccuuuucauucuuauaccacugcccugguucaaggcuucacaucuucacaugcuuuuuuuuuuuuuuuuuuuuucagagacagggccucacucugucacccaggcucaguggugcggucauaucucacuacagccuugcacuccugagcucagcugauucucccuccuuagccccgcaaagugcugggauuacaggugugagccaccguguccagugguauacuucacguauucuuauaccaaguaugcagacaauuacaauagcuuucuaauugguuucccucaaauuucaucuaauuccagcauacuuuucacagugcucucauaacauuuauaguuccugaguuauaaaucucccuguuuagguagcuccccucuugcaguagaauaaaagacaaaucuggccccauucuaacuuugcuagucuucucuuucacucuacucuuucaugucaccuucacuguuuccagaacaugaccugcaguuggccauuuucauugauuugcacaugcuguauuuuucugccuuguaauaaucuaugaaguaucuguucaaucuaugaggcucaacucaaguggcagucuuccugaaguuuuccccagccccuucuuguuugaauuaacuucuuuuuccucuguauuccuguugaugugguguauaauuuugguaguuguuuacacaguuuucuccaccagaagaccuugaaaucaggucugugacaucuaucauuguauuucacacaugaccauuuacgucuuaauuaacaauaaauguuuguucaguggaagucaauuauuauuaaugugaaauuuguaauuaauuuuuuaaaaaauuuaauaacugagagcaagcaacacuauuguucauuaggaaucuauagcauuuucaguaaauuaguaauaaugaaugcaaggacaaaauguauugcaagucuaguacuuuuuaucuagaagguauguugaaacacacuagaauuuuugcuuucuaagugcauuaaaaagccaggugguauacauauuuuaauuuaaaacccaacuacuuauauuacugagugaugaaaugguuacuugguuuaguuccuugacguuuguugccaucuaguguggcauuuggguaucacaugcuaaauagaaggaauuauauauuuacauucuuuguggcagugaaaaugccugaggauuuuauaagaaaauaaauauauaacuugagaaguauauaaugccaugcaaacauucuuguguggaacuaccuuggauaaacucccuacucucaccacuuucuaggucucugauuugggcaaguuacugaaugucucaaaguaccaguuucuucaauugagugauaagaaccaauuaaaauguauugagaggguuaaauaauccauguauaccacuuagcaaaguaucuggcaccuaguaggugcucaauaaauauuuuuguuugaaaauggaaguuauuucaauuggugauaauuuuaaaagaggaaaagaauucaccugggacuaaauggagagaaaaaguagaggcuugugcagucacaccuugauaaaaagcuacacgaagcagaugaaaagguuaaccaggccuuaggccugccugcuuguguuggaagggaaauuguugagagguauguguaaaggccugaaggcacaggcuguggcaugaaguuaccauaagcauaucuguaaugauauaacccucuaaggaaaaaaaaaauuuucuuuuuuacucauaacaacuugaacaaaguauguauuuccaauuugcuaagaccuauccugccauauaucuuuguggguaaguggugugaacuuuuuaaaaaaguuaauuauuauguauacauaauaauuguacauauuuauggguuacaugugauauucugaagauuaguuuuuaaaacagcagccugguagguugaacaaauauuuacaaagacuuuuucucccuuuucaaauauccaaauuauucuguuucuuggauuacagggagucagaaaggcaggaauuagaaaccuggauuaaaaauaaaaucagaaaagcauugacuauuugguuauagucacaaggauagaaaauaacgcuucuugauuugcacauuaucugucccaaaagaaguguaaauaucuugaaaaaugguacauagggauagacugauaaauuucugguuagcaaggguuuauaaauuaaaaucaauaguuugcauuauucauaaguuagauguuugaaauguguuaaucuuuuuaauuuugugggcuuuauucauaaaaauaaaaauguuuguaagcuuuaaaguuuauguucaaaggugugagcuguauauuuuucauaagaucuuaauuccuuaguuaugaauuauucugucacaaagauuucuugaaaacuaacccuagcaguugggaaggacuuuuauaugaucuacaauagguuuccuguuuuaaaauuuuaguugacuagauauaaauuuuguuuucgaaaauauuuugacugccuaagauaguagugccuacccuuuggcuuaauaaaaccaggacugggaauaucaaguccaauaaacuguguuugaaaaaaaguguuaauaugucaacacagaaugaccacagcuaaagaaauuucccagaaaagaaaagguaccuucaggaaugagucugcuggguggggggaauguauaauuccccaacuucucaagaccuacagccauuuccaccaaggaaagggccguguucagggaaagggagagaagccaggacuugggaacuacugagagaaauaacagccgcaggccccaaauuaacuuugucaccuauaaagaucuaucauuuaaugguaauugccuguuuauagcauucaguuacuauaaaauuauaauuuauaauuuuauagaaauuaaaauuauaauuuauaauuuuauagaaauuaaaauuauaauuauaauuuuauagaaauuaaaauuauaauuauaauuuuauagaaauuaaaauuauaauuuauaauuuuauagaaauuuauaauuuuauagaaguuaaaauuauaauuuauaauuuuguagaaauuaaaauuauaauuauaauuuuguagaaauuaaaauuauaauuuauaauuuuguagaaauuaaaauuauaauuuauaauuuuguagaaauuaaaauuauaaucauuugaugauaguugauuguuuacugaccuagccuuugagaagucaguuauuaugucuuuacugaaugguuauagggguacucaaucgacagggauucugaaacuaggagaagaaacucuagaauuaagagagagcuuuaauggagauaguguauaaauaauuguuuacuagacccaaaucuuuuaguaugugcgguccagugugagagaguuaucuuuagaaagaauaaaucauuuuucugauuccaaguguuacuacgcuuuucuguuuucuucacugugaccggacauauacguuaaaaucaaagcaaauaaaaguaaaagcuauuuuuguuuguuuguuuguuuuguuuguuuguuuuugagauggagucucgcucugucgcccaggcuguagugcaguggugcgaucucagcucacugcaagcuccgccucccggguucacgccauucuccugccucagccuccugaguagcugggacuacaggugcccgccgccacacccggcuaauuuuuuguguuuuuaguagagacagaguuucaccguguuagccaggauggucucgaucuccugaccucgugauccgccugccucagccucccaaagugcugggauuaaagacaugagccacugugcccggccuuagaagcuauuugauaauauggaauuguugguuacacgcuaagagacaucaguaaccaguuuuuuguuuguuuguuuguuuuguguguuuuuuggggacggagucacacucuguugcccaggcuggagugcaguggcaccaucuuggcucacugcaaccuccgccuccuggguuuaagcgauucuccugccucagccucccuaguagcugggauuacaggcacgcaccaccuggcucagcuaauuuucauauuuuaguaggacgggguuucaccauguuggccuggcuggucucaaccuccugaccucaagcaauccacccgccucagccuuccaaagugcugggauuacaggcgugagccaccacgcccagccaauaaccaguuuuuaaccuaauauuuuuauucaguguuuuguugcccauuacucaucaucagccauuggugguggccauuccuaauagagagaagaccauccacaaaaccaaggccucagcagugguuuuguuuacaugauuuuacagcuucucacuuugugcuuuucacuguaucauccuaucuuggcauuacaccucuuauccugccaggauuauuuacuguugcuuguucuuuaguugacugaguucuuugaauugauucuguaggugccuuucaugguagccugguuuuagaucuucagucucuucugcuguuccuauacuuaaugaugaugacuccugaguuuuuguucaguugaaaacuuucugauuggauauauugguuuauauuaaguaagcguuuugucuauucauaccaguagcauucaugauaucagggagaguuaugaacauuuacucaauucaugugaaauauuuuucacaagagcaauuacauuuugaaucacaaaaguaacucauucauauuucaagcuccaagggcuuaaauuauagaaaaaguaugccuuuucauuuauuuuaauaucuaauuuaaaauuuccuuuuccaggcauucucggcuggaauuuugacuugggacuaauucccuagaagaaucacuuuuuacucauuguauuuguuuauuaguuaaucugagacaacugaauuuuaccuuuauauuuuaugccugggagcauagaaacuuuucagaagagaccaaaagaaacuggaguuuaaugcuuuccagaugaagagaggaaaauucacauauccuagauauuuauugucuguauuuauuauagcuuucaccagagggaagcauaacuaugcauaaaacuuacagugcuuacuaaggccauuuccaucuccauuaaaaucaaaugugacuaugaaauuucuaaucauacagcauguaagucacaugagaccugggguucuuucuaccauuucaggggaaaagagagguugugugagguggauauuguacauaagggccacuggaauaagacuauaagauacuauaguaccuuacuuuuauuaggauuuuuaaaaauugggauuuuacuaugcaaucuguguauguaacuaaauuacauuuguaccccauauauuuauacaaaaaaagaccuccccaaauugggauuuuugaagucauauuucauuauuggguguuauaaauaaagauauuguaaaaguggccaaaaugaaguuagagauuuuuuauuucuggaaaugcagagugggaaauuuacaguaaaggacaaucaugaacuuuaccagaaguggaagauccuuauaaaacuaaguagugaauacugucuugagucuuuccauuuaacuuacgauuauuacauaauuuuuacuucaguuguauguuuaaggggagugaacuaaauuuucucuuaguuauauuuaaggaaacuugauuauuauauaguauuaaacaaaagaugccuguguguaaugauauauucaacauuucauuuuaguauuuugaucuaucauuugaaguauuccaauaauuuuuauccaugagcaaauaagaaaucaguuaaauuggauacuuacguauuucguguaguauaaacaugauauauaauugaaaauauuagaacacuugguguuucugguucccuuuuuuaaaauucugacucaucuguggccgucaucaagguucauuaccugaauuuugucauugauuaauuaauauggcuuuaaucaugaaaauugaaauaugucaauaaauguaacauuuggauacucuuuuaggucaauaagugguauugauaaacaauaaaaaauuauucuaaugggcuuuauagugaguuuuugcuauuuuaaauauacuuaaagcuuaauuaugucauuuuaccuauauuuuuuccaaauucuaaccuccucuuucaaucuguucuauccuggcaggcuuuaauccagugugaccaguugaggaaggagcuggagaggcaggcggagcgacuugaaaaagaacuugcaucucagcaagagaaaagggccauugagaaagacaugaugaaaaaggaaauaacgaaagaaagggaguacaugggaucaaagguacuuaaggacucugcuguuauccacauugcagaagaaagguuuuuuaugaugccauugaugauuccauaggcuggaguucuugaaugaacuuuaaauuuuaaaaucguuauuauauaaguaguuaaauuucguauaauuuagaauucauaaaaauguuuuaucuuuucauauauuucucaauaguuuaugcugaucuuuucaaauaaaauaaucaguuagauuccauacaaugaaauuacaaaauuuacuuuaaauccugccauucuguuggauucccucucucguguuucccagagucgugcuaugaagauacccagauuuuauuucaaccuuggcuaaaucaaggagagaugacuuccccugcauuaucuccuaccccuaaauuaaauaugcagaagaugaaacacuuguaaggaacugaguaaccaagaaaaagugauuaugcacucuguaugaaaucaguucugacaaauuacaugaugaauaaugacgguaaccagaugaagggagagauuuaaggcaaaaggaacagauaacaugaaacaagcaguguuugaaaaggaguucacaaacuagaauacagaguugagugggaccuagcuuuaaaauugcuaacuagacucgaauugagcaaguugugguccaucaaguaaccaaaacaacuguguuacauguuuguuuuuaaaaguggacucacagcuuguacucuaaaugcuauguuguuaucagauucaaugugugauaauuaacuuauucaguaaguauauacugaguaugugcugugugcaaagcaauguggaggccuaaagauauguaaagagaaaaaucacaacuucugcccuaugaguuuuaagucuuaauaagaguaaacucaggcauuuccuguaaauguccuugucuucuuauccauuuuuaaaaauugugucugucaaaacccuacuaccuaccuucucugcccuggauuggugaucucugcugguaaaaaucacacagccuugcagaugacauggcuguagacuccaggucuucgguguccacgguccuuucagugcuuucuagcaguccucuuuugccuuccucucucuuauucauuccacacucaacagauauuaaccagaggggcugggaauguuguagucacaggaacgaugcaguuuccucaugaagcuuacaaacucguaggagaaguagauguuacacaaauguuuucauaagugaguuuucgaucaucauugugauaaagccauaagguucgguuuaggauaucgugggaauguguaacaggaaucugaccuugucuaggcagucacgaaagacuuuccugaguaagagauguugaaaaugagaccugaaagcauugaugaauggacaggugaagaggggaagaggguuucaggcccaggaauauaacacacccaagacucuggaccuggaaagcaucgcacuuucuaggaauuuggagaaggcccugauggguggagcauagagagagaggagcagaguagugggaaugaguuuggagaauuauguugggauggaaucaugaauggcuuuaaaauccauaugaaggauuuucaauuuuguccaaaaagggauggaaagccauugaauggcuuugaauuugucagugucacgaugccauuuauauuugagaaaaaucauuuugucaguggauuggaaggagaagcagaauagaugccuggagaucagcuggaggucauuaucguaguccaggucuggaggugacucacaguccaggucuggaggugauuaucauaaucccccucuggaggugauuaucauaauccagcucuggaggugauuuucgcaguccaggucuggaggugauuaucacggucccggucuggaggugauuauugcuguccaggucugcaggugauuauugcggucucagucuggaggugauuaucacagacccggucuggaggugauuaucgcggucccggucuggaggugauuaucgcaguccaggucuggaggugauuuucgcgguccaggucuggaggugauuuucgcgguccaggucuggaggugauuauugugguccgggucuggaggugauuaucguggucccggucuggaggugguuaucguaguccaggucuggaggugauuaucguggucccggucuggaggugguuaucguaguccaggucuggaggugauuaucguaguccaggucuggaggugauuaucguaguccaggugggaagugaugguaucuuaaaugcauuucuuuaaagacuguuucaaaucacuuguucuucucaaauucucuauaauaccauuuuuccucuuauucucagcagagagccuuacuuaacuaacaaagaaaauggaagccguugggugaugaccaccucaacuauuucucuuguccaugccuuaaaauaaauuuucaccuguauuccaacccagucugaaugggaaaggugucuuccuaaucccuuccccuucccauggaccucgucuccuuucacccccucaaggaacucauuccauuuguuuguuccacuuuucugaaucaaucuuuccuucacuacagucucuuucuuauccucaggaaaauauuuucagaugucucuuacuguugaaaggaacaaucuuucuucuaaucugugguucuuaauuuuuggcacgcaagaaguucuaaaaaucugauuguccaaacaguaccccacacccauuacaucaaaaugucugagagaagcauccaggugucaguguguuugaaacucaccuaggugauuccaaugugcagccaagguuggaaaccacgucaguaauuccaucucccucuuugacucuuucucuuaauagucgaguuucuugaaagauuuguccauacauguugucuuuauuuugucaccucucacuuacucuucagcccacugcauuucaacuuccaugccacagccagugaaauuaccauugcuauguucacugaagaucuguuuacacuauauuuacugauuuuuuuucagucuuauucuccuuaaaagauucucuaugauuucuuugaauucauauucuugauuugggagaaugaugaugugugcuuuuuacauuacucugaguuuaaagugccuuugagacaauaaaggagacacauccagaaagcagcuugauaggagguucuggaguuuagcagggagcuaaagauuuaggugucuuuagcaguacuauagcuugaauuccauguauauauagccuuaggaccuaaagcuucaagacuaaagcuauuugauuucuagauccuuaacuguauacugagcucccaaaccagcuuuacuuuccaccuccuaucccaguggauccacuauuuauccaguuauccagcacagaaaucuugucacccuuuucucccccgucuuucucaccccacacaucucaucaucaccaggcucuaagacuuaagccccugagcauuuacauugccuugucucucuauccuacugcuaccauaucucauccuuggaugguuccuauagccccugugguguccuugccuccagucucaccuccuuccuaucuguucuccaaacugcagcugggaugaucuuucucaauaugucagucucuugcuuuaaaacuccuuucacgucucccugcaaccuugaauaaaauuuaggauccuuuaucauagcaugaagacucuacaauauuguuccucucuuuggcucuccggucuuauguuccuucauuuuucuucuuugcacccucaccacacugaccuacuugugcuuccccaagcauguacauaugccucucuuccauacuguuuuuuccagugcaggauauugcaugugcuuugcccucugccuagaggagucuuccucugcccucuuuaacugauucuucagaguuguuuguuuguuuguuuguuuguauuugagacagggucucacucugucacccaggcuggagcucagugggguguucacagcucacuuagccucgaccacuugagcucagguaauccucccaccucagcuucccagguagcugggacuagagaggugugccaccaugccuggcuaauuguguuuuuuauagagacagguuuuugccauguugcccaggcugaucgcgaacuccuggggucaagcaauguacccuccuuggccacucaacgugcuaggauuacaggcgugagccacugcgcguggcccagaacuuuucuugguaccaccucgucuccgcgccucccauagcugaauugggaccgucuccugugggcucccauagcucacuucauuacaaauucaugucgaauagcuugccuccccuaguucagugagucccuugcauguaacauccucaaugccuggcacauuccucucauguaaaaugugcucaguauauauuagaugaaugaaggaaugaauuacaaggaaaagaaaaaagucccuaugccauugggaaguuauggcuaaaaugcugagaguucagaggaucagaacugauugucugcaagagaucauggaaggcuuuggggaaaaaauggcauuuucguugagcuuccaagaauagaugggguuuagaaacgcagaguaugggggaaggaacgccaccuguaaccaauaugaauaagacauggaagggagaugaaguugcgaauugaguguugugugagagagaaugguaucaauagcaaacaccagcuauuguucacgccuaggaaauuuguauuuuuugguuguuugcuggaaaccauuugccuugcugaguaguucuacuguguagaaguauguugaugagaauuccugauaagaaaggaaaaacgaaggcugaagugugccuggcaguauuccaggugccuucauauguaacagaaccucucuuuuacugacaguuguuucaugaauaaagguggugacagaaaugcagcacauuuuuuauguaucauuuauuuauuuauuuauuuuuaacuuuuagauucaagggaguacaugugcagguuuuuuacuuguguauaucgcaugaugcugagguuugguuuacaaauuaucuugucacccccuacauaagcauaguacccaauaguuaguuuuucaaccccuaccccacucccucccucuccucucuagucauccccaguuucuguuguugcuaucuuuauauccgugaguaccuaauacuuagcucccacuugugagugagaacaugcaguauuggauuuucuguuccugcguuaauucacuuaggacuacggccuccacuugcguccauguuccugccaaagaccugauuccauucuuuuuuauggcugcauaguauucagugguguauauguaccacauuuucuuuauccaguccauucuugaugggcaccuagguugauuccaugucuuugcuauugugaauggugcuacaaugaacauguaaguacaugugucuuuuugguaagacaauuuguuuucuguugaauauauauccaguaaugggauuucugguagaaugguagguucuaaguuauuugagaaauuuccaaacugcuuuccacuguggcugaacuaauguacauuccaccaacagagcagaaguguccuuuucucugcauggucuguuguuuuuugaguuuugaauaacagccauucugacuggugugaaaugggaucucauugugguuuugauuugcauuucuaugaugauuaguguuuuagucuguucucgcacugcuauaaagaaauaccugaaacugggugauuuauaaagaaaagagcuuuaauuggcucaugguucugcaggcugaacgggaagaauggcuggggaggccucaggaaacuuucagucaugguggaagggaagcaggcaugucuucugugguuggagcaggaggaagagagagcagggggaagcgcuacacacuuuuaaacagccagaucuuguaagaacucgcuaucaugagaacagccagggggaaacugccccgacgauccaaucaccucccaccaggccccccuccaacaucggggauuacagugugaugugagaguugggcgggggcagaaguccaaaccauaucauucaugagugaucuugagcacuuuuucauguuuguuggccauuuguauguauucuuuugagaagugucuguucaugucuuuuguucauuuuuuaaugggguuguuuucugcuuguucaauuguuuacuuucuuuauagauucuggauauuaggccuuugucugauacauaauuuguggguacuuucucccauucuguagguugucuguuuacucuguugauaguuucuuuugcugugcagaagcucuuugguguaauuaggucccacuugucaauugguggguuuuguugcaauugcuuuugagaacuuagucauaaauucuuucccaaggcccauguaggaaacacccggaaugguguuuccuagguuuucagcuaggauuuuuauaguuugauaucuuacauuuaaaucuucaauucaucuagggucaauuuuuguauaugguaaaggguaaaagcccaguuucauucuucugcauauggcuagccagcuauccuagcaccauuuauugaauagggaauccuuuccccauugcacauuuuugucaaguuugucaaagaucagauggcuguauguguguggcuuuauuucuggaucucuauucgauacaauacauaucugagcuagagucauugaaguugauuuugucccuaguaagcccuggcugacauuugaucucaagauccugcucuaaauaaagauguaugaauaaagagcucacagugguccuagcacugaggucccagcucucaccaggaaauggcagaaagugguuuuggaguaaaaggauuuagaguugaauccagcuugaccuuucugugaccuugaacaauucacuuaaccucucuaaguuucagaggaguaaauaaaguuaauaauacaucaagaauugauaggauuaagugagauaauguuuagaaaauaucuaauauaaugucugacuuaccgugggcauuuaauaaauuuuagcuuguggcuguuguuuuagagaaagagagacggagccuucuuggauagauuucuuggcccuucauguuaguaaaagcagacagacuuuuauauaaagcccagcuuuaccuuuuacuuauuaguuugaaugaacuugggcaaguuacuuaguuuucugaaucucauuuuuucaaaugaaaauuaauuccauauaauuccuucucuaggggauuuaauuauuauuagagacagggucucacugugucacauaggcuggagugcaguggugugaucauagcucaucguauccucaaacuacuuggcucaagcaaucccccugccucagccuccuaaguagcuaggacuacaggcgugugccaccuugccuggcuaacuaaaaaaaaaaauuguagaauuggggucucauuauguugcccaggcuggucuugaacuccuggcaguccuccugccucagccuccaaaagcaguaggauuccaagcaugagccacagugcccggccuuucuaaggggauuuaaagagagaaugcauaucacacugccuggcccaagaacauaaugacugaccaguuaaucauaacauuguaagugcuaggcaguuaaaguuagugcuagaacaagaaucucugcuuuccuaacuguaggaauacuugugaaacguauagauuuucuuucuuucuauguuuuuuuuauuccucccuuacuuuucuuuuuuuuuuuuuuaaauuccauuugugugggaagcugucggagaacagaugccuucuaccuagacagguuugaaucauuccccaucaacaguucuugcugugaguuuguguguuaucuucaauaaugguccuugguguugcacugagcacucagcuuuguuacuucauucagucauugaucauuuauuuauugagcacccccugagguccacacguuuucucaauugcuuuccuugacaguauccauuguuaaaauccuuaauucuuguaucucuugcauagggaguacagcuucauaccagguucaauacacuagggacugcucugcagaaauuucuaucagccucucccaaccuggguguccuugucucuuccuugccccugucaaaguuuaaaggacucaccugaugucaacguccuggacauccagcaguguugcagcugugucuguguuacuucuggcucugcaacagauguggauggagaagcuccugccguguaauguugacuuccagaugguggguggggaggaaaagaaggugugacaacaggaggggagaccucagaaaguggggugggcggcaggagggagcagacagcuagugggcagaggaccucagaaaguggggugggcggcaggagggagcagacagcuagugggcagaggaccucagaaaguggggugggcggcaggagggagcagacagcuagugggcagaggaagggaaugauggguggcagagggaggaauccuaaggaaggggagagauuugugacaugccuuagaagagaaauggacuagaauuuauaauuagcaaaauaaaugucgguauauuuacuucaaaaaccauacaauguuguuuaccaucaguuauguauguccacauaaauaaguaaaauaugauuuuuaguagcugguaauuaaaguuuguuccugucauaugguuccagaaaagcuauaauuacacauucauaauauauaugcucaugaacucgaaauuuuaaauugaaaugaaauugauauuuuugauguuauauuuaacuucuuuucaaccuuaguuuuauauuguaaugugcccaagaauauuuuuuaguuuguuauuaguaaagcuaauuguaugugaaaauuagauuuguagacaauccuuugaugauagggauguguaaaaaaccauaagucaaauaugaaauucuccacuaccuucagaaaguuaauuaauauaucugccuaaauuauuuucauagggucaacuuuaacuaguucuguaguucgaaggcagacaccuaucuucguuuuauugaugucagguucuuaauuuacuaaaacuuugguucaauguugauuuuuaucauagaauuuuaguaauugauuuaaguuauaaaacugaauucacacccaugucagcauacaaugguaaguuucaagcaucauuauuuaaaaugugucaccaguucuuguuuuaacagauaaaaauugauagguauuccuauauguucugcugcuucuacauuuuaaaaacugccaguacaguaugacauuaagagccuagaagagugacuuccuggaaaagaacaaaacauaauuggaaaccagaaacuauaaaggauaaaucuaagaucuagaaagcauuucuaaucuugagaagaaaaacugagaaccuaauacccauagaguccauuggaaagccauuuauucuaaguauuuacucauucaucaaauauuugguaccucuugaggaacuucuacucuaaugaggaaacagacaacuaaaaacagugggaugaguacugugguugagguacacagagguuguggugugauggagguauauauacugagauuguaggagcacaugccauagugauauucaaaauauuaaucuuuacagugugggaaacagugagaguggacacaggcuacaaacaacaggcaugacugucucagugcacacaagcugaauaucaacccugaacgugggaagggucaccuauuuugugcugggaacuggagucaaggaagacuuccuagaggagaggagauaauggcugagcugaaaccuacaugagaaaugagggagaacuagauaauaggggggcgguugggguuuuaccaacaaagggcacugcacagagccucuucuuuguugguuugcgggaaggguagugggagccauagcagaccaguugcucucucuaaagaacuuccuccuuaacucuccccaucaguccuuuuauaccuuccauguggaagaaggguuuaagaguuguaugcuucuguaucuccucugaauuuauuuauggcacucuguuucauaacuuaauuggguguuugauaacugucacuuuaggguuucaaccaaaaccuugacuuuaucaucuuguuauacauuuuucaaaaugagguuagagaucaggggaaugaauaggagagaaguacauauuucaguucacugggcauaggugaauagaggaaggagaaaaaugaacauacccaauccacagagaaauggcucacagagcccagugacuaugcugagacgcuauuaauucaagaaaguuuuaguauuugauuugucaaaugacauuauuguuuaggacuuuuauuuucccuuacagauguugaucuugucucagaauauugcccaacuggaggcccagguggaaaagguuacaaaggaaaagauuucagcuauuaaucaacuggaggaaauucaaagccagcuggcuucucgggaaauggaugucacaaagguacagaaagagauuuuaguguaaucguuacuuaaggaaauauuuccuuugaaaaauguuuuccuaauguacaaaacucuuacuguuaucaggaggaaguuuggaguagaaaaguuuugugauuucaagaauaauaaaaggccaccuaaugguuacucagcaaacauucaguuacuacaugcagccccucaguggguauugcaugugcaaggaugaauuagacaccagucauggccuugaagagcuuaaggguuaaguggcagagacagacuuacaaauaaauaagaguuauauuacuuuaauuauugaauauuugauaaaccucauuuuucuaaauuaauuaagagugcuuuguuuuugccguagauagcauaagguugguguuuacaauaauugccaaagacauauauugacaacuuaaaaggugugcuugacauaaaaaaucuuccacuuccuuuuccuuuucagacuuggucauuaaaauaaagauucuaauacuacaugaucuuauuggugcuuaaauuuauacuuuaaaauacuacauugucugugcuaugggcaucacugguucgugaaucaagaacuaaaauguuuaauggucuuuacuggcaaugauuaagauacauauuguaagaaauacuagaaguccaucuagauuucaauaguuaauugcuuuaaaacuaagaaacuaauaaaaucaauuuauuuuuuaccacuaaaaacacagauaauuugcuuaaaauacucuuugcauauuaccuuuuauucuucaauggauuuuccuaaauuuugacauauuuguaaugccauuguugcucuauaauucaguaauuaaaauuaauuuuaacauguauuaggaaagggagccauuuuacccuuuuucuugaguuucuauaauucuccauuugcuuuuaaaaauuccuauuagcuaauguagaaguuuaagaagcucaaauuuuuguguggagauaggguggaagugaaggaauuaguucagaaggaugggaauacuuaaccuagauuuauaggugaaagcuaugauaagacaguuuucaguugauaauagagaggcagcuuucuguugaaaucaguacagcagagagagaguucucugucucaagaacuagcugaaaggacauauacaucagaagagcgauuagacuaaaucgccuugaaguugcuuccaacguggagauaacauaguucugguucaauuuaauguguuaauuuauuugaaauagaauuugagugcuguggauaaacauagcaaaugcugaacugaaaguaguaaagcagggaacuguaggagugaaaugaagggauaaaauaauuuuaaauaagaccugcugcuuaaacaguuuuuacauaaccagcuuguauugguguuggguuuuaaacaucaugguuguauaauuauuaucuucugauguuaucaguucgggguuuuauuccauuuuauucauagacauaaauauuaauagugaacaauugagaaagaaaauaaaguauggcuccucauuuuuuuccugucacucugaauuuguaauuuuuauuuagguuuaaaauuaauaguuuuuauaaauuuauaauuuuugaaaucggaggaauaaacucucucacauugaaggcauuugaacuuccaauagaauuuuuaauaacuucauuauuguucuagcuuucugagggcuacuagggagaagccuguugacuuuuucuucugucuugucacuauagcuuuuaaacauagauuaauuuauuuuuaaaauuacuuuuaagguucuguuuuguuuguuuggagacaggaucuuguuguauugugcaggcuggagugcaguagcuauucacagacacuaccacaguacacugcaguccugagcuccugggcugaagccauccuucugccucagccuccagaggaacugggacuacaggcaugcgcuaccauacccagcuuaaaugcauauagguuuuauaccuuagucuauucuaauaccucaguaaugaugaaacugauuucuaaaguuuccaaaaucauuauuuuuggagaaauaccaaauacuugaaaaguuccaagaaagcauaacggugagauaauauauuaagagccauauauuuguaaauuagaagccaacuuagcugacuuguacauuaauugaacuuucuauagguucucaguucucucaaaaggcccauaauuugcuuguuuagauuuaucugcuaauuacacuuuucaaauauauuuccauuucuguagcaguccuagauucgaaaaaauaaauaaaacaaaguucuuaguguuaaguauagaggaugauacacaacacuuuuaagauacuauguguguucauuauuggugccguauuacaauuauuucauuuaaaugcauauuuuccuuuuauauugaauguuacagucauaagugcauagugugcuuaguuccagucuauggcuuuugccagaaaaucuuccuuaacuugaauaccucauauuguguaugauaagaugacaucugcaaaccuugcagucaauacuggauauuacagaccuagauaucaauaguauaucuaucagcagacaaaaauuccuuuauacauuuccuuuuaaagagcauaacugaugaagucuuuaaaagaaaacuuuguaauauagagugaauauuuaacuguaucaaugugaaugaauaauaacauagcuuaacauuuuaacuacuaacuuuaccuauuuaaagguuagaugauagugcauuuugguugauaauaugcaauugaaacuguuauauaaaauaaucuugggcacauuacuuaaauuccuuaguuaugcauuuauuuaucuguaauuucaaguuguuagaaucaauaaucccugguguugcuucugaaucuuaacaagcuacguugaauagucuaauagaaaauggcauucuuagaaaaguuuuguuguauuuuaucuauaugaccucuagggggcaccaaaagaucuaauugcaggcauugccugguagauuccagcagguaaucauccaguuuuuuacaaucuaacagguguguggagaaaugcgcuaucagcugaauaaaaccaacauggagaaggaugaggcagaaaaggagcacagagaguucagagcaaaaacuaacagggaucuugaaauuaaagaucagguaagagaggacacagcauaauugcagcaauuauagauaugaguaacauucuuucucaaguugauguuguuuuauuccuaauuuauuuauuuguauuguuucuaacuaaugggaugauccaguuuacacuguuaggaaaauuucuuuuauaguugccuaaaauuaucaccuuucacaugaauggugagaauacaacagcaugcauauaaaauuccaaucugacaggucauaaauauacauuuggauauguguaucuauuacuuacaaaaguaaaaagaaauguucuaaugcacaguuugaaccuaaaauauacauacauaaaguucuugaaagaugccaacuugaauccaauuuuaaaugaaaaaguuuaaaauucguaagaugagaugaguugauauguaaauaugucaaucaaauugauuguuggcagagugaaaccaguuuuaacuaagauaaccaugaauacguuuguucaugaagccuaaauacagugacauuagaaauguuaguggauaaaagcugcguacuuuaauuucaguuugaacagauguuuuauguuauaucuuuauugagaugaaguagauaacuccaauuuuaguugacaacauggauaaaguuuuuagagaggcaguucuaauaggcugacuuuugauuuucuauuuuuauguuacaguacaggaccuugaagguuuucauucuuuguauucaaugaaagcagguuguuuauucaauuaaaauaguaagacuggguucuuagugucaauauuuuaaaauaauuguuuuagaauuuagaaguaggucgcuccaaauaaguuuuuuuucaaauauguuucuaguucgagguuuuucaucauauuuuccaacauauuuucucuuuugagccaaugaagucuuuacaacaaaugaugcaaagacaauugggaaaaguauugaaaaugaaagugauaaugaagacuagaacaaaaagcuuuucaagucauaacugaaauccuuaguacuaaauuaaaauccuggcaaccaaaguaaaauucugcuuuuguaccacuauauuugguguuguaauggguuuuacauuuucagaagacuuuuaauuauuaacauguacaaauaaugaaacauuuuauugcauccaguugggggcgugccugauaguggaauggaaaaugcuuucugucagggacugaaggccuaggucuacuaaguuuaucacagauaacuuuucuuuccugauauauuguaauuuuuuaaaaaggaaucaauauauuggcauacuuuuggccuuucguauuauucuacagcauucugacagcauaauauuuuggacuaacugcaaaaauacaucaggaaagagucucaguuauuuaaaauuccauuauaauuuucuagaggaaaaaagaucagggacaauaggaguauaauaucacuuguaaaggaauaacuuguuuagaagcauuugcaauauuagaaguauuugcaguauuaaaucucauuuuaauuaauccgugaugguauggaggcuaaaguugcaggauuuacaaggagcaguuuucauuuguaaacguuuucugauaauagugaaacaauaguaguuuucauaaugacguuuagugguauguuuuuagauagagaugugccuuuuuaggaggucacagcuuuaggaauaaaaccucugaacaguuacaagauguuugugauguguugugaagugaugugcuuguuaccauuuuuuuuucccagacggaaugugaggaaaucuuauagguacucuuuuuaacuguuuuguauugaacagacaguuucagaaaagaagucguggugucucauuccauggaugauuuggaguagcaaagcagcaauuguucuuuggucuuucagccaugaccugaccuucugucugugagaccaaagaacuacuuugcuuggccaccaucugcacucaagagagaaauuuacauuuaacuuuuaaaagcggggcauguugagcauuuaucugaaauaccuacaauaauauaaaguagauuaaauguuuaaguguuguguaucuuacaauucagcaucacaagcaggcuaucuguagguuugcaaacaagguguucuucauaauauagucauuuuauucauauuuuaguucaucugaccacuugauacauuuuuaaagugggugggaaacugugagauuggaaugugugagaacaacagcuuuuuugauguauacaaaauagggcaaaugguuaaccaccaaaauaauuuuccuugugaccugagccuuggcucuggcauaauuagaaggaaagguuaggagaguaacaauggcagucgcuuccacccacuuucuucuuuucuucuuuauauugugucaggaaccgaugggcggauuauccuucccaucaacuccuuuguaucucuucagcuuagagaauuccugucagccucagaggaugcuucuugcaccagaaaaagaggcauuugguauggaggagaaugugaaauaugcucuuugauuuuuaugagaaauuuuuuuaggcaaugguuauacacacacacacacucgaucaggggaauuuaaaaacauguaugaggguauagggaauauuguaaugaguccucacauuuccaucaccuacacucaucauuuugcccguccucuuccucaguccuauuccaucacucaucauuuugccaguccccuuccucaauccuauuccaucacucaucauuuugccaguccuccuccucaauccuauuccaucuaucucacuuuuuucucucuacuucuguccucaucgucaccuucaucuucuuugucauguuuuuucugcuccaccuucucaucuucaucuucuucugucuucuuccucuaccucuuuuucuucuuuugcagaaguauuuuaaauggaucucagaccuuauguuauuuuacucauaaauacccauguggaucuaugaaggauauuuuuacauacuaugucauuaucauaccuaacaauguuaacaauacuucuuuaauaucaaauaacacccagccuauauucacauuucuuugucucaaaaauguugauuuuacaguugguuuauucaaauuaggagaacaaguauguuuuuguauguccaauuuucugguguuacccuuuuuaauaggaaauaaacagaacucuuaguaaaauuucaucuuucuuuguuguugucuguuaaauuuuguacauaauguuuugauuaugcuuuauuuuuauaaaaugccucauugucauucuaaagagguauaaauuaauccuacagcaaaguaugugaaggaaauggcuaccacgcagcauuccugauaaucauaucccaaaaggagcuuccucgcauccgaaaccccaaauucagcauuaauuucacagccuuguauuuaagauuuggacauguugcaggaggcccuaacaugacaaggaugagcugaccugaaaugagugaugcagaaauagaguuuuuuugucaacuucccuuuugguaaauuaaucugagaagacgauucuuuauagccgcuaaccuuugauuagggcccagugcaaagugaaaauacaggacccuuuuguucagaaagcaggaaagaagugauauuaaaaagaacuaaaauauaaaacauuuuccuuucuucuucagucucucucuccuugccccuccucccucaccaacccaggcuggacaugcauuuuuuuuuuuuuucuuuuuuuuuuuuuuuuaggacggagucucccucugucgcccaggcuggagugcaguggcgcgaucucggcucacugcaagcuccgccucccggguucaugccauucucccgccucagccucccgaguagcugggaccacaggcgcccacgaccacgcccggcuaauuuuuuuuuuuuuuuuuuuuuguauuuuuaguagagacgggguuucgccguguuagccaggauggucucgaucuccugaccucuugauccgccggccucggccucccaaagugcugggauuacaggcaugagccaccgcgcccggccuggggcgggaauucuuaccucccuguccagcucuaagauggcagggaugggcacacuugacucaauccucucuaaacacacauucaggauucugccaggggcaaaagacacaggagaacacacaccucccccagugacauacgcaccucccccagugcccuggucccacccuagguggagggacccaccccagcagcagggcagggcgggauagaggaagcuggagaggaguauauuucugagaacugcguagggcugcagugaggcaguggaaagaugagaccacauacaggaguucagucuccauuguuccaucagaguacaccuacaaaacacaauucuagccgggcgugguggcucacgccuguaaucccagcgcuuugggaggccgagguggcggaucaccugaggucgggaguuugagaccagccugaccaauauggagaaaccccgucucuacuaaaaauacaaaaaaaaaaaaaaaaaauuagccggacaugauggcacaugccuguaaucccagcuacucaggagggugaggcaggagaauugcuugaacccaggaggcggacguuguggugagccgagaucacgccacugcacuccagccugggcaacaagagcgaaacccugucuuggauaaaaacaaaacaaacaaaacaaaaaaaaaaaaacacaauucuaagauacaauugcuaauaauuucaagacauugaccacagaguauuaaacugcaaguguaaggacccuucugaacagcacaugugugacugcacugaucacgugcccaagaaacugccauaaccagggggaugggcaaauggagauuuugcauacuaauauauguguauauauccccacucacauauacagacacauaugcauauucaauaugcuaaugugcccaguauucauaaaaaaguguuagccaacuacagcucauaggucaagucuggccugcugucuauguuacaaauaaaguuuuauuagaacucagccauaccuacucauauauguaucaccuauugcuacuuccugcaacaacagcagaguugaggaguugugguagagaccauauagcccacaaagccuaaaauauuuacugucugacccuuuacagaaaaaguugccaaucccuaccuugaguauagaaauacaacuguauuuuuuaaguuuccucugacuuacuaggaugcugagcuuugaguuugaagacccauguaucuuaaauaauaacaaugguuuuagaguauuuugcaguauaacaaaugugccacaucuuuagucucuuaaaaaucuaauggcauuacucagcgaguguaucacugauaaucauggcauuuucuuauuaguggcacaugacuuacuaguggcuuggaugggaguguaaauaccguaugauuuuauauuuacaauuuuguuuuuagguugguuccaauuuuauuuuucagagauaagaaggcugauauagaaagcgucuuucuuuuuuuuuuuuuaccggcauuguauaaauuauaauuuuggaguuguggcuacuacugaguagaaaacaucaaguuugaaaugacuuuaauggagcaaucaaagcaaauauucagggugggguaucucugcaaaagaaauagauccaaaaauuuuggcuggaaaaaugagggcaaaaaaggauuugaggguugcucauaucuacagcagugauucagcacuuggacacugacauuaaggauggaguguaaggacacaggaauuaucgccuaaauucaguugaauuaacuagacuguuggaagaagugcaucuauauuguauggcuuuguguaaggagaagaaggccugccugcaagcccuaaaagucaguccuuuuuucuuucuuuuuuuuuuugagacggagucucauacugucgcccaggcuggagugcaguggugcaaucucgguucacugcaaccucugccucccagguucuagcaauucuccugccucagccucccaaguagcugggacuaugggagcacgccaccacccccagcuauuuuguuguuguuguuguuuuuuaguagggacaggguuuuaccguguugcccaggcuggucuugaacuccugagcucaggcaauccaccugccucggccucccaaagugcugggauuacagacgugagccacugcgcccggccuaugucaguccuuuuuaaaguuagagaaauauaaaagcaauaaagaaaaguugaagaauuguaccuuuuacuuagagaagacuucaacauugcuucacaucuucaaggauuugacaaauuauuucaaggaaaaaguuaaacaccugauuugagucuucaauauggacagaacaagaacaaagggauuuaacuacagcaacuacaaaucacaauagccugaaacaagaauuuucugacaguaaggagauugaaauugcugcaacaggccauggaaccuuuucccuggaaguuuuaguuuuaaauaguagcagcaauaugauuuaccugaagacccagcucauggaccucugagguccagucuucuauuugauucuggaagcguccuagaaagacaucguuguaucuuuuaaaaguggguaacagcaguguuagucuuuucuacuugaaaccuagcacuuacagauuaaaguaaaauccuguuccguucuauucucugcuuugugucuuuaaagcuguguacucuuuuucagaagguuuuuggggaauaugcuaagauaauggaugacuucucaagagccagacuucagaaacuuauccaacuaccaccugcagucucacuucucccucuacaaaaugacugggagaggggccauuugggccugccuuugguacauguaaucacucgguccuggugaugacagaguugcucuccaguauucuucacacccucuuucagucuguagacuuagcacauucuugucccugcucccuacgaagacaacagcaguuccagagggcuuggcuuacccagaccaguaugcuagacacuguggggguaauaacuaggagacccagguccuacccuuagggaguuuauauucuaguugaggagucagaguacacauuagaacaugccuuaagaauacuugcaaagcagcauaucgacaagugcaaauuaauguagugugaacuucaugcuggcuacagcccaugagagggagaaucugguuccaugugugugaugcaauaaagcuuuuuuauagcaucuucucuaaguaugcccuaaagcauuguucagcauacuuagagaaauuuguguucuuaucgcagccuaaccaagaauucugagaaaauucuucagccuaacauaugucuaauaaaucagccucuuuuguucuuguccuggaugaugcuugaaugggacaaguaggauuuauuggauuauacaaauaauuuaaaauauguucauuuaauaaaagucuaaguuauugauugaacuuauuuuucuaaaaugcugugccaaauuacuuucuucaucuaaaaucaucauguugguaaaaucacaaaauuagcaguaaaaaaauauaauucaauuuuucugcauaaagaagcaguuccaaaucaauccagugaauaauaccgaguuggagaucauuggggcauuuagcauuuagucacguuguuaaugauuuaggcaguuguuuucugaggcaggguauguauaccucauucauagaaacacugacuuuucaauuaacaugcucaaaaaaagaaucuauuaauuucugcuuguuauuugauuuuccaacaaagaugauaaugcuguuuaacauaauaauuuauuuuacaaaaucaaauguauaagcagagacaacacaucugaaaauagcaauuuagguauauuuagaagauaagaguacaaauaggaaauaaaacaagcuuucuuagaaauaauaugccuuauaggagaaacauuaagaaauaaauauuugccuuuggaugggaauagaaaacuguaaacuggacucuaagaauauuccugugugcccugaagaaauauaauguuugcuauauuuucaguuucaguggaugacauguguuuugguucuuugaacauuuuuuugcaugcuuguuuugacuguaaaaguugacuuaccagccaacugccaacuugcaaagugccuucucagguaccaacucugcaguucugguagcuaccagguagugacaguucuuuaaauguguccaugcagcccaacaagcugagagacauuagacauaagacaacuacauaugcuuucuuuuuguuuauaguccagaaauauuaguaccuauauccaauauaaauaucacuaauuacuacauaugcauacauuuaaaaaaauuuauuguauaaacauaagcacauuaacagaagccaguaguuccaucacccaaacaguguaaauuguuuuuauuuuucuguuuuaccuuccacuuuuuguacauaugcaucuauaauauuugcaaauauaaauagauucuaguuuugguuuuugcuuuuuucauuuaacauuaucuuaagcauuuuuucuguguugcuccuuauucuucauagugaucacuuuacuguggccauuuacauauaccuguaagggaaaaugauaguaaguuagauuuugagaacagccacuaugacagauuuagagcccuuuugcccuaaacuucauauguugcuuuaauucaauaaccauauauuaugugcacucuacuuagcuauaaucaauuucugucagaaaggaguauguaaaccagguaugccaauaaauauaugucaaagagaacauaguagcuaucagcaaaaugcaaaaggcaugggaauuugggaggggaaagauaacauccuugcagggugguuagaauguugccuagggccagccgugguggcucaugccuguaaucccagcacuuuaagaggcugaggcaagcagaucacuugaggucaggaguucgaggccagccuggccaacgugguaaaaccgugcaucuacuaaaaauucaaaaauuagccgggugugguggcgcgcgccuguaaucccagcuacucgggagacugaggcaggagaauugcuugaacccaggaagcggagguugcagugagcugggauugugccacugcacuccagccugggcagcagagcaagauuccaucucaaaaaaaaaaaaaaaaaaaaaaaaaaaaaaaaagaauguugcccagcacggauagaagaagaaauuuauuugguuagaagguucaacauggcagcuugagcaaaggaaugggggugaaaaaggagggugcauccaagaacauaugugucuuuugguuccauagcauuuuuguauaacugaccuccauuauuucaagugccacuucucuguuguaauagauugcucauagaaaauggguuuuaguaacacucagaaucccaauauaauugucuccuuguaauauacuguaugcccugcagucaggcacagaagucaugguaucguuugggaauguaugcauauguauuucauuugcuuuguaguagguuuuauguaauggaaaaauuuuaagauuuuucaaauuucagauaacauaaauaaaaugucauuuuauuuacaguguuagagucauauaggauuguuuuccuagaaauaaagaauugacaauuaucuugauuuguggaggauuagcacaugacuguugaugaaaggugaaacacagaucauacaggguacuacuuuacuuaaggaccaugaguacaaagucaugacuuucugauuuagcuuuuccagcuaauuuccugagcaaaccucucagagccucaguuuauuucccagugaagugagaagcuuggacaagugguagcaaaaguuuucuccagcuguaaauucuugcauuucuagaaacacaggaaguauuucuuugccccucuuaauugugaauuaaauauucauaaaaucaacagaaauugcauggagccucaaguuuuauucuguauuuuccaguuauucacuuucacuuuauaaacaugacacuuuuguuaagauuauaaaaaugaauuuugacugucaucugcaauuuuagacauuuucguuaugauugguaauagaacaauaaaaugucuagccuuguaaagaguuaaguuuacuuacaagacagacaucaucuaauuugcaacaaggauuaaagccccacucugaauuaaaauuucuacuggaaagauuugaggcacuggcaaacugucaaagguaguauugugcgagaguaaccagcuuuugcaagaccugugaaaguaaaucucuucggccagaguuucuuaggugugugaacuuaugaugaucaggaauacauugguggauucccacuagagaaacgcaccauuaauaguuaaugcuuucacuuucuguuuucacuuguugcccucauaaaugcaagcauggaaugaaaagcugugguaguucuggacacagaugaccuagaauaugaucaucuuaagauuuugcucugggaguucuuuuuaaaaucaaucaaaaugaaaccaaaaacaauuuugcaauugucuuagagguuuuacagaucccuggcauguuuuucugacccucacuggaguucaguaugagacagaccacgcuacaaagagauuccugaucuaacucuaggcuguucaugaguguuagacacacagugugagacagaucacccuacacagagauuccugaucuaacucuaggcugcuccugaguguuaaugaguugcaagguguuuagaguuuucauauuacucuucuuaacagauggucaaguuaauuuaacucuuuuugguguuaacaucuguacuuaaguggauuuguuacacuuacauuuaggaaaaagacaagaaagcugcagggucuuuauuucuggccugccuucugccaucccugaaaauuucuggaguuuccuauaggaauggaaaauucuucuuuguauaaaaucucucuacuuacaacugaaguccugauaccuucucucucucucucucucucucucucucuguccccuacccucucuccaugguaauaaauuauacaaguaguaguauuagccuuucuucaugagucaagcugucauugaaaauucccauuaaagugcgaggggacgcucauaucuuuaaagaaaguguggcugccaaggaaacgagggagguaaaaauaaacuuuuaaggagaucuugagauggaagagaaagaaucguucuacucgaaagauuauuucaaaugcuaccuuuucuguuggacucuucuuucuuucuuuaugauuaauauuauuauuuugggauuugguguuuuacucuguuguccaggcuggagugcgguggcacaaucucggcuuauugcagccuugaccuccuggguucaagugaucaucccgccuccaccucccaaguagcugggaccacaggugcaugccaccacacccggcuaauucuuuuuguauuuuuuuguagagucagggucuugcuauguugcccaggcugguuuugaacuccugagcucaagccaucccuccaccucugccuucccaagugcugggacuacaggccugggccaccgcaccugguguggauucuucuuuagcuugcuuagaauguucugcaaagaaaucugaauucacucauauggagaggugauugucauauccuaguuugcauuagaaacuuuagggugucauuuucaacuaaauuuaucguagaacuguaggagggucaguguuucuucccuaauauacugaagguccacuauguguauagcaaauuaagcuaugcaagguuuuauauaauaagaaccagacauguuucauuuuaaaggcggcgucaacacagacuaacgaauacaucaaauaucuguauguauuuuuaaaucuauauguagauauauagcuuucuauauaucuuauuaaucuauaaccuuacugugacuuacuaaugauuuuucuugagcagaaccugaaguuugaaguaucucaaugcugaauuugacauaccauagacuuacuucaauggcuaggagagcaagaaagaugcuagaauuaucuuuaguuauaaaaacaagaagagaaaagaaaaguaguggcggggggguggugggggaagugggaagagaaaaugggaaagacuuuagaggaagacauucuaaaggcauuuauacuaagaagaauugggcuuuuuuuuuccuguuuauacuguuucaccuuaaacuauaacucagaagaggcaaacaugaccaccuauccaucaguauaauaaugcaucaggauuuucagaagggaaccacaauaauggauuuuaaaaaaccauuacugguaugaaaaucccuuuuccccuacaaccacugcugauugucgaaaauaacuucaugcuagacaugguggcuuacucccguaaucuuagcacuucaggugucccaaagcaggagaaucguugagcccaggaguuugagaccagccuagccaacauggugugaccccaucucuacaaaaaaaagaaaaaaaaaaucaaaaaauuacccagguauggugucaugugccuguaguuccagcuacaugggaggcugaggugggaggaucacucacacccagaaggucaaggcugcaauaaauuguguucaugcacugcacugcagccugggcaacagagcaagacccugucugaaaaguaauaauaauauauaauaauaacuuuauguacuuuggcauuuuucagaagaugcuucuuacccacauagcaauggaauuuaugaagguaacuuuugggccgggugugguggcuuaugccuguaaucccggcgcuuugagaggccgagguggguggaucaugagaucuggagaucgagaccauccugacuaauacggugaaaucccaucucuacuaaaaauacacaaaauuagccaggcgugguggcacaugccuguauucccagcuaccugggaggcugaggcaagagaaucgcuugaaccugggagacggagguugcagugagcugagaucgugccacugcacuccagccugggcaacagagcgagacucugucucaaaaaaccaagaaaaaaaaaaagaagguaacuuuugucuuuagucuuuccuauuucaauggccacauauaaaggauggaaggaaaggcuucagauaauaaagagcaauggcuuggugggcaccaagggucagaaagacuuuaauaacuuaguccaccuccuccauucuguauaugaugagacugugagucagcugggaguaauuaccuuauuuccaugcagccauuuauuuaacuaauaauuagugauaaccuauuauguguugcaaacaaauacgcacaggggugcaaugaaaaauaaaaauauauuuacugcucuuaacaacucuuauaguuuggugaggaaguuaaaugugcugggggcucagcaaaggguguggccuacuguggcgggagaggguccagaaagauuuuacacauuuacagucaauugauuuucagcaaggauauuaaaacucaauagggagcaaacagacuuuacaguaaauggugcugggaaaaccugauacccacagguaaaagaaagaacuuggguuccuaccucauaguguagacaaaaauuaacucaaaauggaugaaagacuaaauguaagagcuaaacuuagaaaacucuuagaagaaaacauaggcauacaucuuagugacuuuggauuagguaaugguuucuuagguaugaugccaaaagcacaaagaacaauagaaaaaaaauagauaaauugaaugucaucaaaauuaaaaacuuuugaccuuuaaagaacauuaucaagaaaaaagacaacccacagaacgggagaaaauuuuugguaacucauguaucugauaagagacuuguaucuaggauauguaagguacauuuacaauuuaauaauaaaaagacuccucaauuuuuaaaugggcaaaagauccgaauagacuuuuuuuaaagaagauauguuaauaauaacuauauuauuaacaaaugauuaauaaacaugugaaaagaugcucaacaucauuagcuaucaggaaaaugcaaaccaaaaccaagaugagaaaccauuucacaucuacuuuggauaaguguaauaaaaaagacagauaauaacaagugucggugaggauguagagaaacuggaacucccccauaaguugcugguagaauuuaaagucauacaggcugaaaaauauucgggcaguuucucaaaauguucaacauagagauaucauaugacccagcaauuccaguccugggucuauacucaagagaaaucaaaacaugcuacucaaaaacuucuacacggauguucauagcauuauucauaguagccccaaacugccaauaccccaaaugucuaucaacugaugaauggauaaauaaaaugugggguguguguauauagauacauauuacauggcaguaaaaaagaaugaaguaaugauacauucuacagcaugguagacuuacaauugaaaacaucauguuagaugaaagaagccagucacaaaagacaacauauuguaugauucaauuuauaugaaauguuuagaaugggcaaaucuauagagacagaaagauuagugauuguccaggucugaaauuggggacaaaugggagggacuccugaugggcauggaguuucuuuuggggugauaaaauguucuaaaaucgguugugguaauaguugcacaacuauuuuauuuccucaguccugaacuucauguccagguagagauuuauucccuagaguaacuaaggaggaggaguguuagccagcaccuuccuccuuccucuuggugacuagaguguuagcacgucaguccaauucugaaguucaaucauuggaagccuacuuacccauagauuugagccacauucucuaaaauugauuucauugcuaauacagaugaacaggcuugcuccauacuguucuacaggcugugcacugcacaauuccacagaugccauuugcacuauagucauggcggccucacagugaauguacuaaacuccgugaauguacuaaaaacuauucaauuguauacuuucggugggugaauucuaugguguguggaugaucuuaauaaaguuguuauuuuagaaaaaaaauauaucauccaagucauauuuuagcccagucuggagggaacaagagugggaagugaaggccauucaggaaaacaggacagagucacaaaggcacuguucuguguguaccuggagggcacaagcgggugcaacagaugaggaaggaaagacagagccccacaaaacugaaaugacaugccagaaguggcuguaagguccuuaaagucagggucuuaacuuacccuucauuguguguccgguacucggcacagaggagaccuacggcagauauuuaucuguugauugagugaaugcauagugagcuaagaacaaaccuugaauacuuagugauaguaucuaaaugagaugacugagcuucucacuccuaggucagucuuuguugugcuaugucugauggaaaguuuuagaaucaagaugagaauaacuccuuuuauaaugauacucauauuuuagcaguuauauguguugaaaauguuugaucagucuuuuuuauauuuaguuguucuaguaaguauauaaugguaucucauugugguuuuaauuuucauuucccuagugaugaaugguacugagcauuuuuucagaugcuuuucuucuguccauauaucuucuucacauauauccacugcuaccgucuaguucaagguacugucgucuucagcuguguuauugcaacagucucuuuuuuuuuuuuuuuuuuugagauggugucucgcucugucaccuaggcuggagugcaguggcgcgaucucagcucacugcaaacucugccuccuggguucacgccauucuccugccucagccucccuaguaucugggacuacaggcacccgccacuaugccuggcuaauuuuuuuuuauuuguauuuuuaguagagaugggguuucaccguguuagccaggauagucucgaucucuugagcuugugaucugcccacuucggccucccaaaaugcugggauuacaggcgugagcccccaugccuggccagcaacagucucuuaacuggggcucccugcuucuccucaucuagccccuucacagcauaagggccagagaaagucuguuaaacuuucaucagccaggugagguagcucacuccuguaaucccagcacuuugggaggccgaggcaggugaaucaggaggucaggaguucaagaccagccuggcuaaaauggugaaacccugucucuacuaaaaauauaaaaauuagccaggcacgguggcaggugccuauagucccagcuacucgggaggcugaggcaggagaaucguuugaacccgggugguggagguugcggugagccgggauugcgccacugcacuccagccugggcaauagagugagacuccaucucaaaacaaaacaaaacaaaacaaaaaaacaaacaaaaaacaaccuaugucugaucuugucacccuucugaaaccauccagugguuccuaccucaguagcagucaaaggcaaagucaaacagugacccccucauggcacgcaucugcugaccuacaacugggcagugaauauagacauuugcauuuaccugucuggaacuuggucauuuucguuugggccuguugugucagcuuguccgagcucucuuggauccucuuuucaacauauugccauaauaaauuauuccucucagguuuaugucacugguuagcaaggugcuaaccagucugcccccacgaccacuucagagccuuuggacuugcucuuuucuucgccggguucucugggauauccuguggaucacaaaauaacccuucaagucaucgcugaaaucaucugugugagacuuuccugacuaccuuguuuuauguuguaaaccaguuuccgaguacuccugcccccuuucugcuuuauuuuacuccauaucuuacucauuuguuuauuaucaucuuuccuuaucacaaccuuagcuucauaaaguuaugcccucuuuauucauacucaacacauuugcgaaagcaaaacgugaauugcauugcauugcauugcucuuccauuuagcaauuuggaauggcuucccauuugcauuuagaaacaugaguccaaacuccuuucuacaguuuauaaggcccugcauaaucuccccacugccugucuuuccacccucuucucauccacccuuccccuguccauucaguggagccuccgugguuugccuuuagcuucucagacaugccauggccuuuggacaaacaucuuccacauauauucuuucccacucuuccuuugcuuaaccagcucuuuuucuuucuuuugguuuccaauucaaugucucuacuucacuggcuacuaauguauacucuguuauucucucacagcaccucauuccccuccuucauggagcuuauuauaaguuuuuuauuauuuuauuguucauuugcuuuuaaacaaucaguuucuuccauuaaaauguagguuguuugaggacagagacuuuuacuugucuuauucucuuuuguauucagugccccagugcccugauugcaauuagggucacaguaacuggauggauaggugggugaagagauggccaagugacugccucaaguaacacaguaacuggauggauaggugggugaagagauggccaagugacugccucaaguaacacaguaacuggauggauaggugggugaagagauggccaagugacugccucaaguaacacaguaacuggauggauaggugggucaagagauggccaagugacugccucaaguaacacaguaacuggauggauaggugggucaagagauggccaguugacugccucaaguaacacaguaacuggauggauaggugggugaagagacggccaagugacugccucaaguaacacaguaacuggauggauaggugggucaagagauggccaagugacugccucaaguaacacaguaacuggauggauagguaggugaagagauggccaagugacugccucaaguaaauuucucauuuuacuacccacuacccaaugaaucugaacaaguuacugaaaaugugcaagcuucaguuuuccucuuuguaaaaugaggauagauacaaugccuaccuuauaggauuuuguaaaauuuuaggucaucuauguuaaccucauaguacaaugcaugacauguaauaauugcucaauacacacuaauaauuacuaguuuuacuaauacugugauccuuagcuuuuccaccuucaucucucucccaucugugucccauuuuaucacauugcuuuccagagucgugaugauuacugaauaugagacugcuaguuugaacugcccagugcauagcaguggagcuauugccuaagcuuauguuaaucuagcaucagagccaacuaucauuugccuuauuguuuaucaaauaugucucauuguaaauucuuauugagcuuaaaauucaauuaaaaccccucauggcacgcaucugcugaccuacaacuggguggugaauauagacauuugcauuuaccugucuggaacuuggucauuuucguuugggccugucgugucagcuuguccgagcucucuuggauccucuuuucaacauauugccauaauaaauucuuccucugagguuugugucacagacacauuugaucagcacaucgguggcauccucauuaaagucaguggucuaaauaguauagcacagagagcaucacagagccuaugaccugcagcuuccuuguaauuugauauuugcuguucugucuuccaugugauuuguucuaauugauguuuaagaaccagaucauguuuauuuuucuguuuaagaaccagaccauugccuucuucaaaauaauucuagucaaauaaaaaaauuauuuuuaugccuacuguguguaaguagcuugccuagauaccgaugaaccaugugacagaagcuugccuugauggugggcaaugaggaaaucgggcauggauggcuaagaaaucaaagugccguuguaaauauggagcagauuuguaguuuggcaggauauaaacccguguugggaaacucccaaugagaggucaaaauugaaauggggcugucugaaauuccauuuuguucaucuagauaaccuggauaaaugggcuaaauuggaaauuugagucuuaaaaucauuuuuuugagauuucuccuauucauucuauugacuuacucuccauuuuaaagucuuuuguccuaaucauuuacccuauaucucucuguucuaugccuauuuuauuuuucuuuaugaaaaugggugaaagcaggaauuuugcuaguuuucuaauuaucacagcauauaaauucaguaauguaugugaaaguguuuucuaaacuaugaaaagcuguauacauacauaggaauagaauggauugucaauaaauugaagagaugaguuuacuccuuuguauguggaagcuguuaauuuaaaauaacacacucaaaauauuagcuaaaaaucuacuucacauuuuggugcugcuugcuaaaauuaguuagaaaauauagguuauuuuugaguuaaaaccaaguucaauaaauucuuaaguuccucaaauagaauuuuacagaaauauuuacauaacccacagcuaaagugaguuuucuaagaacuccccauaaggugagaucacguacaccaugucucaguacagaaggauuuuuuuuucaaucaguuaugucucuauaaauaaaccuaguuuuguuguuaaaauugcuguuuccucuucacauaagaacaugucauuaauuuuggugaaaaccuuccaacaaaauaagguuaaauuguccaguuuuccaguggaagaggaauuauuuugugucaccaacaagcagaguaacagcuuaaagguaaguugaacacagacaugcuguuuggguggucagaauauuuugcauccaagcauaaauguuaguaagagccuauaggugagaaugcuuuagguauguuuuuaguaaugcuuuaccucugcuacucuccuuaggauuugggaaccagagcauucauacugauguucucuguaauuagguacaccaaggaguaacagaaacuggguagguagguagguagagagaggugaccucagccagagccgguguguuuguauaggcaagaagaggagcuguauuccauggucugaacuauuaagugauccagacuacaagaauaugacuuccuuuucucaguuguuugaaguucauuuagcgaaaaauuaaaauacaguuuccuauaaaacaaaaucauuuaguuugaacuggaaaaacauuugagguuuucuugguuugagagaaaauaaacauuuucuuuuguccuagcaccuauaccaaacaguaauauugacaaaaaccaaaccuaagaaaaugcauuuuuuuuccucuaaauuaagaaauaguauguauggcuuuaagaugcugcuuaaaaaaaaagaauaagucuuacauuuguucuaguugucagagauugacagaacuaauaagagaauaaaagagcaaaacgaaaaaguucuugcugauuaacaguugucugaggagaaacagacgauauguuuucuuuauugcauugaaaaguuaauuauuaccaauagaagcuuauuuaugcuuguaacugaguuagcguuguggcuuggcauuauuccacauuugaagggaaauggguaucggcgaagagucuggagcuugaguucuaguacaguugagugggcuuagcgagugguuuaacuucacuggaucccacguucccaccuguaaagugaggcgauagauuaagaugaugacugaggugucuugugucccuaacugcauguuuuuuuccuaaaggccuauuuuguuuuuuaugaaacaaaauauuuuaucuucacagggaaguuuacucccaaauguuuuugggaccauuuagauaggaguacacuuuagaaaaaaauauaagcagcacaguauuuaaagaacagaaauuguauuugcuaaguaaauacuguacaucgaagucuuggaaguuagauacaaaauaagccaaaaguuucauuuuauauucccuuuagcaaucagaauauuugauuauuuucuagacaguuucuguaagaguaccauuugguauaagaguuuuaauuugugauaguagaaaaguaauaaaaauguguacaccaucuaagagacaaaauaauuuugccaaaaauugccuuuuguucugguuaagaauaaaugggccaauuucuuuuacacaauaauuuuuaguagcagauaccauaucuaaaaaacuauauuuacuauggcaauaguagcagacuaauuauccagcuuucuuuggaaauugugacuuuuguaguugucaauacuuuuauaucuacacugaaaaauuuuuggcuuugaagaguaugccugcauguauguugauuuuccuguaauuuuaguaucugggaaaauauuccaucugaagcauauguagaaguauagaaaauuguugaaauuccauuuugaaaugaccuuuaggcugcucuucauuuaagguaauagugucaauuuugaacaaacuguuucaaaaacuuuauuuaauuuaggauuaugaauggcauccuuguugguuuuuaaguauuuuuaaccucaugaugagaaucugagagcauuguaaauacauuuaauaaugaaaaagauauuuucuaaacuugaagucaauaauaaacuucuuguauuuaaauugacuuaugaaguuuucuuaaggcaaaaucaguuauaacuuuaugaauagcaauauuuucaguucauuuaaauuuauuuuauuuuuauagauagugaaagcaucuguaucuuauuugaaagugccugucauucucuuauuuauuaaaauugcuuuagugugguuuuuauauuuagucuugguuuuuacuuguguuuagccauauuucuacacauagggaauggugcaggagcuacaccacuguaauuaguagugggcaaugugaccaaguuuuuuuaaucuuauauuucaauauaauuucaaugcaauuacucuauugaguaauuaauaacuuuaauguuuagacauaagugaauauaauuagcccaaaauauaacaacauaaugugaaaaugauguuuagacuucacuuacugaguccugaagcccuaauauuaauacuuauaauuuccugcuguaaauuuuuaugaaaacuaaauaagaguaucauaauaauuucuguuauuuacuguagcccagaugauuguaaauuugaggaggaaaugauguaccuuagaugugucauuggacuugcacuuguuuuuuaucaaaaugauagggaaucaauuaauauuuuaauaguuacaaaagaaagugaagagugaaauagcuuggauauuauucauauauaguguguauaugugugugcacauauguauauguagguauauauacauguauauaaaauuaucuggccaucuggaucauauauauauguauaaugucuggcacauugcacauagcaggcacauaguaugugcucaaaaauauuuauuguauugaauugagagcuugggaaggaauaguuuaagggaauaaauuaacaguuugcuuuccuaaacuggaauuauuuuauuauauuuuauuuuugcuuuuggaugauuuuucucaguuggcaaaaaaaacuauugucaaaugguaauaaaagucaauaacuguaaugaauauuccuuuuauuaugcugugauauguuuuccugcauuuuggguaacuguuuaaagauaauuuuucuuugguaauucuuuuaucuaccagcuuuuauacuuuuuagauuuuucauuuuuauucgccauuggaaagacuacuuuuuuuauauggagaugucccaccagaaaagauuguuuuccugguuuuuugcaguucauuuugaaagaagcaacuccagguuuauuuuugauuugaauacagcuaguguagcaugagaaaauccuuuugaagugcuuucagaaggauuaggucaggguuagguguaguuuuuuuuuuacauaaaguaaauuuagaguugcuauuuuaaaaaauugugccaauuuguuagcaaacacaggucaaagguaccuuuacacuggugacuuucaccucagaaacagugggugaucuucaccagucacccucuuucugcuuuucugccaaggaagggaucauggcuuggucucagggaagaaaggaaggagucccaguuucuuccugguacuuuuguuuacuaauguacuaagggcuauuuuauuaaauagcauuauaagucaacuugaauauauuacauauauuuaauauaugcauucauguauaauauuaauauaauauauauguauaucuuaaaauagauguauauaucuaaauauuauauguaaauauacauguguauaaaauuagucuuauauauuaacauuuuaaguggaaaaugauuuuuucuuucauuaaauuggaaugucaaguacauggcugacauaauuuccuucuagaaaauaagaaccuggcuagacacaguggcucaugccuguaaucccaacacuuugggaggucaaggcaggaggaucgcuugagcccaggaguucaagaccagccugggcaacaugacaaaaccccgucucuacaaaaaaaauacagaaauuagccuggcauggugacacagacguguagucccagcuacuugggagacugaggcaugagaaucucuugagccggggagguuaaggcugaagugaacuguaaucucaccagccugggugacacuaagacaaugagacccugucucaaaaaaaaaaaaagaagaagaagagaaaagaaaagaagggccaaacuguuacuuuuuugagccuuucuuucuuuagaaaucauaacauuuggguggucauagcauauuaaaggauuccuuuuauauguauaccaagcaaaggaauauaggucuacauuagucuuuuuaguuauguucucuccacaaacauuauaagaccaucauauuuaaaugucccaauauagcauuuuauaguaugugcaguagaauagaugccauagaauuaccagcuuugcaaaacaaggaacugccaaauauccaaaauguuuugaguuuauuaccuucguuaacauagcucuugugauacagcucugaacaaaacauagaaacauucucuuggaugauaguucauuuagguggguuuguaagucauugagcaccauuccugggaugucuuuccuacagauacaguaaacauuguaguccuccaguagucagauacuaaaaacagucaacucccagcugagugagggggaagagcggaauuaggaagccacuuucaaaaucuguacagugauaucagacccuugauauuuguagggacaaaucuacaaucuucacaagugaaggcaaaaacaaugaauuucuccuaguaaguguaguaagguauaacgggucccuucaaccucuggaauguuuauaaacuuagaauaaaaauuauuugugaagccagugaaauaaauccuacuacuaagauaaacucaguguauuucaucccaguggagugacauuucaggaggggguuauguuccaaguucagccuaaaagguugaauauugcaugugaccaaauuacuuuaaaaaaaucucauaaauuccucauaauuuaauggucuacauggauuugucuguauugauuuuaugugcauuuagagccauauauuccugccacauuggagacauucauacccuaucucaaagauuuuaaccccuaucacuuuacuuucauuguugggauagauugcuguugaaucaaauggggagucgauaaacaaguugacuuguguuuggcaauguuugugcuuuguaugaaaaauauacguguuucuuagaugaaauuaccacauaguguugucagauggucauacuaugaaagguacacauguacugugaccgaccaagggcucaguggagucaugucucacucuucaugcucacuccaaggcauucacucauugaguugaaugguggauggagucacccauacuucuuccauuuaucucuuucuguuacauguugcaacucuacuauauguuccuauugcaguaacuaugaaccaucugauuuuaugaugguaauguuugaagacaaggaugaaauguaccacauagcagggugauaagagauugcaucucuugagagccauuuacaucaaacucaagagcagaaacaggggaccuuaaaaguaagaaaugaaggauacaaccugggcaagagacaggugugcuucugaagugguagguuuuuaacauugugauugauggcugucuuuuauaguucagcucuugauacauuuucugguauugaaccaaugcaaaacuuauugucagacaauuuuaaaacuccacaccauugacagaugauaacugguguggucaacaauuaggagauuuauauauuugacuccuucauuauuuuaagacuuuucuauuuauuucaacauugucuuuuuucacuucaucucuuuuuacucacaauuucggguugucuuuauccauuucaaucuguaaucugaaucuaccucucccaguuacucuuggcgauauucacauuacccuaacaacucuuuugcaaugcaucguuugaaaaauguuucaccucucuuuuauagcuuuccaacaaucacaucuuauuucagauuuuucccucauccagggcuaucuuaauguuccuuuacaccuuuuaugucugcuccuagcaucagcagacauaaaaagucaagaucucuaucuauguaugcaaauaugucagcauacaauaccuugaacauuguuaauauuuuacucauuuagaacacugaaaaagcaugauaggauuaggggcagaaaaggcccuauauuauuuuaaagaaaaaaaauugcagauuuaaugaauggccugauauuuugucuaugaugauuagaaacuuacauucauaagagugcaaagcaauuuuuuuuccauuuuuagcaaacauaaagucuuuauuaaaccugucccaaaaaaguagagauaucaccugaacucauuuuuguaaacugaccgcagaguuguaaugauucuuuugccacugaaucuccuggcaugacagaacagugguguaaacuuggcuuagucaaaaagucugccguauugucgcaauguaauacagucagcuuuauaucagaugucugaaauucuucucuucuuuagacacauacuuuuagaaaggcacuucuuucuugccauaguuccauuucaucuguuuugaacacuuguuuuggcugagagcuacguuagcucugaggaagugcuucugaauuuaagugaucaguugaugccacuucuguuaacauuaugcaaagaaaaaaaaaguuucuuaaaauuccuuaaagaauauuugcuuagaguaaggauugauuaaauagccacauuggaagcaauuggaaaacugaaaaguuccacaaaaauguugcauauuuuauugggaaggcugaaagguuaaguugcacguugauucuuaggcuggcguggaguucaucauguuguaaaagguguagacagugggacuugaggcuaagcaaauccaaaccucaggacgucuucaagucacuagcccuaaagucuccugcagaaaugcuucuucagagugaaccaggcccagggcuuugcacauugagauccuuguguuugguagcaugauacuugacccaugucaucuggguuguaucuucuccuuugucucugugcuauuugugucuuccaccuaugucacauuauaggccaagagguuuuagaaggcagacugugucauuuccucuuuauuuucucuuguaucuaggauuguuuagggagacaauaugguguaguagaaagauuauaggacuugaaaucagacuaacuccguuuugaaucucagcucugccacuguauaaucuuauguaaguuacuuaacaucugugagcuucaguuuucucaucuguaaaacaggaauaggauacuuauuuuuauaugguugucaugaacacagaauggaauuuuaaaauauaaaaugcuaagacagugcuugguacaugguaagcacucaaaagugauagcugguaucaguguuacuauuaaguccacagugaaagcaugaagucagcguuaugugcaaucaacaaugguaaccgugaacaggauuucuagaaugguaucagcaaccuucugcaucugcuacagugaagaggauaaucauuuuuggcuguuucuaaaaugaguuucuacuuauaauauccuuuuguucacauaggcugguuccccaagugucuagcuuggagaaugagucuuagaaauaaauuuugcuauauucuagaccagugcuaugccaaaaaauuuucugugaugaugaaaauauuuuauaccugcacuuuccaauaugguagccauggaaucaccauguggauaccaagcacuuauacugugauuaaugcaaguaaggaacuaaauucuuuauuuuaauuagcuuaaauuuaaauagccaaagcaagcuagugcagcucuagacaaaaauuuacuaaugauuugacaaaaucaaucuuaacaucuauaaguuaauaaaaguaugaacuaguaaauacuaaauuuccaaugaguucauauuuuacacacaccgaacuuuauagaaaugauuauuuucucccaagugauagauuauauguuucaauuuucaguauuauauacuaccuuacuuuuggaaauauauucuuugaauucauccauuggcuucugagugauaaauucacauugucaaaauuugucagccucaaauccaccaguuccuucuuuuaacuugcgaggauuuuuggaucuagucuucuuacuguucuguaauuuuucuucuccccauucucaucuucuguuacacaaacaagucacccuauauuaaagauggcgaaauaauuuuuaagucacauaauguuuacuagcaggaauaaaucacuaccauugagguauuauaguuuaugcuucuuuuucuuuccaggcaaauuuauccuuuugaauuaagauguuauauaauuuuucaaauagguuuugcauucauuucuuuggauauuuuuucuuaggaaaucaggaaaaauguauaguagaguuucuuuuaaugaaacuuuuuauuugguucuacuuaauuuauguaaaaaauauauuuuaauuaucugaaauacagaaugcuucucaaauuguaggauugugaaaucaauuuuauagauugaagcaagaaauguuuuuuuuuaagaaguggaauuggacaggcauaguggcuaaugccuauaaucccaacacuuugagaggcugaggugggaggauugcuugaacucaggaguucaagaccagccugcgccauauagcgagacuuugucucuacuaacaauuaaaaaaaaauuaucuggguauggugacacaugccuguagucccagcuacuugggaaccauaucuauaucuauaucuauaucuauaucuauaucuauaucuauaucuauaucuaucuauauauauaucuuaauauauauauaagauaagauaaaauaaaaguagaauaaaauaagauggaauaggaaaugucagagcacaucacacauaguaagaguuaauauuauuucuugaaaugcuucuuacauuuauaugugugugugucucugaauugugauuuaaaauggauuuuuuacuauggaucuuggccaaaaaaauguuugaaagcaacugcauaauuuauuguacgauguggugaaggcagugaagucagaagaucugguucaaggcuugaguguacugcuuuagacaauuuucaaugucuucaacccaaaauuucuuauauguguaaacagagauaccugcccuauauguuucaugcaguuguuucaaauaucaaauagaauucuaaggugauguauaguuguaacacuccuuauuccuuucaaguaauaauuuuauauugacaaaacucaguggcuugcaccaacaaucauguauauuuauauuuaugagucugcaggucagguacgcuuuggcugaucugugcuguauuugacuggguguuucugcuucaggucguggguugugcauugucugggccaugguugggguuuggaucugaucuccauguauucuuucuguggucuaagccaaaggggcagcggcuacccagugcauacacuucucaugguuaaucaccagaacaugagcuaaacauaaaucuauuuaugauuuuugcuuacauuauagccaugcaaauuccacuggccaaaugaaauuauauggcuaagcccaaagucccuggggagacauaagguauuccacucucaguggaagggagaugggagugaauauuugcugaacaacagucuaaauaaacuaucauauuaccccaaaacuuauuaaacccacacguuuauuaacugccucauucuuaaauauaaaaggauagccaaguauuauccuguauuugaggaaaaccuacaacauaauggaaaguccaaaucagacaaacaagaaaggaauguggaggaaacugaggcaacauauaauaagcaaaggaaaacauuuaaauacuguauauucuaauagguaaaauauuauauucauagauuaaaauuagcaugcuauguaaaaaaguguccguaaaaacaagaaauagcucauagaaauacaaaauggguagaaaauuuucuuaacguucaaaaugaggugucaucagucaaagaaaucuuccagaaguuacaaucagaagacagagauggaaaauauaagaaaaugagauaaucaauccaacaacuaauguccuggagcuaaaguguauggcauuaaaauauuuuaaaauaguagaagaaaacauccucaaacugaaaaaaauaagccuucagauugaaaaggacucacugaaaacugcgcacaaggaaugaaaaacagcuccauuccaagauucagcauugcaaaauuucaaaaugacaaggaaaaagagaugacuguaaaaguuuccagaaagaaaaaaauguaaaucauagaccaaguacuaagaaucaggauggccuagggauuuucaguuguacuauuaggaucuagaagacaguggaauaguucuuaaaaauccugaaugaaaacuaauuucaaaauagaguuuuauacccagccaaacaaucaaguguacacauacaauaauagcauuuucaggcaggcgaauacucgaaaauguguuuuucguguaccuuuucuuauuaaagcuaccuggagauuguacuucgaccaaaaaagggaauaaauugagaaacaugaugacuuaugacacagaaaacagagaacccuaaaagagcauagggaaggcuugacagaagauagagaucaaccaggccauacauaaggugccaagaaggauauauccaguucuuaaaagaacauacacuuuaucuaauauguucauuuaaaaaaaauuauugaugauuguuuaacagauauguuugaauauuugggggaaaaugucaguuaucuagaaaaacaaacuauuaaaaaacuagacaauucuagaaauaauaaaaugauacauaagaaaauuaauuuaaacaagauaaugcuugucucagcagugagcaaauuuuucauaaucauuauaauguaaaugaacuacugacuaaugcuuuaaccaaaaucauuauaugggagcaugagguggguauguaggguggguggugcgagaccuaaauugucacccuucuucacguaagaaaggucuaauauugaaaacuuaagaaauagcaguauaaguuugucuuuuaaaaaugugaagauaaacaucagaagaacuaauggugcaugccauuggagauuagguuugaaaucggggagguagaccaugggcacugcuguuccuuguuaugagccauuuaauacuauguaacuuaaauuaggugcauuacuuugaugggcaaauuuaaucaacaauaaaaagaaaguuaacauaugcccaugauuaagaaaaaaacuuccuacaguguggagggauauaaaugaacagcaucaagucucccuuuuccaaauucgauccccaguacuguuuucuugcagugaccacuuuuaacaguuucuacuuugaguuguucuggugguuauagucaugacuugaaagauaccuuuugauaagguguaaagcuaucuggaccugccuuugcccaguuagccaaaagauggccacaucaaacugcacuguagacaugcagguuaauagugugcuuugagaguaauguacaauuggccuauggcuguuguuggucuuucauccccaagcuacuauauacagccagggaagcagcccugaccuaguugggugaggcaaaggguuauccugccagugggagcauggcauuucuggcaagagauuucucuucuaacgguuggacuuggugccauggcagauuuuccugacucagggaguaaguguugagcccugguccagcugguuagauuauuuguugauuuugauuaucugcaccaauaagcucuuucacuggcauggauaaucagaagcaggcaguaauuuuccaucuuccuaacaaaaaugcauuucacauuuugaaauuacaauagaugaaguuuuauucaguuuucaccaaaauacugcuucauugagaagggggaacuuuuaugaauuaaauugagaacucuuuagagauagucauauauucuuaggugggucauuuuuucuugucacuuugcuguucuugaaagacagagggaaaaaucaguaauaaugauauuugcugucuuuuagucagauuuuacuaugugcuaggcacucugcuaaguauuccuagccuaauuuaaucuucacaacagcuuuagaagcuuguuaucacuccgauuuuaggaggaagaaacuguaugauagucuaaugacuuguccaaggucacagaaaagugccagagcugugucuggagcccugauuugcguuggcuguuagacccauguucuuuaccucuguguuuggacuguuuuggcaacgcaacccuugacuuuuuauuacaugaggaaaagaaagcagcuaauuuguacuuaaaaccuaauuaccaguguaagguacauauguuguuauuguugcauagugcuuacaaaaauuguaucuuuucuuuuuaaaaaaguuuugaauuuuauacauuuucuauucugucauucuuuugucuucucucaauucaaaauuccggaguaaucuuuggucuucugauuccucuccuuuuauuuccauaaaaucaccauuuucucuuuauauuucuguuuuaagucccuccacuccucaugucuggaauacugcaauuaucuuuucauggucucccuuccgccauucuuugccaccuuaaacugauuguacacauugauccaguuuucucaagcucaaccucugucauauugcauaccuguuuaaaccauuaaugucacccuauuaucuauaagaaaaauguagcguuauuaaucuacaauuaaagagcuuucauaaugugaucuaaaguaucacuccggagcuuuugugcccuuacuucuuucucacuuuucuugcucaugcuaauauaucccucaucuggcuacugaggcaugaauuuucucuauaacucaguugguguuuuuauaugcuuugcauuuugauagucuucuuguguaucuaugucucauuuacccagaugaauuauuaacuacugaguuuagagaugggaacucugaauucaucauauuauuuaguauaguuucuuacauauaggacuguguaagaaaauuaaugaauaaauuuuugaaguuuuaaaguuaaccuauaauuccaauucuguauuucuuugcuuuuguuaauuuuauaaauguuaaacaauacaaauuuaauagucuuuauuauuuuuaucucuuuaauuauauuuaauuaugaaauuggaaauauauggguauaacuuuaauaacacaguauuuuaaagaaauaagucaguuuaacuuaguauuccaauuugaaagauacagaaaaucuacagugaaugaaaaugauacaauuauuucacaguuuuucaaauaagccaauauuugagaacuguacuaaguuauuauauuguugguuaauguaugguuuugauggagauaaacugaauauuuauacuguuaugaauucaagaaaaaauguaaaugaauuauuuaauuuaucuuccaugauguaucaaauguaguuggagauuguucagaauauugaauaaggacaugaggaaauuuggaaguuuauuuaaauacuaaauuuaaaucccucuacuuacacaugauuuuguuuuccaaaaggagguugcaauuuuuucuguaucaaauuugcuucuugcuuucugcugaauuugaaaauguuucugcccuuucuuuuuuuuuuucuuguuuuaauagccuaaauauuuuuaaagguucaucuuuuauuuucuuuggcuuaauuuuacagauguucuauugauaaauaaauauuucuacuuuaauauauaaauuauuuaaaauuauggccuauauaagauauuuuugcuuugaaauauuugaguuucaguaagauaaggauaauuucaucccgaaaccaaaaaauaaaccuucauaaauuuuauauauucauauuugucuuagaguguucuuguugacuuuuuaaauugcaaauuuaaauggaaauauuauuuuagcucagaaaucucauacacucucaaugcuuaaauuucucaugcuuuuuuuuuuccuggauuauuuuuuccaaguaauauugaacaucauaaucaugccauuuuuuacaccucacauuuuucgaaaaucucucuuauuuauuuuaccuuuaauuuggguuuugaaacacccaaaugaagccauaaauuuaucuuuuagaauaaaaaguacauacuugauguaaaucacugcaugugucugauugaaucucacacaaaaauguuacuuuuuaaaggcagugguauuuuaaguaaauauuacuuuuuaaagggaacgacucuuagaaugaaagugcaauuauccacuuugacuacucucauuuaaucauuucauuuuuaaaauuagauuucauuuuacaauccaaaauaaaaccucauucaugugcauuuuuggaugugcuaauuccuuuugucauaaaauggaagcuagccuaaauuuucuaauaauuuuuuaucaaauugaaauucauggcaaaaaauaaaaaugagcuaauuuugaauucaagugcauguauuuuauauggaugcuuuuuccccuucucucuaccuaaggaaauagagaaauugagaauagaacuggaugaaagcaaacaacacuuggaacaggagcagcagaaggcagcccuggccagagaggagugccugagacuaacagaacugcugggcgaaucugagcaccaacugcaccucaccagguacucccuaaucccauuaugcgccauagcaccgauuucauuccacugauuuuugccacaggcuuccaaacaguuguuagaguuagucuuagucauucaauucacacuuagcuuucaggcauauuaagaaaaguggagaugugguaagcaaaacacccagacaugugaaugauaaguguggcagggaauuacugauagauuacaaaaccuuucaucuacaaugcucaaauauuuaggugauucucuaucaauauaagcgaaaugacauauuucuccuaccaccacuacuaccucuucugcuaauucuacgucuaauaaaaaucuugaacugaaggaugugaggaauucauuuaggaaaauaauaaaauacugucaguggugagagagacaaaguaaauaaauuguaagaugcaaauugaaauggaacugauacaaaauaaggaaucugcauccuaaggagguguaaaauuuugagaugaaauagauuggcacugcucauguucaaaucauuauuauaaccaggcuuacaccauugagguuucaaauuacuucauuuccaucaugagauuuugugaugugaucaucauugucaucaacuuuaguaaauauguagcucggcccuaaauuacaguaagacucuuuagguuguaagcauugugaauuugcugcauuggaaaaaaacauacacacacauacacacacacauaaauacacacauggaaagaaaaauucaaaagagaaaguagauauuucacuuuaucauaugugguuucuuuucacuuugaguuuuauuacgauuuugcaguguucacaucaagccuuugggguugcucaguucuuaaaguuuuucaguuuuuagagagaacuuuguuuaaauaaacauguaaguucaugauauuugguuugguuuauaaauuagaaaaacauuggucuuccaaucauaguaauauguugaauuuaaacuaugaaaggggacugaucccuuuuacauuaaauaugacaauguaauucugagcacgguaugcuaacagauggagaaaagcaccacuugaacagccugcguuuggagaaaaaaauauucuagagguuggugaaccucccaaaguuuugggugaguguuaagaugccucugguucuguuaaaaucaaaccuuguauaaaacauuuuguuaugauaauauuccaaaugauuugacaucuucccuuuuaaacaauaaaagaaagaggaaagaaagagaaagcaaagaaagaaaauaaauuauuaauacaugucugguaucuagaaaaaaauccuaauagaugaaacacauauaugagaaaaaaauugcuuaauauugcagaauaauaacuguucuuuuaaugcucauuuaaacuauugucauuguagaacugagaacauaacguuagcauaauuccuguggcuauuuaaucuuagaaguuucagaauuuagcuucaucaugguaauguuaauaguuuuucuuuucugucagacuucuauucagaaccaaccauuugugugcuaagcacugcuaaaccucagaaauaggacagcuuuuaaugucucaguguggcugagcuucaguaaauaaauauuaaugcugguuuugccccuuuugccauucugucuuauucagagaguuaauuucugaagucaaaguccguagagaguuuucccguauaguaucaauuuauaguguuugacaagaucaauuucuugcaaguagagcauauuaagaugcagcaacugcugaaaauggacgagugguaacuaauuccuuuguucuuaagaaaaacgguuuugcuugguuccauagaaagcuuuuuuuuuuuguugagcuuuauuuaaaccaauucuacuaaaauuuaaacguaguuuuacaggaaauaaaaauuauuuucuaagugcgguacucuuuuguaagcauuuuaugcuuagucuauauucauguuuuauaaaauccacauucauaaauuuaaagaugacaauuagaaaugcaaggaacuguguauaucuccccuuugcacugacaaugugauuugguuguugggcuauuucugauauauaguacuuuuuuguuuuuuugguuuuuuuuugaaguuugccaccccucaccauacuuuauugauucaguauacucaggugugugacugagaaauguugugucguucuuuuucaguguagaucagcugaaauacauaacucccacgcagauaacaccuuaccacacagucucaacuuaaacacuucaaauggcauauucuaaacaaaguuuaaaauugaauaugaaaaccguguuuaaaguaaugaugaaauaaggauccaaaucuuuagaggcaaagaaaauuuaaaaacuguaguagagaucuguacaucaaccuaaaagaaaaauagccuaccacuuuuuugguguuucuccuuaugggauuuuaaaacgguaaauagaggccaggcgcagugcucacaccugucauuccaacacugugggaggccaagacaggggaaucacuugaggcuaagaguucgugaucauccugagcaacacaaugagaccccaucucuacaaaaaaacaaaaaauauuagucaggcaugguggugcaccuauagacccagcuauuuaggaggcugaggauggaggaucacuugaacucugagguucaagccugcugugagcugugauugcgccgcuacacuccaacuugggugacagaguaagacccugucucuaaaaaaaaaaaauggaaaauagaaauuuagcauuaauuaaaggacccaaaugggugaguguaacauucacuuagucaacaaauauuuacugagcaccuacuauguuuuaaguacuuugcuugguccuaggcauagagagaaaaaauaaaacucaguuucuacccuuagauugcgcauacucuaguaaagaagcuacaucuguauaugcaaauguaauagacugugacaacagugcaaugauaaaagugaugauuaccacaggagcacauagggagggggauuggcccauucuacaccauaggugaaggcgauagucaaagaaagcugauaucagggaaagcugacagugaaaagggauagucagggagguggagauauuuggcagcaaucuugauuagugaguucaugaguaagaauucugaaaguggaagaaaguggguuggguaccccagguagagagaccaauauauacagagacauaaagaugggagaaaacagaaacucuacuaucagauuagguguuugguaggagauaagacuggaaaggggagcagggaccagcagaagagccuuaugggccaucuccggaguuucgcccauucugaguuacucuuaaugcauuuuaggcaggagcgucaacaugauugacuuucuggguugggagcuggacucagagagcaguguggaaagugagcuuugagaguugaucuaggagacaggaagaccaguuagcccaaggucagcaauugcaacccaugggucaagucugacccaucaucuguuuuugugugaccauuaacuaagaaugguuuuuauauuuuuaaguggaugaaaaaaaggggaaacaauauuuuuugacacauaaagauuauacaucuauaaauaaaguuugauuggaaaaugcuaccauuauccuucauuuauuauguauggcacuaccacacuugaguugaauaugguccucaaagccuaaaauaucuacuaucugucccuuuacagaaaaguguaccaacuccucaggaggcuguuuaguucaaguaagaagucaagagggcuugaauaaugacagauucaaauauguauuuaaagaagguaauugaagagcuuugugaaaaauggauggguugagaagagaugacuggcagggaccccaguuagaauauaagcaccauaguccagggggagaguaaugaagcccuuggcuguggcugucccgugaaguggaaaggaaguaguaucuucagaagguauuuggagucaugaauaagagaggacacaauuaaaggugacuguaaguuuucuagcccaaauugacuagaggaucuguuaagccaacugaggaacuuaaaagagguagcagaggaaaagaauacuuuucauugugcaaccccaguggagauguccaauguuggcuuggugugaggagaaggucaugacuagaggcuuagaucuggaucccuuuuacauaaagguauucauuguagcuaagggagugguuaaaagcacauagaaaggaucauguuuuaaagaacaauggaagaacagccaccagccgauaagacugaaauggggucuucgaauauauaagaaaagaauaaagaagaaugauucgaagaguauuuucagggggcaguaacaauuaaaaccauauacuuuucuuaggggagguccccagacagccuaggauugaagaaaccugaauuauaguaucuucuguaggcauucacuccaggcauucuuugcaacuuuugacaaauuacuuaacucuuugggccugcuuauguaccuauaaaaugaggugaggcuagaugauuuauaaguuuccuuccaguucugauaaucaaugauucuaauaaugauuuaagacaacccauuauuaaguuccuauaucuggacauuaggcauuuaaauugcuuggaugaucuuuuguuuaagguauuuccuuaguuugaacuucagaaaguucauugaaaugaccuucagacccaccacuuaaauucauuguaacuuagguucugcugaccucucacaaagguuaucaaaauugucucaacacccuuccagucucuuuugcugaccauugcccggugaauauucauaagccucugccuugacucuguugcuauacucugaaaaccuuccauggugccacucuauuagagaaaggcaaaugacaacauggcaugugaggucauccugauaggcucucaaccuuccagucuuauuucaucuaagaugaaacccucuuaccugcugauuuccagacaaaugucaguacacauagcuccccuuuuucccuccauuugcuguucucuauaccuagaauaccccucugaccuucucuagcucuauuauaaucuuaccuucuuaccaaggucucccugaaauccugauuuuucuaccuaggccuccccauugauucuugucagaaaggagcgcuucuccccuugaauccuucuucccacuuugagcugauggcauuugaguaaaugaauuacucaaaggaggaaaaagcaaaauguggaaaaaaaaagaauuaauauuuggaaguuuuuuguguacuugcuauuuuuugcuucuggaauguguuauucuucaaguaggaggagaggucuuaucaguauuauauuucucagagccccuggcucaucacuuugcagaguuggagcucaguaagucauuaaugaaaauggugacuguauuccaaauguaugacuauucuuucaagcucaguacugcuauacaaauaaauaucuucucacaaauaucagaguacaaaguauaagaaggugauaaggcuaaaauuuuuuauugagaauuuuacuugucucuaugauacuauauuaugauuuuguaauaaucacuuuuuuaaauuuuuaacuuuguguaaauauauauguuuaaguauaucagaaucaaaugauaaucauucuaacaaacaaugcaaguagguuuaguaaagugcaccaggccucucacuuacauguacguguuuaaaaaccacacacacacacacacacacacacucacucuuaaacuagaguuccgcauaauuaaaagaugacaguggaagccauguacuguggugcacaccugcagucccagaaacuugggaggcugagguaggagggucgcuugagcccaggaguucaaggccauccuggguaacauagcaugaccgcaucucugggggaaaaaaaaaugacaguauuugaaacaagugccucguaagcauguucacuaaacacgucuagccuagcauguaugaaaacaaagcaaggcugcuuucuuccaguuauuacuguuaauauuauucaaacaacuucuucuuuuuccauaacagacuuucagguacauuuaaaaauguucauccauuuauucacccguucuacauggagcauuuucugucauaagacgcugugcuagggaugaagggagauagaaagauaaagaggccucagcugcugcccuucagaagcuuacaggcuagcggggaagagaagaaaauacaugaguagaucgggugugguggcucacaccuguaaucccaggacuuugggaggcugaggcgggcaggucacuugagccccaggaguuugagaccagccugggcaacguggcgaaaccccaucuccacaaaaaauacaaacauuagcugggcaugguggugcgcgccuauagucccagcugcucuggaggcugaggugggaggauggcuugagcccaggaggucaaggcugcagugagcugugauggcacugcugcacuccagccugggcaacagagcaagaccuugucucuaaaauuaaagaaaaaaguaagaaaaagaacauacacauguagucgguaagauaaaugauaagauccagaagggagguucuagaaaaggauuacagggggagagacagauuacuucuuacugauuuugguaggauuuggauauaggaaaaugggaaugaagggcauuccguguaggggaaucgaugguauuugggaggugugcauguauguauaagaguaaguuaaauacaguacacacagcgaucaaacagacaccuaacaaguaucaccucggagguuaagaauauauucaucuuaggccgggcacgguggcucaugccuguaaucccagcacuuugggaggccgaggcgggcggaucaccugaggucaggaguucgagaccagccugaccaacauggagaaaccccaucuguacuaaaaauacaaaauuagccaggcaugguguugcaagccuguaaucccagcuacucgggaggccgaggcucaagaaucacuugagcccgggaggcagagguugcagugagcugaguuugcaccauuguacuccagacugggcaacaagagugaagcuccaucucaaaaacaccaccaccaacaacaauauauucgucuuaguaucugcgugguaccacgcuacauguagcagcucuuuaaaaaauaauagaguuauagcuaacagcaguggcuaacauuugcugagccccugcuguuccaggaaccaagcugagagcuucucauauaauccuaccaauagcucuauaagguacagacuccuauuuucuguaauuuacagcugaggcaacuaaggcacagagaaggaaaggagucuucuaagguuacacagcugauauguuaucgaagcagguuuugaaccccaguaaguugccugcaaagcuuguacccuuauccauuaagcuguaauucuauguaaauuacuagagaaauggauuaaugcaguuguucugaaaaagacaacuuagaaaaucaguaacaugaauuuauaauagaaauaaauguuagcuucuuccggccgggcgcgguggcucacgccuguaauccuagcacuuugggaggcuaaggcaggcagaucgcgagaggucaggaguaaucccagcacuuugggaggccgagacaggcggaucacgaggucaggagaucaagaccauccuggcuaacaugguaaaaacccgucuccaguaaaaauacaaaaaauuagcugggcaugauggcacacguccguagucccagcuacucaggaggcugaggcaggagaaucucuugaacccgggaaguggagguuacagugagccgagauugcgccacugcacuccagccugggugacagagcgagacuccaucucaaaaaagaaagaaagugagagagagagagagagagagaaagaaagaaaggaaagaaguguuagcugcucccuuaugcaugacacgugacggugaauuuuggcuugaauuuuuccuaagaaacauaguuucccuuggcccauuauuugccauugucauuuaaacauauuauaaugccauugucauucuacuuuacucccuuacuuaauuuucacccaagaagaaagagaggcuuuuauuaaaaaguagaaauuuuucaaguauuuauuuuugacauguccaaauaucuguaaagagcuauagguaucaccucggagguuaagaauguauucaucuuaggccaggggcgguggcuuaugccgcucauaugacuaccauuuauacacacgugguuggguuaauuuacgauauggcugaauaaagcaaccacuucuuaccguuuaugugauucuuauuaacugcuuacugagacauucuuuuccauaccuuuugcccauguacugaaacacauuuuuuuaaauccugcauuuuuuuuuucuuguaucugaucuugaggggaacuacugcaggaagcuuucuuuuguuuauuauccagagaauuuagaacucggauugcccuaaguacaaaaccuuaaaaauucuuauuucuccuuuuacauaaaugaucuuuuuaauaauauguauguacuucaaagaauuucucagagcaggaaucuaagugagaguccaccaaacagguauuauacugugaccuacuuuugugauccagaugggaagaucugaccugugaccuagagagacagcaacuugaccuauaggauuugugucuuuuugaaagugagaaaaggguacagcagaggagucacuagguuaaccuguuaugauggauagaucauguggggagagugauagaggcugccuuuccagggcuuucaguuuccacauaguaacuaguacaguuacuuauuuguuucuuuaauuugaagcaagagucuugcucuguugcccagccugcagugcagugguguggucuuggcucacuacaaccucugccucccagguccaagcaauucucgugucucacccucccaaguagcugggauuacagguaggcaccaccaugccuggcuaauuuuuguauuuuuaguagagacgggguuucaccauguuggccagacuggucucaaacuccugaccucuggugaucugccugccuuagccucccaaagugcuaggauuacaggugugagccacugugcccggccucuaguacagauauuuucuugaaauuaauuguuugaccucccagccuauccauacgagucaggacuuuuugggugaacugaaauccaaaaaggagaaauugauaaauuuuuauaacuagaccauguacaauccaggugcagcuggacucaggguuuccuggagccagcaugcuaucauauucuaacuuuccagaacagggcucaauuucuaucugaauuuugcuaauucuuucagauucuuucauaccaugaaguaaaacaucuuucauucugaaauugaugauaaaggaaauaccuuugauuucaaacuguaagaaugugacuuccuagcuccuucacuuccaauuucaaaaccuuugguuaggaucacccuugggcacacacacgcacuuuugggugcuguggcugguagccucuucagaaccacauggaauaagggaagaaaguuucacuaaguaaggggaagugcucuuacuaggggaaaggugucagggauccugggugaguaaaacaccaaguaucugcacuguugcccuuguugucuuuuuaaaaauauaaucccuggucaggugccauggcucaugccuguaaucccagcaccuugggaggccaaggugggaggaucacuugaggccaggaggucaagaccagucugagcaacauaaugagaccccagcucuaccaaaaaaaaaaaaaaaaaauuaaaaaauuagccaggcaugguugugcaugccuguaguccuagcuauuugggaggcuacaugguggugcgcgccuggguccuggcuacuugggaggcuacgugguggugcgugccuggguccuggcuauuugggaggcuacaugguggugcaugccugaguccugguuauuugggaggcuacgugguggugcgugccugaguccuggcuauuugggaagcuacgugguggugcgugccugaguccuggcuauuugggaggcuacgugguggugcgugccugaguccuggcuauuugggaggcuacgugguggugcgugccuguaguccuggcuacuugggaagacugcuugagccugggaguuuaaggcuacagugagcuuugauugccaucgcacuccagccugggcgacagagcgagacucuguccccccucccccccccaaaaaaaaaauaauaaauaaaaaugcaaguccugauuuuuccucuaagaaaugguuucaaguggagagaggggagugaagugcacauuuuuguccauguauguuggaaaaugauauucuccauugucaacaugugauaaguccaaagaggcaucaucaguucuucacaacaacagggucucuuuguuguuuuacuuagaaaacucuuagaauauaaaaagaaagaagcacagcuaaaucucuagcaugcacauguauugugcuugguuucugcauagugcuguuccagcuguggcccaugauggcugcuuguuagugucuauggcaagauaaguaccggaaucuacagaaguauuuggcaaauuuuauaucaauuuuaaauugucacaauuuucaagcgcaugaucaaugagcuuuuuuugggggaguaucuuuuaaauuuuuuucuaguaauucauuuuuauuguguuuuaaaaaacuauuugcaaaagauuagaaauuaaaacaaauaugcugaucauuuaccacaagaagcuugagaugcuaugcuucucacugcuuccagcaagccuaagaaaaaacaguccuuuauagaugaggaagccgagccuccgaaggggaagcuugagguugggcauccaggagggaggagaguaggcaggggaugaagggcaaaagcuuguuucaaacugagauagaaacacuuuugguguuguaaaaucucagcacccagaccaggaagcaggucucuuucaucucugugcccccagcaccaagucaggcacuggguguuuagcagauuuucuauaaacauugaguaaaguucccuuugcucuuuauuauugggaaaauuaaaacaaaaaguuggggggaacucaucuuaagauaacaacaagcuuaggucaaaaagccaaacucauuaucuguuuauuugaagaggauauuauaacauugauguauauucuugcuauuuuacagugaacuuuaucuuuuuuuuccuccugaguuuuauucaagaauuuuuagccuaaaguuuccauuucaaaguuaagcucauuuuuuucuuguacuccuuucaugaauaaauuaagcagagaaugugucaaaaauaauuuuaaauggauauaugugcaaccaacaucuucaaggcuugaaauagauggccuuggugcuguuuuaaauugcguccucuuuuccuucccccacccaguaucagagaaaacaggcugucagaaagccagaaaagaaaaggcauuucauuuugcucugguggacaccacacugccugagccugcucugcuccaccuguuugaagggcuaagaacccuggucucaguguggcccggggcgggagagguucgaaagucaggcagugccaggaaauguguguuugcagguucugcuuaacguucccuggcucgcuccucucaguucugugaagcccaaaugugaaugcaaugaaaaucuccacuggggaugcacucaucuccccugccacauaggcccacagccuggagcaugguggcagcggcagccaacucauuuccugaagaagcccagaggaaaccgagaauguauugcccacaccacuugccugacucaacaacaaugagcaucagguucaaugaaaauaggaaagaaaaagcaaaaacauagaauuguucucauaguagcccuaagccagaguaugucucuaaaagaaaguucugcucuccaauauuauuuuuaaaguaaaaggaauauaacaaaagcccaucaccuugauguuuaauuucuuccgguaaauuucuaaaauuaauucacauucuuuuauauauauuuuuagaggcacagucucgcuguauugcccagccuggcuucaaacuccugggcucaagcggaacucccuccugagccuuucaaguagcugggaugacaugugcgugccacugugcccgccuuugauauuuaguuucuucuuaaacaccuccuccuagugaauguguucuuuacaucaguuguuaggcauuacugccuuguuauuuaauguuuccgugauacccacaaaguacaucgugauuuguugauugauaaaucuuggaauuaaagcucauuuuaaggauccugagcaaguaagaggcuuagggaauauucagucuccucagugcccucucccaagccaugucucaugggagaccagggcccacuucaaguaaacacauuuuuauuaugcugcaacucuguuagagccaccaagcaaaggaugcagucagucucgggagaugagaguaggcaccaaacaggucagaaaauguuuggaagcagcuugccaucuagcugagcuaagagugugcuccaccuuggcucuguguggccucuccccagcaggcagggucaccugugauagggcugagcaucuccugccuugaccaagccauggaggguagagagagagagccacaggcugcuugguuuucagaauaucaaagggauuccuuccccagggugggcaccagugaauaagcagggcaucccuuugacaccuuuccuguaucuaacuucaagaagccuauuccugaccaggagauuuaccaaaagaaugaacccaguguugaggaaauaaccauuagaaccauaugaacaaaagagguaaacaaaauaaagagcaagucacuauuggaaugugugcaggaggugggggugguaggcggucaaggugaagcauucagaguggguuugggcagugguuugggcaguguuccggauuugcccuuugcccaguagcucaucugaaguguggcucaccaggccuuugccugguagcucaucugaaguguggcucaccaggcuggacguugcuugagcuugacagucguccuaguucuauuucugauuauuuuuugucaccuuggggaaaauccccuauuguacuugauuuccuacagaccuuaacugugauuuuaugaggauauauaugaguaugcaaaaucauuuuaacucauucagcguuuuguaaaucugaggcuuaucuauucagguacuccaaugauuuuaauaugaguucagguaaaauaaauuaaugaguagucaguguauugauccgucuagaaaacuuuagagcaauuaagggcaugaccaccugacugaagcucuuuauggcaaggcuauuuggggcacagaguaauauauuguucuuucuacaucuuaaaugauccucuuugucuuuagaaggcaaacuaucuugccauuccugauaucaacucuuugucaaaacaauaucuaauggaagcagcucugugcccuaggggcucuguaaguucugcuuuguuacagugauggcaguucucuauucuuagccuauuuccgaagucaggcauuuguucggaaucauucacuauugaauuaguuaacaacguuugguuugaggaaagaugauaaugauauuaaggaauaauaaaauccaucuacagugaaaaucgagcccagaucagaacuguggaggaacccaaauucagauccuacacucaaacugauuugcacaaagaauuaucuguuaaaagugggaaaaagaauggcagcaugcgacaacucacguaacuaaucaacuuuuuagaugccguuucauauguuugcuuuucauuaaaugcaggaaugguugggacuauguugcugugauucagucaacauuuauuccuaucuguuuuucauguacaaaggcugagggaugccagcaaauaaacuguuaacggagaauuaacuucuuuggcaugcuuucauacuuaucuuccaaauuaaagaaaaugaaaugggcagaaacagaguguagauuaccuccuuuuugucaaaaauggugggaauuugaaaauuaauaauaaaaaagggaacagaugcaguaacaugccagagggagauuaauguggagaguaaaaucugugagcaacaaaacugaagcaaacugaaucagugggaggugguuguacaaucaaaaucaggauaaaagagaaauuacaaacaacccugcacuugucaaaguaguaguaaugaaauccugacucugccagcagugagaaccuguguuagcacuuugggguaaggaugguagccgggugccagguaggagggcaguguuagguugcugggcagcagccaucuuguguagaacagauggcaccgaaagcuggcaggggaggggcuccuuagcagaacuaaucagacaguaacagauagggcagcugggaagacugaccacagagagggagucugcgggguagccgagugccaugauguuugcaguggugugcccauuggucugagauaagaccuugcaaugucuuucccaucuacagaagaacugaaacuuuguucaaaaaggaaaauugaguugaauugugucaaacuuggagggugggggugggcauugggauagugacugagaaaggaagaauuguccaucucugaauuuguccugugaguuuucaguuccagcuaccauggaaccuugauuuuugcuguuuguaugguucuggcaaucuaauguauacaguguggcacauggaaugaucacuuuauacauuuuaugcaucaaaaaguuugcaguaucaaggcuauaguuaaaauuagaaaagauuuuuuuuauaugcuuucuaccacauaugucuuucacaaaaugaaaaacuaaaagcaaccaugugauacaggcauuucuacuuaauaauuuuucauaagcucauuuaagcuguguuugauucagagucacuugcccuucuuuuuucccccauguaacuguggguugaacaucaaaauauaagcauaauucagagccaaaaaccuuaagacaaaaaucaaaccaacucauucugcaaauaaaagagaaaacugaccuguuaaaauuugauaacuuauuaaguagucgugguucuugaaguauagaguugggacguuuguauuaaaacgacgacuuuaacaaagaaauccagaucuccuacaucugcuuuugaacuugucuauuucuuuuuuuugcagaagguuuauaacuuggcucaauuuauucauuuuggagggggagggggaaacauuacaggauuugaaauaggugguauaacauagccauaugcuauuuaugcagcaguuucugcaauaaaucuaauuuggugcugucaaaaaauuagacuuauuugauauagcagcacauuaguaaaugauuguggcagauuuaaaguugucauuuagucucuucuuacucuuaacagaaucucgcaaauucauuuucccccuugaucaacucuaugaaaauaucccaguucuuuguccugcagcccugaaaauauuuccacaucugaaagaaggucuugccuuaagguaauugaggaaggggguggaaaaaugaauauccucugucguuaaaagacuucauaaauauauaggcagaaaaacaaauaaaccagagaaaauuacaguauuuucaucauuuacaguucuuagaaaaacagaacugcaagucucauucagaauguagauaaauuaaggucaguucuuuauuaaggaguuuaaauauuuuaccuuccauccuacguccauaugcuguuuuaggaaaacugauuauuaaagaaugugagugacaucagcucuucgccuucaccuagcagcgcccuuagaaacggcuuuacucuucgguaguguaaccuggcaacauugcuucaaugccucuuuuucuguuuuuuuuuuuuccccuguaaaauuuguguuucagguguuaguaucaaacuaucuaaacuuuuuccuaguuuuucuguuugaaagauaagauaagcaaugacgcauuaagcagguaaauauuaacgguguucucugaguuccugaauuaguccauuuauaaaaguaaugauuucguuucccguuucuuuuucuugcguguuuauggaaaaguguauguguguaucgcauuuacgugucugugugugacuggaagugauguuaaaacugagugcuuuucauuuguuuauguucguaucauacaaauuauccaaaagaaggcuacuaguguguuuuugaaacgcaguuuacucagagugaagaguuccuucacggugauuuaagcagccucuauuaaacuagcaucuugcaaaugcuucuuucuuuuauacagcaaaucagaccauggaagugaucaaauuaccaggauuguuucacugcuauucagaagcagggauccaggugaccaaaguacugucaagcacagauuacacuaaaggaaaaauauccagaaaagcaguaacaaacuugcugggaaaacuuaaucaauauuuuugaaauuuccuccacaugaagagaaauuauuuagaaaggauguuuuaggaagaugaagaagaaaacaccuccuagaauucauauuuugaguagaaaauccauacauuaaauuacauuauauauuacaugagaaugauuuauaugacacuggguauuuugaaggucagcaauaaaauugaaauuauagcuaagaagcaugucucaguacuuagauuuuaaccuaucuuuuugauuuuguuucuguuuuuaauuuagccucacaauuuuuaaaaauaugucugaaaaacugcuuugauaaaauccuuuucauaaauuauaacuguuuaaucagucagaacuuuaagauuuaaauuuuaaauuccacguuuucuccacugcuuuuguuaauaaauuugacauucaauuuuauaucaauaagaaauauuuaauuuuuauuuuuucuaaaaauuuagaaaauuuuacagacuugauugauuuuacuugauacaagcaucugccauaagauuaaauuuugggauaauccuucaaaauauaaaagcagccuuaugaaugaagugccauuuagguucacguuuaaguucacauuuguaacaguguuacuuuuuugccauauauuuucuccuaaaaaaugaucuuccauuuucuuauaagaaauuugaauugagucauugguuugcccuuuuccuaaagaauaugauaucuaaaauaccaguaaauaauucaacauagagugauuucaugucugauuuaugaagggagaguaaauacuugauagcuauagaugccacaaaauaaauucaauugagaguauaauuuucaccuaauuucuaugaguuuauuuuuuucacagaacuagacuauugauacaacuuacauuucuuuagauagauuauguguuugcuuggcagcauauauuugaacauuagugaaacagaacuuuguuuuuuaaaugauggaauuuauaauauacaugcauugauuuguauauuauggguuaaguuuuucaaagcaguaauggagcuguguguuaauauauagcuuauaauugaaaugguacauauuuguacauuuuaagccuuucaguguaaaauuucuuaauuggaauacucucucccuuggcuaauucauuagugaaaauauuuauuccucaaguuaaugcuauauaguaugaugcaauuuuuauauaguguaaacuuguuuaugauauuuugauuucacuuuaaaacuuuuauuuugcuucuuagacauauaguucauacucaguauaaugagaagugcagacacacaugaagaaaauacauaucagcugucugguuuuacaaaugaucauuaaaacaccaugucuuacuacuuugacuccaaauuauugucuuccugaacccaaaaguaauuuucacaaguacauuacacaacagaacuucaucuucugcugguuagcaguagaggauuuaaauccaugccgacaguucauuugacaaugaccuugaggggcuuugcuucuugaagaagaaagcagaagcuugcgguaaacaaaguucacuucugacagauggauugaaugacagaaagguugcgagugccagaauagcccuggcagaggaggaaauguucaguggaauccaacaggagaggaggugugaacaggugcaggguugcugacggaaggggaaccagauggaaggagccagagccaguuuauuuaaaggaaaaggcagaaaacauugaaaggcugugcgaucaguggcuaaaaguguucauagaggaagguaaaaauucacaaagcaaaacugcacagugggguagcuaacacuuagcauaaugguaguaauuugugaguuuaguuuggaaguugcgauugaaauacauucaucuuggcucuugacaccauccaguauagauauuugaaaguuguuuauuuuuuuaaguuucuaagcuuuuuuaaauccauccauuaauuuaauuuuuuccagccagaagcuccauuaugauaauacuaaaauuaugucgucagcuaggaaaagaaaaaaauuuaaagugaagguuaacguuccauucaaauuuaucuugugaugccucaguuuuguucacauauggaaagcaaaugcaugcacuguugggugacaucuguaauaucuaagaaauuugcaauguuagaauagaugccguugguugcuuuuguuguuuuggaucucuguucauuuugugaaguccgguuugauuguuucaguaggaauaaugcucuuuaaaauacacauuugcuggccacaaucugcagguuaauuucugcugcugagguugaccugauuuucauugacuuucagugaccugccuuugggcagacaccugcaaacccaaguacaauuuacaaaaggaacaguacgcauacaguggagcaagaaaugaggacuuucuuguuuucuaagaccuauuaaaauguaacuuucuccacugcaaaccagagauagcccugcuaauacucuguguggucaauucauacauaccacuuaugugggcccuugucuaccacaguuuuccuugaaaauuuuacuacauuacauuucugacaaagagacgccaauagaggaggagcuauuaagaagcuaucaccgggaaaaaugaugacaaugcacaauuauuuugagguuuuaaagaucucguaaauaauccacaaaaguuucugcacacugcucacagagauuaaacacacaaaguaaaugaguacuguauugacauuccuuuucucagaacugccuggaucaaauagauuacguuugauuaaggcuggauguuuugaguuuagagagaaugucugugauucguggcaugcuuuugucaguaaauauaaagaauugaaaucagauuaacaguuauagaagauguugauuuacuccugugcuguauaucaagaucaucaauuuuggucucuuuuuuuuuaaucuggaugaggcaauauacaacuauauuuugaaggaaaaaugguuagugauuucuucuaguaaaaggaaguugaugaccuguauuuuaaagucaucugcaaaauguacuuuuuucucccacuuguuaaggaauuuuuaucuaauaacuucuuauuaaucuaaaauuuuauauaaaaucgauuggaguauccuugcuuugauuauaguguacugauuuugccaucucuuccaucauaauuaccaaauuuauuuauauaauaaugcuacuagcauggugcugcuuuuuaaaauaauaacauaaaacucacuugaacuacgggguucaaauugaaagacaguaaaaagaaacugcaacaaucagugucaucauuugauagucauaucacaaauuaaauuguaaacuucuuauagguagaaccaauagcuucccagaaauauguaaauuuaguuguaccuaguaaagugucuuuugugauaugagucuuuaauuuuuuugaaugaagggauaacaaguugauugcugcuaagcagguauucagucaacauuuauugagcacauguucuguucuagcugcacuaggcacuauguaaauuuucaaaauaaagagcccaugauccuuuuccacaaguauccugcaaccuaccagacaagguuuauguaauuacauauacacauacguguguguguaaaaucuagaaaauaguauauaaauuuauaaacuuucugugacucaugaucaucuuaaaugaauugaugaaacucucaucuagcucaacacuuauaaugugugagaauguugagagaagcuaagugauuuuccuaauaccaacggugguugagugacagcaaaaaguagagucuaaguuuccuuucucuaagucuagugcucuuccugcaucccacauuauacuucuuuguucucauugaugauaugacuugucugagaaaccccauuaaaacccuucagugcaagucuuucacagccuguuuuggaaaggaaaaaaaaauuauuuuuggauuuuggcacacgguuacugguucuugaaacaaacaaaacacaaagguucuuuagcuugcaaacaguaauuacgaaguucacuucuuagaacuuuuuuuaauuauuauuuauuuauuuauuuauuuauugcuggagucucacucugucgcccaggcuagagugcaguggcgugaucucagcuuacugcaaccuccgccucccggguucaagugauucuccugccucagccucccgaguagccaggauuacaggcgugcaccaucacacucggcuaauuuuuguaauuuuaguagagacgagauuucaccauauuggccagacugaucucaagcuccugacuaggcucaagcgaucaccugccucggccucccaaagugcugggauugcaggcaugagccauggcacucagcccguuucuuggaacuaccucugggagugguaguaaagauaaccucccgcauaaacgcugcuuacccuguaauaggcauauucacuuaauccccacauaacccuaccagguagauucugccauaagccccauuuuacagauaagaaaacugagguauucagagguuaguaccuugacccaagucacagcacugcuaagugguggcguaggcacugaagccuaggcagcuaggcucccgacuacgauuuuauccauuacacuauauugccucugaugguggauguugugaaaaauaacuucugucaccaguuccuuuuggaaaguuguauucaacaggcuaaaccagguuucuugacaguagggcuucucagcguuuuuaauauguuagugcacacugugacucucuuagaaaggaauuuaguuuucaguguuuccgaaauuuauaugacuuauggaagcuuuucuaucaaaucuccacacaucuuccaggaaucacguuuuuaggaauacacuuggggaaaaacugaacuaaacuaauuuguaguaggacugcugaaaacuaucauauggggauuauucguuauuguaucucaucagugccucugcaacacccuacuccaucccacccugccccgcaacuucacuuucauuagaacacacacaguucauggaaagaguagauagguugguaacuuucaauuuucauuuagucauuucucuaaaaugggggugugggguggggaagcaucuuugaccagacuucaagaguagcuggacaguuagcugugccagagucacguuccaaguucuuccauaucuuacugucccaacuuugccuuuaugugauaauucuauuuauuuuaaauuauguguuuauucuagaaaacaaauuugacaauuacauaacuagauugccagucaguucauugaaguuagacaccuuuuaaagcaugacucugaaugagauuucauagaauaagauguuauuguggaugcucuccuguauaaacguuuuaggcaaucuccugccaggaauuauuggcacaaauuugaaguaugggccacuaagucagacugcacuagauuuuauuuuccuucaacccaugauauggcaauauuccucccuuuuauguguauucuuuccuguguuaggaagaaauggagcaacucaugggcaauaagcucuggaagucgggaaguuuagcacucauaaugugcuaauuuuucuguaaauacacuuggaggugccuauaauuuauaauuaugucaagcaguuucuacuggugagguuuucuauaaauaaccaucuuguaaugauaacgacuggaauugugauucucaugaagacuuacuaugugugcuccuagcuuucccaccugcccugcuuucuggguucucaaauuacauuuccuucaauaaaucaacuccagcaauuuuuauuaaaguuugaaaccauucacuggcuuauuuguauuccucaaggugcagaaaauguuugggaauaagcgaaaacuacaaaggcaacagauuaaauccccaggcagugggauagcuuacuaaacuggcugacacauugauugacaagcuaauaugacugcaagguccucuugaugaacuuugaaacuagucguuucuuacuagaaacaaguaaugaaugauauaaggaugauuacuagagauugaguaaagaaauccaugucuauuugccauuuaaaaauuauagaaacacuauccaaugaugaagauuuuccaauuuuauuuacauucacuuauuaggaaggagucugugacccagguacauaacugaacauuuuaaaaauaauuugccagcuuggcuguauggauuaacuuuuucauaauacuuuguaauuuaauuuuaaaugugaauauguuuuuugggaguugccucaaaccaaaucugauuuacaaaaaaaaaaaaaugaaggggaucauuuugguauacuauggugacuacuucagcuucgguuguucuuaguguucuaucagaauucuucuccuuuguuucuccuuucaaaucauaggugaguggcugaauuaaaugagaaacuuaucaagguuaaaaaaggucauuuuaauaguuuuugaaaauuaugaguuuugauaucuucaugaggcacuuacguuuaguaguuuugggcaccugguuauuuuuauuuguggaaucaggauuuaaaaugcugcuuugcuauagggugguagacaaaggaguggcacucagaccagugcuguccaauagaaauacagagggagccacaaaauguaaaccacacaugucauuuaaaauuuucaaauaaccacauuuuaaaaaguaaaaggaggcugggcgcgguagcucaugucugcaaucccaacacuuuaggaggccgaggugggcagaucauuugaggucaggaguuugagaccagccuagccaacaucgggaaaccuugucucaacuaaaaauacaaaaaaauuagccaggcaugauggcgcacaccuguagucacagcugcucaggaggcugagacaggauaaucgcuugaacccgggaggcggagguugcggugagcugggcaacaagcaaaacucugucucaauuaaaaaaaaaaaaaaaaagcaaaaggaaacaggugaaauuaguuuuaauaacauaauuuauuuaacccaauguauagaaaauaguauuucaacaugugauuuauauaacacauuauuaaugacguauuuuaaauuuuuuuccuaagucuucacaccccuuuguguauuuugcacuuacagcaugucuugauccaaccuagccauauuucaagugcuuacuaaccccacguggccaguggcugccacuccagacgucacagcccuagacguuuguuacucaguuuuccagcuuucccacaaugcccagcagagaugaaguuagauucucaugagcuuaaacccugaauuguuucuacaaaaaugggaaccauuuuauuaaaacaagaaaaucaugucaucuuuuucuugaauuuuggaggcaguagccaggacucauauugauuagucuuuuucugaagaaucgccacuuugaggaggaggaggaagagagaggaagcuaccacuuacuggccauuacuugaagagcagaugagugauuaaauauaccagcaucacauuauaauaaguucuucuauaucuuacucucccaucuuugccguuauauguugaagaguuguugaaaauaaauuugacaguuaaauaacuagaugccgaucuguuaacuggauuuagacaauuaggaaccuuucaaauggugaucugggcuggacguugccgguugccucauguggagcuucccacauaauccugauaauaucauuuuauuaaugagaaaacagaggcuuagauugagaugagguuccgccuugacgugacacagcuagcacaugguggagccagggcugaggcccagcccugugugugcaacgcuggccaaugcuaccucccccuguguagcuuaugucaggaaauugaggaaaauuuuuauucuuuccucaaggcugucuuugagauaauuauauugauuguuucaguuugaguagucaucuucuaggaaauaauaaggauaacaauaguaauaauacguacuaauuaauauuuuuuaacuuacuauaugucagugcuguacuaacaguauuuuauauguaauauccucauaguccuaugaggagagguacuguuauuaaccuuauuuuucauucaagaaaacugagucguagguuaugugacuuacuuagagcaggaguucccaacucggggucaccugaccuccaucuccugucggagcagcagcaucauuggauucccauggggcgcuaaccguauuguaaacugcgcaugugagggaucuagguugugcacuccuuaugagaaucuaaugcuugaugaucugucacugucucccgucacccccugauggaacugucuaguugcaggaaagcaggcucaaggcucccacugauucuacauuauggugaguguuauaauuauuucauuauauguuacaguguaauaauaauagaaauaaacugcccaauaaauggaaugcagucgaaucauccccacacccccuacccugguccguggaaaaauuguuuuccaugaaaccagucauugaugccaaaaaggcuggggaccacugacuuagggcacacagcugcuaaguggaggaauugcaacuuugaugcuaagucuagcacacaccaaagccuguucucuaaacuucugccuccuuguguacagaugcccugcuggcaguggagcuuacaugcgaagggauaaaggcugaaaguauccuauuguuuuuagggguauuuuaggauuucaguugcuuauauuuauuuucucagagcacaaaguccucaguuuggauauagucagggcaggcuaccuuguggaaauuaguuugaagauagauuuagaaggcuggaagcagcagguuuccaggaauggaaagggccgcucuguagcuacaggaauggugaggacgaagacuaagaaauggcuagaggaagagaaagauccagcagacacagguuauugaagcagaggaaauaauuaaggauguagauaagaauaguuauaagcaaguauuacaaagucaaauagaaauaauguuaaaucauaaaaugacuaaaaggcaaaauguuuugaugaagaaagugacuuaauuauuguaucaagaaaagaauuuucuuauuuagaggaaugagaauaguggaguaggaaucagaaaacuugggcucacgucaguuuuuuucuucuguagauguagugcuuuuuaccuccagaauugugugcaaagacggagagguuacagaguucucaaucaaacucuaaaaauggacuacaguggucuuguugccaagucaagguuacuaguccauagaauacagccguaauuucuguauacaugcacauuggauguuugaccaaaggcacaccaucucagcaauaaugaaaauucuacuaucuuuauuacagaaguuccccacuuacucaaacuuagacuucuucuuuuuuuuuuuuuuuugguuuugagauggagucuuacccugucgcccaggcuggagugaaguggcaugaucucggcucaccacaaccuccgccucccgggcucaagcaauucuccugucucagccuccugaguaacugggauuacaggcaugcacaccaugcccagcuaauuuuuguauuuuuaguagagacgggauuucaccauguuggccaggcuggucuggaacuccugaucucaggugaucugccugccuuggccucccaaaguguugggauuacaggugugagccaccgugccugucccaaacuuagacuucuugcuaguuugaaauauagcuguaaauugagguauaaauuaaaacguacuuuuaagaagcaaguaacuaucacaaagcccuugcacuuuucugugcagcaucuguggaacuauccuaacacacuuuuagguguuaaaaagcaaaaaggaaaaaaauuaaaaacaaaauaaaaaaacauggcagcaaaucacagcaaaccaaccaauaaagaauuauaagaagaccaguaugcuuuugguucuuuagaauaacaucugagaccuuccuugcaauaaauauuauugaaugccuucuguuucuagccacucuauuaagcccuuaaagaucuggcaaugagcaacgauccauaggcacuuacuagcaaaaggaauagcaacaguaaguaugccuaccuuguuuuaaauuaugaaccuuaauuauuaaggagagcuuauuguauuugguauaguuugcuuaagaaagcagacauaauuaacacauuuuagacauauuucuauuguaaauggcgagaauucuguggaucuaauaccuggaaaauucucguauguggaacauauucucaacauucuagauaaauaaugcaugcauuacucugucauacuuaugagauaaaauauaauaaaaaauauauaaauuauaauucuuacuauuauacauauuucugaauaaauuuuauagccacaagggaaccaacauguuccccauuuaauauuauauccuagaaauuaauuccuaaaacauuuuaauaauagaauaauagaauagaauagaauagaaacuguuaugcuacaauuugcuaauaaugcauuuccauugacauguuauagaaacgccacuagaaugcauauugauccuacugauaccugauuugaaguuacucaucagagggauuaguuacugggaauuuguagaucaagugauauuuuucagagaagaaagccaagaaugcauaaaagucauuaguuuauacagacaaauugaaauggaaaauaugaauuuuugaaaauaugaagauacaaaggcaaaaucaugaucgaauuuauuuuagguaauagcauauuuggccuuauuauuuagggugaugaauugggcucaggguguuguauaauaggauacaguagugcuuuacuaucucacaggaucuuugccccaugcaaucacuuaaugcaucaggcacccugagcuauugaaaacauuugaagacugaaaauuaaugaagugugcauugucaaaugcacugaggcuguucagucucaguaucuaccuaugguaucuaccguaucuaaagaaaccauuacagaaauugcucuuacuauugcuguaguaauaagugcuuucccugauucuaauguugucccuuccccaucuguuccccacacugcagccagagugaucuuucuaaagcacgagugugaucacaacacuccgcugcuuaaaacccuacauuggcucccuauuucccucaggacgagggccuuaaaaauagcuucauguucuggcuccugccuacaucuccaagucucgucuuucuucaauaaucuccccuccaccaacugugcgcugcugccccacaacauauauccuccagcaucccgucaugccaaaacuguuugcaguguucucagggcaccugguuaucucuccacccugugucuuugcacaaacuguccacuucacuuguaauaaucuucuuuauauucuuuguauggcagauuacuacucauauuuuaagcuucugauuuuuuuuaagcuuccugaaauccuuccucccuguccccagcuacuccccaauuccuauccuuuccaccuguaucauggcaggaauuuagcccuacuuuaauauuuacuguaccaugaguuguuuuuuuccccaaaacucguuuauuuuguucacuagacaauagacucucugaggccagggucuacaucuugcacacugaugcauccccauacuuuugugcuuggcacaaaguaguugcuuaaguauuuguugaauggaugcgcaauccacuguuugauuaaacaaacccaucaugugaggcagugccauggaauggaaagaacacuggacuuggagugagaagacagauuuggauuccagcuuugcuacuuacuagcugcauggcuuugagaaaaaucucuuaauucccgaguuugagacacuuuaucuaucaaacaggaauaucuguuccaucucucugccccacagagauguuaugaagaauagagaggucggugcauuugaaugugccuuuuaaaauagaaaguacagacaugcaaagggugaugcgcuaguaacuggaguugauagagucugugguuuuguuuuaaaaguagaugggaauugugcauauguaauagaaacaggcaauagcuagucuacuguauugucuuuugccuugaagguaaguuuucaaauuauuuuggagauacuguaagaacauuuuuggagggaaaauuauuuuuagagauguuucuguuaaauauuuccuuucuuuuguguauauucccuugaaagaaguugaccuccuuucuguuucugcuuucuucccuagaagugacucauucucugaucugauaacucaucuuucaacauugugcuugaaguucugacauacuuugcaaugaagaaaauagaaguaauuuacuccaggaaauaugccauuaagucuuuugcauacuuaaggaaguagagauuccagaaucucauuccuguguuuuccuuucuguuucuucucaguaguuccacauuugcucaaauaagggaauacagccccuguuagcuguaaauaagcauagaauuuuggguucuucugaaacauggaagacaucaugcugucuaccaauuuuauuauuguuuuuguuuuguuuuauuuucaauaauaauaauaaauucuugcaaaaauagagauuaucuuaucauauucucugacuguagucaguagacaggaugauacuuacaccugugaggauacuuaguacuuuccgucuuuuaguaguugaucauucauucauucguuuauucauucaugaaauguucauugaccacacaacuguguaccaggcacuauuccagauuuucgggauaaauuagugagcaaaacaaagguuccuauucuccauggauuuagauuccagauugaugcacaugucuuaucuuuucuagagucuguggccacuugaggcaggagauguguuugugguaccuuucaauguuuuugcaaaggugaauauaugucuucgagaaggacacaacuaauugauggugucauuguaggagaaaguaauccaauagcuuaggggacaacagggaaagaagaaggagaacuagcuugggauuuggcugucaagauggauaauauggcuauuaaauggcacacucccauauagauaauugaaauagacacuuguuauccuuucaaccuucucucauuucucuacaucccugauaaaagaagagacugaagcauagugauucacuguggacuuuagagucagauagcccuggauuuccuggcuguaaccuuuaauaacuaaagaacuuggacauacuguauaaccucucuaggcucccauuuucuuaucuauaaagugaagauacuaagagaaccuacuuuauaugguugguaugaggauuaaauaaaagaaugcauguaaagaccuuagcuuauguguaaacauuaguaauuaguagcuucuuaaaaggauuaguccuuuaagguuggauuuucuuuuuguucugcuugaaugaagaaccccaguauuaaaggaagaaaguuauuagucuauagucacacaggugauaaggugguagaugccauacucugacccucuagcucugugaguuuggcuguacuccauugccucucaaggugucaucuucccagagcacaaagagaauaaacucaaaaaguaccuauacauuuguuuaaaaaacaaggcaaaacaaaacaaaacuauaagcaaauauugaaaucuaguuacuaguagauuugcuuuccauagauuauuaauuuugaaacuacuuucuguguauuccaaguuugaacaaacaaguauguugaggauaauaggaaccaaguuucuuacuauugaggaaaaaauuacaauuauggaaaaaagggagacaagguucuauguauguuguuggauuguaauuggaaagaccaguaugaauguguaugcauauauucauauaggauacagacaaauauuuauauuuauauucacauuuauacacuuacauguauauucauauccagacuuaguccaccaaggugaccuagaagcaaugauuuugcaguagcagugagcaccaccuagugacagauccugauuucuaaauaccauucuccauuaaaggcacaaaaacagcuccuuggucaaaugcugauuccaagacugguacaaggacauuacaagaugagccugcaacauuuuguggagauagaaagccacgugaacaauagagacaugucacguaggaaccaccuugaaaggguucccccuggccaaauccaggauaaauugagcauaaaaauaauaaucauaauggauuauaacccacugaauaagauaugaauccaugacuccaugcugauauuaaugaauuaauaaaugagagagaagggaaagcucuuucuuauaauacaauguuaacuaaaaaauagagaaagaauaauggaguaaaaaagucauuuuuggauguaaaacuauuagaugagagcucgaugaagaauaggauguuugcauagucuaggcaucucccaacaaauuaccucuuacuuauuagguuggagcaaaaguauugugauuuuugccauuaaaaguaauuacuuuugugccaaccugauacagagaggaaaggaguaacuuuacaguagagaggccugggacagcucaccuaacugcuguuuugcugagucugacuuguaccagcccaugagagccaauuauguguauuucuucccaacuugguauucagugaugucacuuugguagcugaaaauagagcaugguggaagugucuacacugaaaauuggugaauacuaccaaagagggauuuccuguccccuggagcccuguuguuaaauaucgucuggcacaccaaugauguuaaucaagcuaucaaagcuaauagcaccaauauugggacagguguacauuuucugucuaaacucacaucgguacccagcaccucccugccccuucugucuguauuccuuaaugauuuucagccaguaagcauguuauaaauucucacaaguuuuuucauaccaauaugcuacuaucacaaagcucacaaaauuuuaucuuaaaagggaaacaccuuuuagccaaaagaguuguaugucucacauuggaacuucagacaucaguaaaaaggugaguaggaacauggaaggugggauuggugcuucaaccccacaacuaccagguccuuguuccagacuugagccuuucauuuuuucugucccagggucauuguugagcuaaauuuaacaucauuagaaaauguacuuuaaaaaaucugcuuaacaaaucauuuuugcucugugacaugaacauuuuuuaaauugcaagauuuaaaauaauaaacgauaugaaaaaguugaguaucaaaaauauaagcuuaaugcuucagugccguuucuaaaaagugggaugguaaauaucauugugaccauuuuuagaaaaugcaaucaaccagaacuauaauugguaaaaaggaaugacuaugcuuccauguauauguaaucuguguuugaggccuagccaguacuuguucacuccuuuaauucugaauuuuuaugaagaaaacauugacauggccuacauacgccuggauuacaggugaugugaauaacuuggagaauaaagguggauguuccuauucuagaccauuugcuccuccuuuaauuuauuuauuuuuauuuauuuuuuuauuuuuugagacagggucucacucugucgcccaggcuggagugcagugguguaguuauggcucacuguagccucaaccucccugggcucaagugauccuucuguaucagcuccuugaguagcuggcacuacaggcacacaccaccgcaucuggcuaauuuuuguaguuuuuuuuguagagauggauugcaccagguugcccaggcuggucucgaacuccugggcucaagugaucuaccugccuuagcuucccaaagugcugggauuacagguguaagccacugauuugcuccuuuuaaagaucagcuuuauugggguaaauuuaaauauaauaaaauaucaccaauuucuaacugugcagguaaauaugguuugacaaauauauagaauuguggaaagaucauagucauaacauagaagaacauuuauauccacccaaaacauguccuugugcccuuuugcucccugguaccccucuccuacuuccaaauccuggcaacgcggaucuacuuucugucccuuaguguuuacuuuucuugaauggccugugaaugacaucauaauauaugucuuuggugucuggcuuuuuaaacuacguguacugcuuuugagguucagccaagugcuguauguggcauuguuccuuguuauuucuacccuuccuagccaugguuagacuauaccacaguuuauccauugaacaguugaugcacguuuaaguuguuucccguuuugagugauugugaauaaaucuuucagccccauaacuaccaagaaauucuuuuuuacucaguguuuugagugggaauuaaagcaaaccaauuggagagacuggcuugaccauccuucaccaggcucucacacccagcuggauuugacucucauuuuguuaugcuuugguaaauuuuccccuuauaccuuucuuacgaaguauuuugccaucuacuuucuguuuggccauuuugaacucccugcuaggggcaaggagcaugucuuaucuaucuuuauuugacccagugccuagcagagugccuuucacauaagagaguuaugauaaauacuuaaugcauugauuuacauucuucucuaguugcuccuugaaugccuacgugcuuuuuauaauuuuuucaauccauuaucguauuaccucuagagcagugugucugaucuuuuggcuucccugggccacacuggaagaagaauugugggccacacauaaaagacauuaauauuaaugauagcugaugagcuaaaaaggaaaaaacaaaaaggcccgugcauaaaucucauaauguuuuaaggaaguuuaugaauuuguguugggccgcauucaaaaccauccaggccgcaagcagaguaagcuguccaacuggcggcccaggacagcuuugaaugcagcccgauacaaacugguaaacuuucuuaaaacauuaugagauuuuuuuugugugauuuucuuuucuuuucuuuuccuuuuuuuuuucccagcucaucagcaaucauuaguauuaguuuuaguguauuuuauguguggaccaagacgauucucccagugugacccagggaagccaaaagauugcauaccccugcucuagaguauuauaaaauaggauuccccaaauaaaaacauuuuaauccuaccucugccuuuaaaucauucacuaugcaaccuauaagcagacuucaaauucuuugugacccuuggggauuuuuaaguagguuuuuuuuuuccaacuguaaagugagaggguuugaugaaacacauuugagguucccuuuuaguucuaacauucugggaauuuauaaaaagccuaccaagucagaaccugcaagagaggagagaaggcaacauaggaaaguggaaggggaaaggagguuggaaagcaagacuaugucauguuucuaggcaaugaaacauaauguauaguuucccaaauagagggaaauuuggggaaggauucgagaaacaucaguugauguguaacucaacauuuguugguagaagucuuuuaaauuguuuuauuuuauaaaaaggacuucaauuaugacaguaguucuuuucuauagucaauuuauuuuuuauuuuuauuuaucuauuuugagacagaaucucacucuaucacucaggcuggaguucaguggcacaaucucugcucgcugcauccucuaccucucagguugaagugauucugaugccucagccucccaaguagcugggauuacaggcaugcaccaccacgcccagcuaauuuguguauuuuuaguagagaugggguuuugccuuguuggccaugcugaucucuaacuccuggccuuaagugaucugcccaccuuggccucccaaagugcugggauuacagaugugagccaccgugccugaccuauagucaauuuagaauaucaguaauuaggcagcuuauucuaaagaaugauggugagauugacaaccccuuuacauuggggaacuguaaguaccaguuugugauggguaguuucaguugugacuguuaucuugguauaauuauuaauagugccccuuucacuuucagauggguauugguguuggagaaugcauuuaugucacccaauuguuagggguugcagagccccagauuucuaucucuggcuccugccccggcagggggucugacuuggggauggucugacagggcuuuuuguuuuuuuagcugacuccuuuagcagcacggucuccagcuggcagagccauuagaaccauucucuucuaagcaccuuuuucuaacacgucugaaaaguuuuugccuccucucguaagacuuaagcagauucuccagcuacacguuaagauagcagccuuccuuuccccuaugacaagaguauaacaacauccaaucaugaaauauucaccacccacuuccugugugccaagcacugaggcugggcugaggguauagagagauaaagaugacaaacgaagcagacauguuaaacaauaacuaaagugugauaaauacuaucuuuguacgauguacacaacauauauugaggucauugagggaagaauaguuaauucaggagagaggaaggagaggggaagaauuuugaguuaggccugaagcggguaguuguauguauacaucuuacagggggauugagugggcagguggaggggcuuuccaggaagaggaagagacaugugcagugauccauggccagaaaauacauggugugacuggggaggcaaaaaguagccuagucugacuauccauuuguuguauauacugguuuggaaccgagugcgacgcaagaccuuggaccacaucccggggggagguguuguuauuagaaguaccagacaggaccuuauuucacauuuagcauggacccccgaugauuccauuugagugagguguggguguauuuucauuccagaauuuuauacuacaacaugaccacaugcauugaccaauuuuaauacaggcuuuccuuauguugcuuuauaauuagaagccagugaauugaaguuccacagcgguacauagacuaguagugauagcuuuauggaauuguuuauuuuuaguuuggcaaaggcuaagcaguaaauaucucaauuaguaaacuaaagcagcauggaugagaaaugcccgcaaggagaucaggaguuagaaauaacuaagucaguuaauugaaggaaacccuaauaucacuuacccauauuuagaguuugaagaaccauucuaauaugugugugugugugugugugugugugugugcacauguacaugcacacacacacugucaguauccacagugcugccagcauugagguccuuugcauuccccagguucuaauuguuuaggaaguuucucucuuuggagccacugugcuugguuauugacccagugggauaggucaguguccuaucacaguacgauggguuguugucugacuacagaagcuuuucauccugcaauuucuuucaaugugacccacgagggauuuuauuaugaagugcugggggaaguuauucguauucauauuuguauucauauucacauuauauggccugaugugugaagauauuuagugaaaacaugaauguggcacugcagaaucauuuacucgccucuagauagaggcuccugcauuauauuuaagauuccauuuuaaguuuagagugaaaacagagguggucuacaaagcuuaguuuuaagaauuuaaguuuuguuccuagaguuccaguaucucugggaaagauugaccacucagaagaugaaacauucauugauaguguaaaacauuaagaauauuagagaaaaaaguuuuguguuuuaaaguuacaaaauaccauuauuuaguuguuaugauguuuugacacugcacacuuuaguccauuuggauucauggcacguauuuaacacuguauggaagguuguuuggaucuucccccuaaagugggggagggucauuagaaagguccuugucuucuuaugcuuaacaauuuacuacguaucagcucucucuggucuauaggggacaugauggggguuugugcaucugcagauuaaauuucuguaugucuccucucuguuuugcagacaggaaaaagauagcauucagcagagcuuuagcaaggaagcaaaggcccaagcccuucaggcccagcaaagagagcaggagcugacacagaagauacagcaaauggaggcccagcaugacaaaacugguaggugguagggaaagauuagagccugggcacuagcucacaagucaggcccacgccuuacugugaaaugacaucaggaacaccuguaaccuuuggcuggccgaagggagcagaugcuaacuacaccggagauuccgaauuacauauuaguuagcguuuaaaagagaaaauggaaaguauugcccacugucuguugauuucagagugcugcucucacaucuguugcaccaucuggauuaugaguuuauuuaccuguguucaagaaacguaaagcugagagagaccacaacaaaguagaaaaacaaagggcuuguuuuuggcuggguuuucaggcacacauguuauauaaagaaaauagcaucagaagcucugcgggaaaugcucugagcuuacaguuagagucuccugaauagcauugaacaguucccacaguacacacauuauagcuacucuaaaagccuaaugaguuugcuucagcauccaaacuggagaaaagcuuuagccauuaaucgguucuuaauucacugucgcagcuggauguaauucaguggcuccaaauugauauguuccuuuauuuaaucuuugcagcuucgaacauuuuuagcauuuguaugauuuccccaccucccccaacccaaucuagagugauguuuaauccuuugcauucuucaaguucucacaacugcuguuaaaauucacuaauacaaggcacugaccacagcuggcagcuuggcuaaaaauugccaucuuucaucacauuggcacuauucugcagacugaguuggccaguaacucuuuaccuuuaauuugaaaguaaaaugcacuuugaaaauagacaguuugauuuguucagucagagcauuauguaguuucuuucacuuuugaguuguguguucacagacaguguuagucaaaacaagacagugucagucauuauaauuccacaccacauacuccacacugauuguacuauuaaaacaaaaguuuaauugauccugucucuuccagaaaaauguugcuuaauuuuagugccuugauuuauuuugauuuguaugcuauaugcuuuuugccaaucauuggcuaaaauugaaaagaaauaaaggccucuuaaaacuuaugcuuagagguaauuuucauaugauuuaauguauuaauauauuguauuugaugacacaguaagaaauuauuucuuauccuaugggugaaaaauugccaacaggcaagucauuaaauaaucuauuuacuuaugaagaggcaaaugucauauugacucacauaauucccucuaucacuuucaguagagauuuucuuccaacagcauuuggccagaagaaacgaaaauucaccagguuuaguagaaguuuuuccucuaaaaacaaaaagaggcaauuguaggauaaauuauuguuuuugcccccacugcuagcaugauccuagugaucagagucuugggcagaaucuaagcacuagauuagaauguauuuaacuguuaaaaccgccuuaagaacauuuccuuuugucuuguacacacauacacaaaaucacacuguuuucaauuucuuugaccagaucuccauugaagcucaugcuguugacaaugaaauuaaaauucuaaagaaaauacacauuuuuaccuucauaauuagagaaguguaugcaagauugggggugguggugguaguaaaccaugugugcaaauaugaaacaaagcaugaauuacaguguagaagagaauuccucgaugauuuuaguuuugaguuaucugguugugauaauuuuugacacucuguuuauaguaaaauugucaaaauaaaaauauaauaucuugcauauugcaaagauauaagcaucuauucuuccacuugagguauuugacacuuuauuaacauguuaaaauguuacaccaagcugguaugaugaaaaauguuucugguguauaauuauguugaaaauaaaugacucccaagauugagugucuuuccagaugauaaguccuuugacuuaggacauugaaggugaucuaguggcuuauuggaaauguguaggggucuaagcacuuuaccacucuauguauggaagcacugcagagcgacaaccauaaacaucuuauguugguggggguuuauuguuauuucuagaaaaugaacaguauuuguugcugaccucccagaauacauuuuugacaaaguuaaaggaagaaugcuguacauuagccaagaaacuggaacaaaucucucaaaaaaccagguaggugauguuauagaauacuuucaagagcacuguuugugugauuacucuaauuuuuccuuaaaaaacaucauuugcacuguuuuauagucuaaugucaaaauuagguaucugcugauguuuucuuugaaaauauuuucuacauauggacauuuucuuaauugucuauacgcuuuuauguuuuuucaugguuauguguauguacuauuauuugacauuucaauguuuagaauugaaaacugugaaauuucaggaaagaaggaucaauaugguaauaacauaaacaugcagauaaaucaagcaguuauaaaaucuuacauagguaugguuaacacauuuuaaucuauuguuacaauucaccaugaacacaaaagcugucuuuagguuaaaugauaacagaugaaauguguauauauaaaaaugaaaguagaugguacuuugaaauaaauaaaccaaaacuauucuucccuucuccuaaaauuguuauauuuuaauagaacagccaucauucauuuuauagcauacuacucuuuuauaaauccauugauuggaaucuuaaugacuuuuuucuauacacuuucuagucagauuaucucaaugaauaaauuauuucauauucuaaacugcaagaagcccgacuccccaucucagcuccgacaguaacugaauaaucuuggacaaauguauuugaccuacuuggacuauaguuucuucuuuuguaaaugaaagacauuggacagaaucacuuuaaauugaacuauagaaggcaauauucacauaacugauaagaugucaaauacuacuuuauaugauaacucaaugaaaaaauugccugugugucuucuuuucugcauuuuucugaaacucacauagaucuauugagagcaggaaauauggcucagcaaacaaacuacugaccuagauguuucauucgggaaggauuucugggaguaucagggcauaucugaucacucugagcuccaucuuggaauccugcaucaacaagcugucuuagcugauagaacccccaucccugaaucuuuuggggaaucagagggcucgugcauccaacucucccugcucaccaggaaggcagaggcuccuguaaccaccaagaauguacucugacaugcgcaccuuccuagcguauacuaagauuguauuuugguaggggaaaaccuaggugccaaaauaccagauauuucaaggaaauuugaccaagaaaaccaaaugauuuugucaugaaagagacccauaaaauaucaacaguagcuauucuuaaccagaaauacuugauuugcaccacauagauccaaaaguaauuuguuagaagcaaacaaacaagauuguaucauuuagggauaaaaugauaucaaucuggguuuuauauaaauguauuaggucuaaaauugguuugugaaugauuagugaucuugcucuccaaggagaccuaauuagggaaauuuauuauauaaaagagacaaaaaggugcuugguauguuauuuaauucucaccacaacuugaggcaggaauuauuaucuuccagauaaggaaaccaaaacuguuuaaauaacuggugagugggagagcuacgguucuaacauagguauuucugguuccaaaguauacguucuuucuuaugguaauuacaguauuuuacaucuauugcuaaagaaaauucaagccacaguaguuaugaugagaaaguuugggaaggaaaaauucaccuuuaaauuuccguggagaaguaagcguccuuggcauguaacgguuaacuuacucugugccccuaggcccucuuuuuccuccucuagaucugucaucuuagccuguacuggucuaacucagaaccucuauugcuccuccugcuucucauuccuccagcuccugaacaguacuuuguaaauuggauguauucuuuuguaucugacauagauggcauuuaaugaauaaaugaugaaugaaugaaacaaauagguguggugcuauucgcaccuccugaucugacuucugaugccagucugucccauuguugauggcugacagugugcaguaaagaacacauggcaauucagaggaacuagguuugaaucucacucucccacuuggagcuuuguaaccuuggguacauggccucauuuccccaaaccucagcuucuccuucuguaaaaacauuucuaaagccacacugcaggauuguuaugggaauuagaauuguguauauagauacgcauacauacacguaucaagugccuagcacagugccugacacauaguaauacacaguagcugcuauuauuuucacugguggcauuuuuaagggucuugacugguaauuuggguaucacuuuacauagcuauugucuuugccagggaaagucugacugucauuuuccgacggacauaagucuaugccacaaugaaagccuuuuuaaaacagccagaucaggaaaauguggaucuaguuguauuuuguaacucugaugaauuaaagcaggcaccuacucuaaguuuacaauuugacucaaccaaggccuggcaaguaguaaacacuugauaaauuguuacuuacuauuuuuaaaacucucaagcgccccuaaaacuuacgaaaagugcauuuugugugccucacaagaagguagugaauaggacaaauuuugauuuuaggguuguuuguucuuaauuucuuuuaguuccaguuucauuucucccuggcuucuuacuaugacauuuucaauaacucauucauguuaaguuuuacauuccauuuugauguuaccuucugcuuugaaaccaccuauaaaacuugaagggcuuaaacugcuucuuuuaaaauacaaauuauuaauguaguaaacucugaagaagcccuccaggagugugccucugcauaccccaugccaaacuauugggauaaauaauuuucccugugcuuugagguaaggaaaaucuuggaguuucuaaaguuuugucauuguggaaacucagucuccaaauuuauacuuaugcaauccauaugguaauuuugguccagcuuuuccucagaguauuacaguaaaauucuucuugaaaaguaaguguauuuauuuuguauugagcaauaauuaagacauauuuuuccuuccucuguuacuagcaacauuacucuaagagucuuguuuuucaaaauaccaacuaaacaaauagauuccuaccauuuaaaacaagauuuuaaacucacagaucuagucauuugacugaagcccaugcagaaugacgggaaagcugagagcaugggcucggcgugcacguacgcccuuacucucugccccagcuucaugcuaggcugcucuguugcucugugaaaauguuuugaaaugguaccuccgugugugugucuguuguauguguuuucuccccaaggagaccguaagucgcauuauggcagugacgacugcuucuguuuucuggaagccuccauagugauuagcacaguaguuugcgcgcucuguguacuccacacugcacguaguggugucuguaaccccgggguuugugaauggcacgucccauuuuaaaacuuaaaaugaacugccgauucugugcauguuguauagcuuguuuuugaccaucaggcaagagaauuaauuccauuuugcuuuuaauuggcaccaggcagacauucuggcugauuuuaguugaagcucacauaaacuuucgcuauccuuccuucuguauuccccaguacucugagagcuuauuauaguuaugggguuguuuuuugaaggagguaaacggagcuauuuaaauaucuucgguacaacugugauuuuucuuuaucaaagugaaggaaguguucucucuccccacgcgcuuagaugaaucagcaguaaaacguugcagugcgguuugcagugcuaucuaacaccuggccugggagagcuggaaggauugggugcuggcagggagugagccucugccagccacagaguggagagaagugugugcuagguuuuagcuuccaccucuugcacacugaaaagaacaggauagagcauagaaccagggucuaugugguuuugcuucuuucuuuucugucauugucacuuucuggguugugaggcuuguggacugaugucuaacacugcccauuguguauuugugauuugcguuuuguaauuaagaggaacaaugggaguccauggggucucguuauauauaaugguugguuuaauuuguuucacuucuaucuuguuaauuguaaauugaucauuaagauuugaauucuaaucugucaccaggguugugaguauugaggcuagagcaaugaucccgguuuuaaucacugaugaugagaaacaaauuuuauaauuuugguacauauugcaguucauauauuuuaacacuauacuuuaugguguuauaaauauuguuaaaugacuuuuaguguaguuuuacuguguggacuauaauguguaaauuauauuacuguuuuggcaacaguagguauccaacugugugaguuuaauugaggugaagaacacacacccgguugaacuguuuuuuuccuuugcauguuuagaugauguuagguugggauacuauaaaaauuauauuuucuacaagaggagacugauauuggccucugcuaauuguuaccaaaagucaaacuagaaccuaaaagaauaaaaaauuaagauauuguauuucccuuugaaagcaauuaucauuuuaauccgaauuauaguaguaaaauauauuucaugcaaaugcaauuaugcaacauaacugguauauaaaaauacaggggaaaguucaugcuucuguaaagccagaaauugccugaauuuucuaugaaaauggauuagagucaauuauccuuuuauaugacacaggauaaucaugccagaaauguaucuccuaacuaacagaaaacuuguaaguuuacucuuugagcuuugcaaacuacuaguucuaggaacauaucgugagcugcagacagaaaaaggaugaugugcaggcauauaugucaaauuuuuauugaaaaauggaaguugguaggcaaauuacaauuauaaacaaagaaaaaaacaaaaaugugaagcagaaaaaaagauuguugcaauacacacuugauagugauguguacuuuauaaauaacauuuauauuuuugggauuauguaagacauccucaaugcagggaauuuggaaaauacaaagaagaauuaaggaaaauuuccugugccacuaccagcuagagauaacuauucuuaccucugauauauuucccuucagucauuuuucauguguaugucuguguacauuuauagugugauugagauuauaccguauauacaguuuugcgucugcuuuuucauuugauaucuaaugaacauuuuucuauaucaguaaauacucugaaaacaaaacuuuauuaaaugauuugcguguauaagaauuauuaggcuuuuaagaugcuuccaauuuuuaaccguuuaugaauaauaauacaacaaaaacuuuguaccuaaaucuaaauuuuugauuguuuccuuaauugcugguccaagacgauuaauccuuuuaaggguguugauguguuuuaccuugcugaaguacuacacuaacuucuaauaacuguauauguagccauauuaguaaauaacauuacaaagaagugagauuuuuuuaaaaaagcaugagaggcaauauugcacagguggguggaaccaccccuuuagagguggacuaaguaauaucugggcuugacuacuuggaugaccuuaggcaaauuauucaacuucauguuuaccucacagagaaaagaaaagaaacccuuacaaguaccuuauaggauuaauugagaucaugaauguaaaggauggauuucacuguuuguuauacgguggcaugcaguaaauauuuggugguaguaucugguuuuguugugcuauuuuuugaauaauagugaaauugaauauguuauaaaugguauugaucauuuguguuucuucuguagauauuuucaauauuucuuauacuuuuuaauuggaauuuugauggagagugcaguuaguguuucauuaaauuaugcuuuuaauguuugucuuauuuuuguaaauaauuuccuguuguuuacauugauuuuaauuaauaagcuuuauuuuuuagagcaguuuuagguucacagcaaaacuggacagaaaguacagaacucccauauauucccuguuccuuccacacacaaccucccccaccagugacaucuacauuuuguuuuauuaugauuuuuuucaaaaucagaaugaauuuauuuaaaacaaauaaaauacauaucuauuuuaaaaauuuagaaaguauggaaaaggaugaauacagaacagagaaaacauuccugauccuaccauccagaaauaaccaauauuaauaguugguaugcaugucaaaauauuuuucuaaauuauaaaaugaaaucacauuacacaugcugacuuuuaauguuuucucuuuguuacuaauaugucacaguuuuagaucaauaaauaucacuuauaaauagccacauuaucagaauaauaaguaacauaaccaagcuccuguugauagauuucuugguuaaguuuccagauuauggguugcaaagaaagguuguuucuagaaacaaugcuacaaugaauacucucacacaaaccuaugauauauuuuaaaugugauuuuuuuaugcauaaaaguuuuguauuuuuauauuguaaaaucuauuuuuuucuuugugauuuuucuuuuuaaaagugccuuuugcuuggaaagugccugggaaaagaucaauguucugcauuuuuuucuaaucugguuuaaggauuuuuuuucuucuuuugaaauuuauuuuagugcaugguaugauaggagauacuaaucuuggaagggauaccagaucaaaaauuuaucauaacugccucuaaauucuuuuguauuguaugugauucugaaaggagaaacguaagucauuauuaacuccuuucggacuauuucaaauauggguagauucuuauuaggagaagcaaauguagauugagcacuugaucugaacuugaaaaugagauaauccaugcucucauacagaauaugguaggaaagacaaggcacagagcacaauuuaaaagaauaaauuauaagcuaauguaugcauaaaggcuagagguagcuucaaaaaacgugcugacauauugagaacugcaagguaucaaucagggcaagcuuccuuuuggaugacauuugaaccaagaugaaaacaaaaugaagaaugaggugaacuaaaagcaagaguuuuugcuccauacacgugagcagccugguccuugggaugaacaauuuguaaaguaagauuucccuuagcaaauccaaauccuuuucugaccaggaagaaaaggcuaucuugccuacuggaagaauucuuucuuugaagggaauuaauuuuaugucaggagucuucagaaaacaauccaaucauuaaccugaaaacgacucauaauauacaagaguuuuaaacuuuccauucuaacugauuaggcauuagggcaugaggagaugguggcaguaggcaguaauuuagaguuuacuuaauacaaggaaaggaauauaauuuuucuuggauaaacaucuuucugaucuucaaauuuugagacuuggauugucaucuaagacacgaaaaacaagauauucccauuuugcucaggggaggucaaucuuuuuucuauuaagaccuucaguggauuggauaaagccugccugcauggacggcaaucugcuuuucucaaaguuuacuaauuuaaauguuaauaucaucuaaaaagcacccucacagaaauguccagaauaaugucuggccaaaugucugggcaccauggcccaaagaaguugacacauaaaauuaaccauuaaagaacuauuuuuauuuuaacugugugccauuaaacugguuauguuaauuaaaagaaacucuguuauagaaauuaggccuaggguuucuucuuugacagcauaguguuuggccuauaacaagcacucaguaaguauuuguuaaaugaaugacagucuuuuaaaaaagagauuugaucauuaucauguuugucuuauuccuuagggaagccauuucuguuagaguaaguuguuauuccuuuuucugucuaacacaugagucucuacaauguaucuugccauuucugaaauauuuucuuuugcaaaggauguaguuuucauuaugcuaucauguuuaaguguggaguuuaagauaauguuaagguuauauaauaacaauaugcccuaguaauaagaacuucuaacaucuauuauuuuuguguuuucaccucuagaucugaaauagcucaacucagucaagaaaaaagguauacauaugauaaauugggaaaguuacagagaagaaaugaagaauuggaggaacaguguguccagcaugggagaguacaugagacgaugaagcaaagguaaucaagguuucaugucaacucaugugccgcauauugaauguguuugguuuacacacugaaggggaauugcugcggaauaaguagaauucaucaucauuaugcuacuugugacaugcucaaaaucuaauacuuuauuuuauguauuuaugcuuccuuaauuuagguuguucuuauuauauacaaagaggagaguacauccucuuuuuguuauucucugaagacauagaauuagauuuaacauggaagaauggaggaaagccauuuuccuuuaagguguaaguugguaauauuguaauauggaggaauuucaaauuaucucuccuagaaauuagauuuuauaugcuuuuuguaagguaaagcacauaguaggucuaaagagguuaaacaucuuaucagagguugcacuaauagcauugcuagagucagaacuugacuacaaacaaaaccuucacuucuuucuggugguguuacuuugagcaagucacuuaaguucucugagugacuguuucuucaccuauauauuggcgcuaaucauaucuacuuugcauuuugauggaaagaucaaauauaauauggcaaagcacauggcucauaaaggccacccacuaaaugucaucaauaauuauuauucucuuuuucuagaugaagaaauucggcucagagaggcuaauagguuugcucaaagugacagauggaauaagugguagaguucagacuugaaucuugaucuuuugacuccaaaauccuuuucuuuuugugcaguaauggggauuuuuuuuuuggcaauaaacacagccucuuacuauuuuuuauccaugugccauuucucacuucugugugauaauggauucccugggcagaaaauaaucucaguauuucacagcagacagugaauagguuucuguagacuuggacuuccacaugacaaccgcaugcacgaugauagcagccacccuuccaguggacacgguucgcguggccuccagcucggcauccccacaccauuucccagccauccaugccuucucuguuucaaaaacaguucuugauauaauugaaggaaaugaaaauauuuauagacuccuuguauuuuuuuaaauguaaaguaagcauauuagccuggggugggggggagguauuuuuacguugauuacuugcuuuauugaaugaagacaggcagucagaugauggcacugcuugucaguuaucaaaauaccaaaauauggauauacuugcaaaguaauaauuauucauucacuauuaaaauguuuacuuaagcccaggcacuucuguaggccaggggucugcaaacguuuuccguaaagggccagagaguaaauauuucggacuuugcaggccacacguggucuccguggcauagucuuccuuguuuuguguuuuuuacaacccuuggaaaaaguaaagaccauucuuagcuagaggaccaacaaaaugagccagaggauuuggccauugggccagccuuugccccaguccugugcaccuggggcaucuuuccauuuauuuucuuacauuuguguauugcuuuagaguuccuagaaugcucucacacauaguaccuuauguaccuugaagcaaccuugaaaguagcugcauuuaucaucuccauuuccagauggagaacuaagccuaagaaagacaaacgugccgaaugaaggucagguggcaaauuaaugguucguucauucaacauugauugauugauugauugauugcugcugugugucacauuuucuaccacaugcuggaauaaaauagcaaaguagauauaguucccacucuaauggaguauacauccuuauagggaagauggauauuagcaaaagaauuucauaacugucuaauuaauuauaguugacccuuaaacaacacagauuugaacuguuugggcccauuuauacacagauucuucucaauaaauuuauuggaaaauuuuuuggagauuugcaacaauuugaaaaaaccugcagacaaaccauguagccuagaaauaaugaaaagaaguuuuaaauuuaaguaugucaugaauacauaaaacaucuguagauacuggucuuuaucauugacuaccauaaaauauaugcaaaucuauuauaaaaaguuaaaauuuauccaaacuuacacacacaaacacagaucauacaugguaccaucugcaauugagagaaaugucaaaugugaaggugcaguauuagaucguaacugcaugaaguuaacuguagcacacacuguacuaccgugauaauuuuguaaccaccuccuguugcuauugcgaggagcucaaguauuguaaguauccacugaaaacgcuguguggacuaaaucgucugcaugugaacaguuucucucuccaguaaauugcuuauugcaauaacaagugaucuauugcagcucuuguguauuuuucaucauguuuagugcaauacauaaaccuugaauaacaccgugggacccauacgaagugccacuagugauguuggaaguacuuccaagaagcagagaaaagucaugacguuacaagcaaaaguugcauugcaggauauguagcuuagauugaaguuugcagcugcagccgccugucauuucagaugauucaucuuauaaacagacauuauaaacuuauggcaucaauauauaacaguacaguacuguaaaaguauuuucucuuaugauuuucuuaauauuuuuucuagcuuacuuuauuguaagaauauaguguauaacacauauaacauauaaauauguguuaaucaaccauuuauguuaucaauauaaggcuucuggucaacaguaggcuguugguaguugaauuugagaggagucaaaaguuaugcauggauuuuuugacuguacaggggguugaugcuccuaacccccauguugcucaagggccaacuguacaguaaugaccaguucuaugaaggagaaauauauuuugugguacaaguacauuuaauaagggaacuuguuuuuuaaaaaauuauuuuuaagagaauaucucacucugucgcccaggcugaaguguaaccuugaacuccugggcucaagugauccucccuccucagccuuccaagcagguagggcuacagguacauaccaccaugcucugcuaauuuuuuuuuuuuuuuuuuuuuuuugagacagagucucacucugucgcccaggguggagugcaguagcgcgaucucggcucacugcaaccuccgccuccuggguucaaacaauucuccugccucagccuccggaguagcugggauuacaggcgccugccaccacgcccaacuaguuuuuguauuuuuuaguagagacaggguuuccccauguuggccaggcuggucucaaacuccugaccugaggugauccgccuaccucggcguccucugggauuacaggcaugagccaccaugccuggccuaauuuuuaaaacuuuuuguggguacuaggucuugcuauguuguccagucuggucuugaauuccucgccucaaaccauccucccgccucggccuuccaaaucucugggauuacaggugugugagccacuguccccagcagggcacuuaacauugauuaagaaaagcuucaaugagaacaugacauuugaaucgguaagcagugggauuagaucaggaauuggcaaacuaucuggcccucuccuaaaaaauuuuacugacuccuguucuagagaaagaaaaucuauaaaauggaaguuccugagauaagaaagcauaguacuggaggaagagcaagaacuguguguccaacauaaaggaaaacagaaaguguggcauacaaugagguuggagagguaggaaagggcuggaccuaaaggcagggucuuuauguuuuuguuuuuauuuuauuuuauuuauuuauuuuuugauacggagucucucucugucgcccaggcuggagugcaguggcgcaaucuuggcucacugcaagcuccgccucccagguccacgcaguucuccugccucccgaguagcugggaccacaggcgcccaccaccacgcccggcuaauuuuuuguauuuuuaguagagacgggguuucaccguauuggacagcauggucuggaucuccugaccucgugauccgccagccucggccucccaaagugcugggauuacaggcgugagcuaccgcaccgggcuggucuuuauguuuuuaucauggaccuuuaaauuuaucuuguuacuaaugggaagaaaucaaaagauuuuuuaaaaaauagaggagaugugaucagauuugcauuuaaaaauuguauucuaacuccacaauagauaacagauuggaacagagccaucguguuugcucaagaccaguuaugggccgggcgugguggcucacgccuguaaucccagcccuuugagaggccgagguguguggaucaugaggucaggaguucgagaccagccuggccaacauggugaaaccccgucucuaccaaaaauacaaaaauuagcugugugugguggcgagcgccuguaauccuagcuacucgggagggugaggcaggagaaucacuugaacccgggaggcggagguugcagugagccaagauggcaccacugcacucaagccugggugauagagcgagacuuugucuaaaaaaucaaacaaacagaaaaacgauuagggaguuuuuggacuuagucaagcaaugaugaugcuuggacuggaaugcuaauauuggugacagaaauaaacacuggcgaaauguguaggaaguagaaccagcaggaguuacuugauuggcagugcuggguggagaagaggagcgugucaaggacgacacccauauuucugaccugagcaaugggugccuagugcugcuacuuacugagaacuagggaacacucuaaagaagcugguuugggguugagauggccuggguuugggaugagaucaagcguuacguuuuggccaugaauuuaauguucaaaugaugguaaagaucauucaaguuguaaaaacgaagaaaguuaaauuuucaacuggugguuuggaaccccugguguccacaaaggcaguccagggaauucauguuaaagauggcagugccauuuuuuuuuucuguuuuuauuuuaaaguaaguaucaauucaccuauuucucccuagaaaauagagcugugugaaaaucccccaguguauacagaguggacaagccccagagccaguggagcacugcugagcaccuguguccucucaucugggcguucacugucaccgacucccaguaaucccggggguuucgucaauuacacaguuuuacaggaguuuuuucccccuuuuguaugguaauauauuguuuaaaguauauccauaaaaaccauugucuaaagacaugcagcuucugaucgaaguguaacaaucuaguaaugaguuuaaaauagguaauucuucuauaaacuagauucaggaugaucuuuaccaaauccguaaguucuauguuugucauagaaauuugauucuucaaaagccaauguuaaaaauacaaauuauaauauugauuucuaucuaauuugacauuuuaauuuggggaauuaacacuauuuacuauuuucagaaaagugcuugaaaauagaagccugaaaucuuaaucuuuaucucauaauuuaaaaacaaaaagaguccuuugcaggaacaugaauggagcuggaggcuauuauucuucaaacuagugcaggaacaaaaaaccagauaccguauguucucauuguaagugggagcuaaaugaugagaacacauggauacuuagaggggaacagaagacacaggggccugccugaggggaggagguggaagaagggagaggaucaggacaaauaacuaauggguacucggcuuaauacuagggugacaguuauaaucucuucacaaucucccaugauacaaguuuaccuauauaacauaccugcacguauaccccugaacuuaaaaguuuuaaaaaaaugggaaaauuaaaaaaagagagaaagcuguaacaguagcaguugaauuuuauauucaaaaagcaaacauuucaaaacaaaucaugaaauuguuuuuauuuguuauugauuuuauaacauggguuuaauuucaaaucuauguuuuagaguaucuuuuggugugaagacguuauuagccaauggugccuuuuucuuucauaauuaauucacuauggauuuaauuuauguaaaugaaauaguggcauuauuuauugcacaggaaaauuaaaauuuuauguuacaaaguucaaacuuaugcuuauuuuaaaugaaaugcuuuuacuuaaaaaguuccucuuuauuauauauaauaaugagaugauuuaauaaauuccauguguuucuauggaggggguuugagagucaaaagaaauuuggagacgcugagguagacaaagugcggcguauaagguuccugagaagagagguggguugggauaccaagcacugagcagaaaaugauagugaacugggcgaagggucaccuccuccguugccaucgcagcagcuguagcagaagagauuauaugagcugauaaaugcaggcuuauggauacggugcuggaaagguaaccugaugccagacuuaguuuauucuguguuuauugggcaucuguuuuguaccagucacugugcuaggccuggagacacaaagauguaaaagauauacucugccuuggagaacugcgugaacucggagggcggagguugcagugagccgagaucgcgccacugcacuccagccugggcaacagagugcaacuccgucucaaaagaaaaaaaaaaaaaaaaaaaggauauacucugccgcacucucguggcugcagacuuccuuucuguuugggcuggccuaaguauugcaauccugcagugcagaguagccauggcagcaccugccaucuccugggaggucacuccuggcugcugccaugccuccagaaacccagaugcaagaagaaagucucuccugaggaaccagccucccuuggcaggcuagacaggaguuggcugcccuuaaaguguuuauuuguuuaagucuccuguucucucuguuuuauauagaccuaaaggucuguuauugagauuuggaguguauggucaaaaacuuccacugccccuggggcagucuugaguuguucauccuuugcuuagaaaagugaucaagguguagacccaagcucccuggguagugaugaccagaagacucaccccgaguauagguguuuuugucaauucuuauggacaguuucaaaaucuauuaaguaaaaaauuuaaaaguacuaaaauuugguuuuuauaagccaaaacaacuuacugcgaaugcuaaugcaauauucuacuggccgccuccacacccggcagagcuugugugauguaacauaagcgcugcuaguuugacuuuugaugauuuggggaaaggauucuaauuauuacuagguuaucagcguuguucugaggucaucuucauuuucaaaugcugcucuucuugcuuuuaauuauaaauugcuguuaauuuagcuucaucacaauaauuuaguuuguuuuggauuguuuuguuaacccccuacggugcaguauugcauacuugcaucagugguauaaugguuucccaguaacuacauuuuaagucccguaugacuuguaauacagaaaugaaucacccauuaucucuuuugcuaaagcagauauaugaucccugccuccugccaccaccucagcaauuugcuguagagaggcaguccuuugauuugcuccuugcaaauguuuguuuuuaaguaacugauaacaugcuauuaagagcaaauuaacaaaauuagauuuauaugccauuauuuuauaauauaaaauuauacucuuaugaagaaaugguaagagauguauauguugcuagaaaagaaucuuauuacaucuuguuuugaaauguuccguuaucccuagaguuuguuucacuggaccacugacauguuuggauuagggaggcugucucaucuaaggggucuaacaacagacaaucgaauacuagaaaucacauagaaaaguuuauccuuuucaaauuauucaaaaauuguaagccaauugggguucaaacagucccuuuguaaugagccaguuguaugcauugagaacucccugugaggacuggaagucacguuuguuuauacuguggugggaaggccagaucagacugcugcccucccaauaaguugggagcuuugccacucugugggaguuagaauuuugaucugggaauggauaaugaguuauuuaaagcaggcugugcauuuaccuuagcugggacaaggcagcugcuauaacugauuaccagggagaacauuaagugggaaaaggaggcaacaaaacaaaguugggacaaugccaaagaaaugauguuacacuuuugccugggauaggcccacuacccaggaaaaagaaaaagacacccuuugauuuauucaucaaauauuuaccgagugcuuauacacugcugaugugcuugggauacaucaaaggacacguagacagccuuguccuuauggaacuuacaugcuuuaagcuaccuucaagaucuaguccuuuguuuuuaagaccuaaagccaaaaguagagagauaguaugcaucguacguaacagcauccuuccuaaaaccaaguucucugggcuuuccucaguuuacuucuuuguagcugcuuuguagcuccaugggcuaauuccuuaaucuuaaacuucaucuuccucacuuucuugaucuccaaaaugcuaccuuguagguugugaaaacugccuaaaauaauccacaaaaaggucuuuagaauaguuccuggcacaacguuagugcuuaacaaauguuucacauugcuauucauucauauccuucauucaacauauuuauuaggcccuuaauacaugcugagcucuguucuggauucugggauugcagcaggaacuucagagacuuagauucuaaaugguuguuuauuuauauuauagguuaaauugacucuugugaguuagucugugaaccaaaauaccauguuuacauaauguuauuucuaaggcaaaaugccuuuugaauuuucaacaacugauuuauggaacgacauuuuggaccacgacuugggauaugccuaugauguucuaaguguuugugaacaugugaauguguguguguguguguguccucuauucgauggugaaaauuuucaguaugagccccaaguaaaauuucaagagggauauaucuaucuaguugcuucuuuacaaucguauuuucagcauaguuaggaauaaggaacacucuaaaaaauuuuuuuaugcaaguuuuagguucacagcaaaauugaaaggaagguacaaagauuucccauauaccccauacaugcauagccucccgcauuaucaguauccaccaccagagugguauaauuguuacaauugauaagccuucauugggacaucauaaucacccaaaggccauaguuuacauuaggguucagccuuaguuuuguacauucugugguuuggacgaacacaugauauaucucuaccauugaacaugcucuguaugauaucauaucauguuuaucaacuuuuuuuuuuuuuuuuugagcaguggcaagguuuuuugugaagagcaaaagaacaaagcuuccacagcauggaaggggucccgagcggguugccccaacuuuuuuucaugggucguaccuuugguguuguagcuauuguccuaccuguggucaccuagauguucuccuauguuauuuucuauaaauuuuauaguuucguguuuuacaguuaaaucugugauccauuucaaguuacguuuugugaaggguguaaagucucugucuagauucauucuuuuuuugcauauggauaucuaguuguuuuagcacuauuuguuaaaaacucuauuuuugcucuauucuacuacuuuugcuguuugucaaagaucaguuaacuacauucaucugagaggaacacucuuuuuaaauuccuaauuguaacuucauuaagucuuuaggaacagaaaaacaaaaggcuaacagaguuuaacuucuacuccugggagggaaaauuuuauauuaguacuaggaaauaacuaaugccuguuuggaggcaaaaauucugacaaaccaucuauaaccugccaauuuuaauauuuuuauaauguuuauuauuuuugcuuuuucuacaauuaacuguggauaauacaaaaauauucaauuaauaauaauugcuacacccauguuagcauuguacaaagaaccacaagaggcugugaguauuaaacaccuaucuguggaaaggucuuuucgcaaaaagacagaauagguaaauuucuguucuuauaucagaggggaaaaaagguacauuucagugcugaaagucccugaaaaauuucuuccauauauccaauguaaaccucuuucagucaauucacucucuaaagcugauuuucucucuuugguuuaucuuuuugguagauccagaacugauuagaauuuucauuaucuuaacucuuaagacuuaaaauuuaacuuagaacuuuuaaauuaaaucugauuuuucauuucuguaguuguguuuguugcuuugccuuagacucuacaauuuuaaacauugaauauuaaaugugaaaaccuagauugccugucuuuugcuuuauuuugcaccuucuaacuuauuaauguaucccuguauuuauuaacaugcauucagcacuagguacaaaaggaaaaaagacaugauauuuccccuuuagaagcuucgaauccagugcgggagguauacgguaaucauacagguguaauagacuacgguaagaguaaacccaggaugcucucuguguacaucagacuggcaugucacccagguuuggagguacagggcacaauucuuuugagaaauaauaucuaucgucaaauccuaaaaugacauggaggaauucuuuuuuuuuuuuuuuuuuguauugaaacagagucucgcucugucgcccaggcuggagugcaguggugccaucucggcugacugcaagccccaccucccggguucacgccauucuccugccucagccucccgaguagcugggacuacaggcacccgccaccaggccuggcuaauuuuuuuuguauuuuuaguagagacgggguuucaccguguuagccaggauggucucgaucuccugaccucgugauccgcccgccucggccucccaaagugcugggaugacaggcgugagccaccgcguccggccagaaagcuguuuuuuaaacauuaaccaucacaccacuaauggauuuugcuuuugcccucccucagugacaguucacauuuuuccuaggaucagggcaacagguuuccacccauuucccagaggaagacagcuuuugccucucaccuucuccuggaggcagugggccuuuuuccugagaagguuucuugccccucccccgggagcuugaggcguuugcuucauaugaaaaaauagucuagucagugggcaguggauguccucaugccccaccucggagggggaagcugcucguggguuuuuuugccccgccuucaaucuuuccugugcgcauccggggggaggaaggcuguggaaaaguguucaauaaugagugcagguuucucuuguccucuuguguuuggggcucccauggauuccaggcuggcacacuagcccacacuuuaagaacccauuaaaagguuggcugcuuuccuuuuaucuacuuuuacaguggccauuuccccuuuccuugcuaugccaaagauaaaacgguucaauuguucugccuucagagagucaugucaccuuuuggaauuuacaucagcuaguuaccuugcaaccucagcucucugauuggcucaagaaaaaauaugauuuugaagauuaucuggcuuuugcccauuguuagagugggagugauugugugugugugugugugugugugugugucuaugcacacgugcgcgugcaccugccuaccuccuaguaggagguagaccccucagaaguuagaccuggaggagucuuucucuugaaccauguaaaaauguuuaggauuucuucugagcacucugagaggggccuuugaaggguuuuaaacaagggaaagacauuucugugauguuagcguuuucaguaccaugaggcuuuucucauacuuggugagccagaguggcuccugauaacuuucugcugaucauggccuaucuuuaacuuugcaguuuguuucugaucucugaguuuauugacauuuucaccagugauuuugcucgcauuauccaacuacuuccauuccuaugacauuccucugguuuguaucuuuccauaucuguuuuaagauauguuaacuaaccaagugagugacuucaaugaagaugcugccaauuccuucauuccuacugucuuagaaccugugcaaggauuaaauaugaauguuuauuuuggcuguagucccugggcagugagagugagggaauggaaggugaggcguggaagaauggaaaacaaugugugauaauguguuacaauacuggugacugcuucuucuuuuauuuuuauuuuauuuuuuauuuuuugagacagggucucacucugucacccaggcuggggugcaguugugcagucauggcucacugcagccucaaccuccuggauuuaagugauccucccaccucagccucccagguaguugggaccucaggugcaugccacugcacccaguuuaccauuuuaaauuuaaucaucuggccggccgcaguggcucaugccuguaaucucagcacuuugggaggccaaggcagguggaucaccugaggucaggaguucaagaccagccuggccaacaugguaaaacccugucucuacuaaaaauacaaaaaauuaaccaggugggauggugggugccuguaaucccaucuacuccagaggcugaggcaggagaaacgcuugaagccaggaggcggagguugcagugagccaagaucacgccacugcaccccagccugggcaacaagagugagacuccaucacacacacacacacacacacacacacacacacacacacacacaucauuggagcuauucuguagagauaguaguauugccuucuguuucuagagggggaaauugaggcucugagaaguuauauaacuuacccaacaucacauagcuaauauguggcauuguuagucuaggaaugcagggcuaucugaugucagagcccaugcuuuuaacuaccugaguuuccccagcaagccagccucucagcggggcuuggacuacaagugacaguguuuguuacaucuaagucaaauucucucucuacuaggggccuuucaggcuaaugugucuuagaaagcuucccagguuguagcaagacuaaaugagcuuuuaaaaagacuuuuuaauugcuaauggagcauauggugcauaaugguuaaugauaugcaguuuccggagcuuucugccuggguucuagugccagucccaccacugaaccugcuguugaccuugugcaaguuacuucaccccugggugagucagugucuucauuauaggagagaaaaacggaaaaggucccaccucauaggguuaugaggcuuaaaugagcuuagcauuugccuggcguguacaaaacgacguauguuuuuguuaaauaaaauaaguucuucgguuuuauucugcaauucacacuuaauaguauaucauuauuaaauuaaaaaaaaaggaaaagaaaaacauuaacuagcaggucuuccuuuaaaacuaaauaagcucugcugcuagacaggacccugcuuuugucucaggaaacacugaauuucaggcugccuuugagagguuuuguuccaaggcagacccuuuucaccugacuugggaagggcaguucacuuugccugucggagagccuaugggucaguuccaggaagaauuccaggaauucugggaaauggcuggaaggcauugacaugggguuggagcuguguguaaggcccuguaggcagcaguguuccaauugugcacuuuugauguugcacaaaggauugaaaucuagacucagucaaacauaaugaauuaacugcuuugugggauaccauggcuuuuugacauuucuuugguaauuuugaacaaaauaacuucugaggugauuacauaaggaaagcaaugccuuucgugcuuuugaagaguguuuuccuuuguugagcugaauguguauauuuaagggggaagagcaguuucgugcauuguuuuggccguguguagcaugcaggcugcuggugaugggaauugagcagauuaaagucaauguuugguuuugugauaauaucuugaugaucuauuccuggugauauuuucugggcuuuuguuuucuagaaauuaauugguuuaaaaauggccauuauccauaaaagaauuuauuuuguauaugaacaugggccaaaccauuuucuccuucuuaucuauggaaaauagucagcuuuaaggagccgguauuuuaaaggcauuuuguaugaauauagaaaaacagcauuaaagaggcuuuugagucacucuuuuccaacaaauguaaauuuuaauauuuauauguuaggcaaaugugucauuaaaagaaaguaggcauccaucuagcugauguauugcugacucuggcugcuaagugaagcucacacaguccucugcaaauguggguacaggggauggauggguauuaagaugccaaacgugcuguucaugcugaauuguuuucuaaccagcccaugguacuucucugcuauuuuuuuaucuuuuucuuugucugauacuccccucaauuuuacauuacuuuccugcucucuuuucacgguccuguugcuuugguucuucauuucuagaauacucucuucauuucuagaaggaaaucuguggucagaauuuaugcucuucuacaguaaaaugguaaauggugugccuaggaguagcauuuucuucaaauucauauggcuagauuuuauuaccuaaaaucugagauguacuaauuagggaacaaagaauuuuaaucaaaaaucuaguugucagaaaacucuagguuuguuaaaauauauauauguaaauauagguacagauauaucauacagacuuuggaguaucuuaacauugagauuguuuuauacaagucagaucagcacauaggaggagucacaacugucauugaucauaauuuaugacccuuucuagacuuucugaauguuguuauagaaagaaaugucuuauauugagcuugauucuuuaacaucauagaaauucauucagaaaaguuugaugaauaacagaagaaaucuuuauucacuggcccaaagcuuaguuuauauucugugcuguuauaacaucuauaugugugucuauauuaguacuaucagcucucuguggcaaaaagaggcucuuuaaagauggaaacuauuauaauaaaacuucguauuuuuacaaaauaccucaaauugguagcauucaaaaugaauucauguugguuaauaaugagguguacauuuugcuguguaagugaauagaucaucauauuaccccaagaggugauuuuuacaucuauaucaacaguguuucuugagauugaggaauugugaaaaggauuuuaguagaaggguggcaauuugcagcagauguguaucugcaccucugguaucacugguuguaauugaacaauaaaaauguugcaaccgucuggguagcaagauggcuaaggucggcucuugccugugauaguaagaauggaggagauuuguuugacgucauagacucuggauuauaagaaggagacaugucaagcaguaacuacguggcauguggcugugaugcgucuacagccaaccuccugguguggccuucccaaagacaaggaagcgucccauucaagugugucucagugcuugcaugacacagugccucuggauuuuacgucaguucugccuucaguguaaagcccugauuuucauagauaaccuaaucuguagggaaaaagaacauuaaaaaaaaaaaaguauagccacaaaaguucuuuccacucauguguggaucuuuccaguuuuuucagacagaaaccaaaugacagccucacagucacagaaucuuccaacacugaaaguuaaagcugauuucuucuucauggagaaaagcuuacaaaccuuuucagacuacuucuuuagugucaauucuuggaaccacaucuucuuccugauuuaaauguuuggcuguguaccuccagcuagagcuauuagaguuuuugcugauuugcuuggcauaucuccagcaaaauaguccauuaaaauucaaauccuuucccaauaauugagacaaucaauuuacauuaaacaaggcacaaauauaauuuuauguacaauuuaaauucuauagaaaauaaucaguaugcaauaaagagggacacuuauuuugaugcaaagagauguuuuucuagucugcauuaaacaaaucuuucauauuuucaaaauaguucccucauuaucuuuguguagaggagcucuauuguguuuuauuuugauguaggaacaaguguguguccauggcugcauguuugauaagcaguguaacuuucucucagugacauguaaagggaaagguuugagauagaauaaggaaaguauuugcuugcuauuuaacuuggaacaauucauacaaaaagggcgaagaagaugcauggggaauuuauugccuuuguaccaguguuagugaaaugggcauuguuuguucaucuucaccuguuuaugauacaccaggugguuguugcucugccagagguuguguguuagguccuaggcaaaucacucaaugggacuugggaagguugcauaggaugggggccaugugcacacacauaauugugugccuuagugcagaagaguuccugggaaaguuuuaaagccccagcagguaaccucgcaaggcagcuagaccccaccagugugccugaauccuccacaguucucauuuguaagcucuuaaugagacugguauugucggucaggaaaucuagaacacuggagaaauauuauuaggaagaauauaguaaaaauaaugacaagaucgaaaacaaauccugucagagcccaagaauaaauuuggcuuccgcuugcugugucugucuguuuccauaaugguccagaauagaaaccggauguuuaaaaucucucuccuuuucacaugcucuccuccccuccugucuuccuuccucuucaguauuaguagacuuacuauuuuuauuauuuuuuauuuauauuccuaguuuucaauauuugccauuuguguggauaacacauuaauuuuuaaugaaauauuuucagacucuuggaacucuuggaauagcugaaucauaaaagaaaacuugaaauugauauagacuccaaggcagcacacaaacugaaaauuacgcuuguuuuuauucuucccacugacaaaugacaaaugguuauuugaaaggaucauguguacuuagauuuaaacuucuuauguuucuauaugagccuaguuuguauaauuuuuguggcacagaagguaauucagacaccauuuuaauuaauaauuaaaaugaaagaagcagcaaaacaauaugugagguagugagcuccaguaauuuucuuuuuaucuagaaauacuuauuuuugacaagccacauugcuaguaaaggaauucaagugugauuuagauuacgucauaggcuuaacuuuauuuuaguucuguugcggcacuaaaguuuuuuuguuuguuuguuuguuuuguuuuuuuuuuugggauggagucucgcucuguugcccaggcuggagugcgguggugugaucuuggcucacugcaaccuucaccucccggguucaagugagucuucuaccucagcccccugaguagcugggacuacaggcacaugcugccaugcccagcugauuuuuucuauuuuagcagagaugggguuucaccauguugcccaggcuggucucaggcuggucucaaacuccugagcucaggcaguccgccugccucagccucccaaaaugcuaggauuacaggcgugagccacugcgccuggccagaucuaaagaucugaaagaaaguggcauuuguuucuuuggguaauuuauuuccaccaaucaauaauuguuguuagugaaauuaaaguuaauacugaauauuauuuaauuuuauacugcaugguauucucagaaaugcaacuuuguaauccacuuuggaacuguaaauuaauaagaauaguuucuucuaaaaguuuguuuuuuguuauagauagcauggacauuuaagauauaacaucuuuuagaucuuuucuuauucucaaauuauaaggauaucaauuucuauuuuauguuggcaacuuaaaucuuauuuuaaucauuuauauaugugguuacuuuuauauuuucuucuuuuaaauuaaaauuccuaaaaaagucuacuuaucucaaguaaauuuacuuauucucacauuaauaacaaacauauuuuuccaaauauuauuuucuaauguauuucuaaagacuaauaaauuuuuaaggagcucugccugucuuauaugacccgaguuauguagaauggcauuuuauagaaucagaagaggccugaaagauuaucuaguccaacuucaccucuugucgucuacucccacccuccauucccauccccauccccagcaccacauuuuauagauaagaaaacggaagcccaaagaauacaaguaaugacucgaauccguuuucugacaucaggucuaguguuuucuacuguacccacucaauaacuuauaugcuuccagaaauagggagguggacuaguacuaaugaugaaaaggaaaauauacaauggacauaaauaaucagauguuuaccagaagcuauuuuguccagugaccuugagaccagaaguuggaugguuaauuggaaggucaaaaaauacaugacaggugauggauauguggggcugaggcauauuuuuuguguguaaggaucaccugauuuggcaugccaugucauuugcccuggauaaacaacacccaaaauacaucuuuuauugcacccaauuuugauuucuccaaacuaagugaggacauaaagacacuugggaaacagccuucaugcagaauuugcuauuuuaauggcccuugcccaccaaaucuuuuacauuuauuucaggcacaccuaauuggacaaacuuuuuguguugggggguggaaauucagcuuuguugaaugcuucuaaaucacuccacugcguuuucauagaaucagcaacucuuuuuuuaacaaucauacuucugaauucagcaaacauggaauuacguuuauguaagcagcacacacaggcuugggaagaaacauggcugacuuuaggaaguagagcacaacuguugggagcacaagcgcccauuugugcuggugaguagcagucauuggccauagcacugagugugccguggacaucauucauguguuugacagagggaaaaggaaaggguuaguuguugggugaucaggguaaguggugcuccauuuagagagcuucuacuguacuuuggaaggaacuaccugagucagacaaguaaagauguauaacauaauaacugguuaagaagaaugugcauugcauucuccaugcacuaucuuuccuccuucuuuuuuuaagacagggucucacugucuuucuugcccaggcuagagugcaguggcacuaucacugcuuacuguagccucaacauccugggauaaauugauccuuccaccucagccucccgaguagcugggacuacaggcaugcaccaccaugccggcuaauuuuuguauguuuuauagacacaaggucucacuuuguugcccaggcuggucucgaacuccugggcucaagccaucugcccaccuuggccucccauugggauuauaggcaugagccacugcaccugaccaauuuuuuucuuugugucagagaaaggccaacuuggaggcagaagaaagggaacuuuaucuguuuccuuucugcuuucucuguuccuggcuuaagaacaucagccucaccccacccagaagcugggccaguggagcuuuuauauacugagcaaaccauccauagcuacuuggcaauaaaagcaucggccacuguucagccuggagaauauaccucauguacagguuuucaggugaccugcugcccaguuggggcugcuuggggcugcagccaggcuuucucggauggggaccugauugacuccuugcauaaaagucauggaaggacuacuuucuuaggagacuguauggcugaaaauacaaauagcuucaaauggguuuaggaaacucuuggauuaagaacccaugcuuggccgggcacggugucucacgccuguaaucccagcacuuugggaggcugaggcgggcagaucaccugaguucaggaguucaagaccagccuggccaacauggcgaaccccugucucuacuaaaaauacaaaaauuagccaggcacaguggccgugucuguaaucccagcuacuccagaggcugacaggagagucacuugaauucaggaggcagagguugcagugagccgagaucgcgccacggcacuccagccugggugacagaacaagacuucgucucaaaaaaaaaaaaaaaaaaaaaaaaaaaaccaugccucauucuuaaaaggcauuaugaauguauuaagucucaucgcuaaaugaggaaugaacaaaucaauagguaaugaacaacuauucucucucuaaauugggugaauauaauccuuccacuuuuccuuuuauuuugggggaggaaggggaucugagcauccauucuauuuuucuuccuuaauuaggucuuaguaucuaucaagauggugauuauagugugugugugccugcgcacgcacacacacacuaucuuacauaacugccuguuuacuccuuugcuacacugugacucaaagggguggggcagcacuuuugcaaauguguuuuacagacaauccguccuucacagauagucuuugaaaaaaagguuugcaugauaucuuaguuuuggaacauacugcauaaacuauguacuuuuuagagagucagaauguacauuaggauauuaaaagcauugauaagucuucagaauuauuaaccauuuuuaaaauuuaaguuauaguucaaauaauauaaauaaaaauauuuguaaacauuuaaaacuuuacaaagaaggguaaggggauauggugugaagagcuacaaacuucccuguggggugguucuuggagacaugucaccaaacuaagcauguaaauggcuuccuguggcauuucuuagaggagcuaaauaguuucugcguggcuuugugaucaucuuucacccuuccugucccaaccguggcuuuuauuuuggcuuuauuucccuuauagcauagugugcagcaggauucccgaguccuugcuuccuaacucauggguugggagagcugcucauggcuguagcugcugcaggcacccgcauugcugaacaaugggaggugucauccacaggugaagcuugaggugugguucauccaggcuucugggaccuugucaaggcauagauuuagacagaaacagguccuccagggcuugguuauguccauuacuaaaucuggcuguagcaaacaaggagaguaaacaucuuuucuuuauaguucaugagcucugaaaagggauuuucuguuguuccguucuucucaggaaucuagaaucaagugugaauaaaaguagagaggugguugguguuuguucauguauuuauuuuauuuauaguucuuucacucuacauacauacauucuucagauauguauuguguucuaacaaugguaacaggggccugugguaggcuuugggguugaaaagauguguaagacuuaacccuugucucucagaauucacaguccgggugcucgugccugaaagaccuuuuccuccccugccuagagaccucuuauuucccaagacacaggucagccaucaucuccaguacaggcuuccuuaaugccacucucuguguuacucagcacuucguucagacagcaguuugcucaaauguacaggacauuauaauuauucuuugacuguccaacuuguuuagacugugacuccuuaaggacagaaaccauacucuggucaucuuuguaucucuugccuauaguucagauccuggcccuuagaaggcauuuacuaaaugaauuuguaguccuuuuuaucuucuuuuuaaaaaucaucauauuuuaucauccuuuuuaucuccuaaaauuguagaaggguaaaaaugagacaaaagcagaacuugauguguaugugcaacauuuaaaaaauauuuuauaaccucucauguauaucuucauguuuggaaaaccuacucacuauaugugugucuaauuacuauuaugaaguaauaaaaaucuauaguuuuauuguauaaugaugcacauccaguggacacucaguaaguguuaaucacacuauuaaauaugcuuugaucucauuauaacuggaguggcugccuggcucuacuuaggcuauuuaacaacucauuguguuauuaguugauccuuauuuuucaagguuuguaggucaugcuuaauggagcgacuugcuaagguuguuagcaguuacauaaaugacucugacuuuacaaauuuuaugauaaccauuuggaaugaauuauauauuuuccaagcuuuugguucccccaguggcugauacauuaaagaauaauugguaaguugcaaaauuugugacaguuuuguuuuuaaaaaaucagcuaaauuuggcuuuuuacauauugcuagugauuucuguaucauagaugaaggagauagcauagacuugaggcugggaaacacguuucuucuuucacauagccaggcagaacagcccuuggaagacgauccuuggaaacacauuaucauuucuuguucaaaccaaauauacuuaacuucuguaucucuuccacuuuaaaaucauuauuuuugugaccgacgucuggaagugccccaguuuuuccacauggcccuuaacacauaguguuaguguugcauuucguaguucucauuuugaauuaugccucuguguucacuagcaggguuaccuccuguuaggcccgacuggaccauggaguccugggcuccuuuuggccuuuugccuagaguagggaggccucagugacugcaaauguggcaacucgggcagucccuuggcccuuuccccuuagguccacacucccaucuugggauucugucuuuuccacuucaauaaauggcuccaaggaagagcuugaaaacguauuuggaucugauugccaaauuucucaccagaacuauucuuucagggugggauuuuugagguuggguaggggcaggguuaaaaacaugagcuuucucuagaggccaacauucccugauucuaggcaguuagucagaccuuguuccuaugguagacgucucuguuuuccagcacuuagagcacuguauucauggccuucgauguccuucucuccucauuagauugugaggucuucaaugugaaccauguguuaucaaucucugaagucccaguguauggaaguguauugaauuaaugaaugauucucuaggaacugacauuguuuucauuuaaaaguuguuagguaaugguuaggauuaauauaggcugauuccauauguguccucaguucuuuccaccacaccauuaggguuugaacuccccuggcuucauuagcuauuuugcaacuccuuuaagcugcuguauaguuugguucauuugaaacagaaaaccagcgaaaaauacaaaggugauugaauaccuauuacaugauaggaauucugcagaccuuggagauauggaagauaaaucaaucacugacuuccagggauucuugucucgugggaaagcauguauucuagcguugcuagccccuguuuuaguagagauaugaguggacagcauaggguauguauaaccuguuuauuuuuguuuguuuguuuuguuauauaaccugguuuuguuuguuuguuuguuuugagacagagucuugcucuguugcccaggcugggaguacaguggugccaucucagcucacugcaaccucugccucucggguucaagcaauucugcugccucagccucccaaguagcugggauuauaggugugcgccaccacgcccggcuaauauuuguauuuuuaguagagacgggguuucaccauguuggccaggcuggucuugaacuccugaccucaggugauccuuccgccucggccucccaaaauccugggauuacaggcguuaggauuaauauagcauuuaauucuaaaaugcugcuaaaaucacuuguugaaaaagaaguguuuauugauaugacaaaauguucaaaauauauccccuaaggggaaauaggguaaaaguaguauacauuauuucaucuuuugcauacacagaagguauauaguuauagaucuauagauggauauguacugcaaaugucacaucuucuucauacucuagcuuguguaucucacacauguagacucaaauuuugccccaugucaguuuguacauagagcucagcaucuccuugaguuucccuaaagauuucauaggcacaaauguacugcugaucagcauggauuuuacugaagauauuguaagauggaaaacauucaugccauaccucccuuagaaacaacauaacaaucuccauuaauacuuaguucuccccuccauaauccuuuccugggugcauucccaacuuggaacuuuuuuuuguccuaucucccgcuuuccuuaacccuauaacuuucuaauucuuugccuucucauauuucuaggagccaaacauucuucacccccuucuauuaugcagaaccauccaguucugccacaacucuugucuuaaauggacauauucagaguagccugcuucuugaguaagcacacauuguacacacaugcauacagacacuuacguauauauacuaaaggaaauuuaagccaggcccgauggcucaugccuguaaucccagcacuuuggaggccaaguuggguggcucacuugagcucacaaguucgagaucagccuagacaacauagagaaaccccgucucuacaaaaaaagaaauacaaaaaccagccaggcuugguggugcgugccuguaaucccagcuacucagaaggcugaggugggaggaucguuugagcccaggaggcagagguugccgugagcugagaucacgccacugcacuccagccugggcaguagagccagacuuugucucaaaaaauaaaauaaaaaguugauugcggccugcuaaaguaauuuugugacccacuaaagggucaugacccacaguuaaaaaacccuuccaucaaaggcccuuugacaaccacacagcugcugaauaaaauugugucccucuuguuacaucucguuacaccugcgugugcaugcucaggcguuuccaugugugugcacacacagacagacaguaggccacacaccagaaaggaauauaguagugcucucugggauuacuggugugccuucuuccacugcacuuucuggccauuucuaaguuuucugcacuaagcauguguuaguuguguaaaaggaaaugcaaacaguaacaggcucagcugggguuuuucgucuuccccuuuuuguuaccuccccuaguaacccuugcaaacagaguuagacuccucuaucucuuucucugucauaccuuuuugacuucucccuacccuugagaugaucucaucucuuuuuuuuuuuuuuuuuuuuuuuuuugggacaguaucuggcucuguuacccaagcuggagugcaguggugcagucacagcuuacugcagccucgaacuccuggccuguagggauccuccucccucagcuuuuugaguagcugagacuguuaagugugcacuaucacaccuggcuauauauauauguauauauuuuagaaauggggucccacuguguugcccagguugguuuugaacuccuagacucaagugauccuccugccucacccuuccaaagugcugggauuauaggugugaaccaccgugcccagccugcaaugagauucuuacacugaaaugcauagaugggcugugaaccuucauaaaauuuauauaaaacuuaauguuuacuuauuucuuuucugagaagcagauccaauuauucugugagggcuucuguugugccaggcaagguucuaggucugauccuuuagcagccucucaaaacguugaagaacugagugacucuucuuacucuguuguuuuccuucucugaacugugagugccacgaggcaaggacuucauccgucuuguucaucacugauuuccugcugccuagaacagugccuggaacauaguaggcacucaaaaaguguaguguucugaaugauuaggcauugugaaguagaaaauacauuuaucuuaugacucuccuuuuccggaguugaugagauaucaugauguuauuggagggugcaggaggugaucaacaguauucuaggacuuugggaauucagacuggggaucacaaaauuuggagcagguuucgcuuggcacucaggugggcaucugucuccaucccaccggcuguacucugcaguggcugguaaauuacacucuucuuggugggcuugaggccccagcccaagacugcagggucaaugcaacauaaaaguccaggucuccugacucggaguacagacuauggcagcacuccugagcuugacuuucccugggcuucauuuaauaugguucauuuuguuuuugaagguaguuugugccauagaaaccagacaggguguuguuuaaauaguaggcugaugucucaauguaacauauuggcccacugagcucuacaagagugugaaucacaaacccgccucuguacauuucugauacagugugaauguucuggauguaagaaaauccuguuaagaaugaucagguuaucucauuuugccaucaaucguauuuugaaauguucgguugauagaauaacugcucuuccuggcuaaauagauucucucaacuccagcaaaauauuuuuaaaaucagguaauucagccaguaauccaaauuuuauuugguuuauuuucuucagacuguauauauaauaccaggacugaguguuuaaaguucagcucaguguguaguauuccugugauaauuucagcacauaaaauaagauguuuacaaaagccaaccugagaccuauauucuccagcaguuuagcagcaaauuccuacucuggguauauaacaauaauugggaucuuucuauuggcuuuacauaaacucagauuaguaguaaaaucuaaguaccaucccauuuggcaaacucuuaacuucaagcagucacaaauuugcuucugauugugcuuuucauucgcaccuagcucagauuuuugccugaugcuuuuuuaaauccucuaauuuacauacugugguaaauuuaaaaugagaacagaugaaugcugcuaaacuuuucuauuucacugaugaauaugguauuuugcuuuaacuaucuagcuguuauauauucaaugaccuuuaaaacaugaaaaagauacuucuuuucauauauaccgugcaagaugaauuauuaguauugucuuccuuugaaacuaugaaacugagacacagaggccaagcagagcaucugggaacugauuuccacaggccuaaaaucagaguuuccucuucccgggacucauaccccuucagccaggcagagaggccugguucgcucacguuugguuaucuuggaacugugggagguaaugcauccacucggaaugcacuucuuuccuuaccccacagcccccgugcaccacagccuacaucacuguacccguuugggcaugucggaacaagcacgaguaagggaagaggucgccguuuuugaguggcuaauaggaaucugcuccagcuaagcauauguuaucucacauauugugguuaauaauaauaauaaccguguucuccaaaggagccaaaggagaguuggagaaguuacauuauucaacaacugagaugucuaaagccugugcuccuguacuaucuucuguuugucccuguuaucuuguuuagugagcagcauagcauuuugcaagaguggaccguucaccuggucaggauuucagucagcaugacagaugcacccuccacuguggucggugucugggguaaccagagaaaacuucccagauacgguagaaauaaacuucccagauacggugggaauaagcuucccagauacgguggaaauaaacugcuugacaaaaugaauagauccaccaugacguaauuuucuaacuguucauuuguuuucaauaaccaaaagcaauauuaauuuugaaauuauauacacuacuuaugauuaaaaugcuguaauucauaagacaaggaaaaucuagggcacauuuuaaaagaaaaguuuaauuuugaaaggaggaaaucuauuucagaaugaagaaaugaaaacuuuugaaagcuuuaacaaaaaauuccuagggaauuuugaaguuuuauuuugcccuaacaugaaaaaguaggccaguugcuaaacguuaauugcuuuacuuccaucuaucuuuauuuuuguuuuuauuuuuugagauggaaucucgcuguguugcccaggcuagggugcaguggugcuaugucagcucacugcaaccuccaucuccuggguucaagcaauucuccugccucagccucccaaguagcugggauuacaggugucggcuaccaugcccaacuaauuuuuguauuuuuaauagaguuggguuucaccauguuggccaggcuggucucgaucuccucaccccaagugaucugccugccuuggccucccaaagugcagggauuacaggcgagagccaccgcaccuagccuauuuccaucuaucuugaucacacuugaucauguugagagacuagaggcucugaaauuuaauaaaugaccuaauucaaaauaucuuacuccaaauccagcuugauagaaagccaaacuguugucaguauaucucacuuuaagcaaacccaacauauuaaauccauauuuacaaaauggauuaguuaaguagucauucuucacuuagcaacauaauucauuauaguaaguuccccuuguaaugcauauaaacgugauuuacuuuauuagaacccucugugugugccacauuucaagugcaaaguacauuugauaauguuacucaacaaauuauuuucucauuuguccaaauauuugguugggcaucgcuguggccccuaaggaaacaaacaagugggucagaauggccucuggaccgaagggaugcguguugcaggagcaaggacuguuggcgugggcugaucgcuggucuacaggcugugggagcucagagcauggacccagucaguucagucuccaucauccuaguuuucuggaucuuccaacuccuuauucaucgaaugaaccgggagcaugcagaauuuaucuugguggaaagccuuucuccucaguuuucucucccuguuuugguuuacugaacaggaaagccugacauaauuaggucugagaagagucaucggguucugcucucauccuugagccugcccugguugguagggaaauucacuuauuaauucuguggcuggcuuugggucaugcagaugacccagggucacugggcuuuucagguuaucaaaagcuaaaugacgugggacacuucuggggauuaguuuaacgaagcuguacaaauauagucagaugacaaauuuggagauguaguggcagaguaaauaguauuuuuaaaaaaugcaugccucugaauguaauaguaaaccuguaugagaggcucugcuuagagagaaauuagagugagcuauuagcugugccuauauguuuauuuucauauaaauacaucaagaaagcuagauuuuuugcuuuuauuuuuauaccaauaugccuagguuaaagugggucauucccagcauuuaaaaaggggguagagggagggcaauuggcuugguuuugguaaagggguaggggauuauuuuuuauuuuauuguauuuagggggcaaucuuccaucuuuaucucuucguucuugugcuuuuccuggaccauguauucugaucauauuuaacuuucuauuguagaauugggauggaagaccuagaguucagcuugaaaaucuuuugguagaugcuauaucuuuaauaaauguuaaauacaggcaucacacuuuuaaagaacauuuguuuuuaagggucuuugugcauucaucugaggaaaaagcaaccaaaucuguuuuauucaaauuccaaauucuaggggagcagauugucacagaauauacagugaugaacuuccaaaaaggaaaaugggcggaagacucguagguauuuaucacgcaugcuagaaacauuaaugcuuucugaggaaucaacagaucuuugauucucuuuugguugagugcaccuuauuuuguaaaaaaauaauuuauugauuauuucauauuuuuuucuuuaaggaaaaaucuuauaaauauucauauucagaauagcaugugucuauucuguugauccugaagccauaaaagaaguuucauucucagugucaugucaacaaugaaaauuaucacaaaaccaaaaauaauucauguaaauguccgcauuguuuaaucaucgguuuuagauccaaagcaucauucuuucuguuuaaaguggucauucagaaccgaauauuuuaaaugacuuauaggagcccuguagaaaauguacagaaagaauucaccguuuaaguaaaaauauauuugcuuugcuuggccugucaguuuccauauuugcaguggcuucccauuauugacuagcaucaugcauugaggauuagguugucaaaugcgguguauuuacuuuugaacuucucugcugguaacagucggugcauacgugacauuuguaaugcugaugguugauuucaaaguauaguaucuaaguccaauuuuucaugcauuuuaugaagcuuuuguccuuaacacuuugauuuaagucgcucaaaauucauucuuaaaagagagaucauuucgauguuuacauaauugcaaccucaagcguacuuugcaaauuucagcuggcacucuccaaucccucuguuaagugguuaucaagggugguuauuaccauuuacaauaugaggaaaccaggagacagggauuuuauugacuuauacugugaggcagcauugcugcuagucuguuaauauguguuuucgucucuuuucuaaacagauuuuaaaauuuggcuauaauauguuaggcaucacucucuggcagaaauauaauugucaggugugcugguauggauagagguccugcagaaaccuucaggacccaucccaaaaugacgaagacacaagauacaguucuguccucaucuugacuuuugugugggucagagugaguuacuaauuuuagaaguguucucgugaagacaucugacuacucagcacacacaaucuuaaggucuuugcuguaagaagcucaaccauccuuuagccucccuggccagggacccuggccucugcuuuuguguuucaagaauucuugguucuggcccuguccuugauucccuaauuuccacaguuugacagcaccgaauguuguguuaagcuucuugcuaccauguaaaaauuuccugacaccucuugcaauaauaauuguuauuauauaauauauaauuauguaagauauaauaaauauauaauaaucgucauuguaauucucaucacuguaguagcagcagcuaacuuuagagcgugcuugcuauguaccagcuccucuucuaagcacuuaccuuuuaaacccacugaauuuucauaaccaccacaugaagcgaguacuagcaauauccccauuuuaacaaugaggaaacugaggcacagugagguugaguaacaggcugaaggucacacagcuacuaugugauagaugccaaacgugaaccugggcaguguggcugccaauucugggaagaagggaugcugauuugaagaaucuuagcaauauuuuagcucccauaauaguaaaaauuuuuagaagcgcuuccugugauuccagucagauauggcauuguuuuauauucccauugucagugaucucuaaacggcauuccugccacuaaacugccacuguuuuccuacaagggacgucugaucaguuucugaauugagucccaagauacgugccuuaagcuauugcaugaauaucucuaugugggaaauucuuguguucugauagauggagaaaaaugugguggagauaguaaaauauuaccaguuucaaauguguuuauguuaccuuaaauuugaggcagacuauggagagugagaagaaaaagcagaggggcaauaaucugaaauaaaagagugacagaaaggacaauuugguaaagccuuuccuucccauaaugaaaaaaguagucccuaguuauugacaauucacucagacauuacuguacuuuacaauagucuuuacaauagucuuucaagguuucuuccaauuuaugauugaggaaguggaggcucggagggaggaaguguggccacagcugcacaguccuaggagggaaagcuagaauuuaaauagguuugccugacucgaaagcuugugcucucacugaaaguucauaguaucuuucugccucuaaagagaagaugguccuguugaaccuggaaaaucaguggcuaacauggggcuuuucaagacucaauaagguggaggaggccagagguucagcacguucugccagaaacaagucacugaagaacggagguguauuacagaaaggcuuggggggugggggguggaaauaauuguaccuaaaaugaaagaaaacacaaccuuuuggaagagugggaauggaaggugauacuaaaauauuuagaaagcuaauaaguuuuuguuuuuuaagagacaggguuuaacucuguugugcagguuggagugcaguggcacaaucauagcucguggcagccuuaacuccugugcugaagugauccucccacgucagccucuugaguagcugggacuacaggcguaccaacacccucagcugauauuuuuauuuuuucuggugaugaggucucacuacauugcccaggcuggucuugaacuccuggccucaagugauccuccugcccaggccucgagaagcuaguaaguuucuaaucaguuugcacgugcuucugaguaugcuaaugcuuuuuuuuauuaccacucaaugguaauaaauggugacgugguaauuccaagcuguuuaggaaaauuuguacuaccaaaugucacugucacucaagggauuauugcauauaggucuuauuuuguuuguucuuuuuuaaggcuuucucugccuuucucccuucuguuaccauggcaauauuaauguuauugaucugaguggaacaugauguuauucaccagugugacauacauuagauuuguaaagaaucuauuuauuagaacaauuuaucagguguuaauaaugcucauacauuauauuauuuuuuggucacccaauauagaagccucuauugagauaaagaggcaugauuuuuuuuuucacaaaauggaugauuucuuauuuuaaacacaaaguguguguagcgagcacuacuuucucuaggaggaucuccgggaggauucugguggcauguuggucagccuucccugaggcgacccgcaggaauggaauuggcgccagcagggaacagucacucacaguccacccaacucacagugugacugaucaccacgccagucaugucaaaacuggacauuuccuguucacagaaaguugaagcagguccauuuugaagaacaucugauuggacauuuaaaaauggauaaagaugauucagaggaccaaaagcccaauuuuccauuuucacaagcuauagguagagcagcccuagcugacuggaacaaagugugacugaagcauguuuauugugaagaaagagauggaaauacuggagaugggcauugacuuaacucuauuucgguaauguuguggccacaccaauaaguccccagcuucccucuccccuguguagcuuuuucuccuuuuucuguuuguugcaccccugacggcagcguguucggcuuguucccuuucucaggugguggaagucuguggccucuuagccugugccucccagcacaccugaagaaaaccacaauucccagugaggcacugacgcuuguaucuuauugcuuaauuauuauaccuauuuaaugcuacuuagaacauugucagcuguugag[450 bp omitted]guagcaucugaagucuuugcuuuaauuccgcagcaugguuuugaggaguuaccaguuccuuguaacuguaucuguggcaugacuuucagagucuuuaagaggcuucagaaguccauuuucuucaucuucaaaaaauuugcacugaugagagauguuuucucuuucuuggcacagucagacagagcugagcuacaugaccauucugcugaguucugacauuuauuucauuggaaccuuuguuaccacugaggcagucuguuucauuuucaucccauuccuuauuucuggacuauuggugcgucuaaauguaccaugguacauuuuuaaaacucaauacuauacagagcuuuagcgucaagggagguguuuucuuggaugaauuccucuucucaauucuaagaagauucaccuccaccuggcccacagcccucacacacauauuuacugcuuguucccaugugcaaaggucuuuuccgagcccaaaugggucaugaccucuucgaggggaagggcuaauaccuaauauauuuugguagccacugugaucagagcucauaagagguacuuggacuucagguaagugaaacacaacaucuuuggaaugagaucuuaucccauugguucuuuacucuaagauuucacuuuaccuuacccucucuccaccacuucucaacccugcaucaguguagcacagagggaaugaagggggcugcaggaaagguuuggaggccaggccgaggauugagcccacuacuuucugcccuuccccauuugccagaacucaagucaccuggcucaaccaacugcaggagcugggaugcaugaucuagaagaggaggaaccuguggaguggugagcuccaguguucucguuccuaucaucccugccucuaaaaauaacccuccauaaacaaaugauagcaaaagucaucucgugcauauaaagacaugacagaaagcaauaucuuuuuagguaaggggcuguguggcugugaagguaaggacaguaaccagugagguuucccuccuaacacugucauacacacauccuuuucacaaaugucaucuugcuaacaacuaugcaaccuccuuggagugaaaucuuggcugucuuguucuccacuguaucccaacgcccaguaaagaagacauuguaggugcucagaaaauauuugcugagcaaaaaugaaugcaugaauaguagaacaaauuuacauuguauuuuuuucacauuaucuuaaaacuccuaccuuuuguacagccagaagacaccagcaccuaugugugcacugcauuuaaacagcuuuagcaauaucauagugcuguuggguccccagcugcugccagugaaauuguuuaccuagaaaguccccaaggccuuuucugcaccaagauauuugccuucucucaucuuuuggcaaaaaacaaaacaaaacaaaacaaaaaaaaacccuaggcucuuuggaagacaaaaaaaguauaugacugccacacaugcaaccaacucucugcuuccaccaaagguggaaaugguuuugucagugguucucugaaagcuguuuauuuuaaaagauaaauaaaucuuuccccuuacccugugacaucugauccagggccaauaggagcuuucaaaacacagucaaguccacugaugcuguucuuaaaaaugcauucuuucauucaacagcugcauguauuggacacugugcuggaugcuauggguaccagcaggauucaguccugacucucaaggagcuaacauuuuagugcaggaggcagacagucauagugcacugugguaagagccauggguagggcacagaagaaggaacagguaagcaugagaaggccaagaggagcucuguagaguggcaacacuugauggcuagggagaggcaguguaugcagaggagaauaaggcccuuucucuucuaauauuuuuuuggauugcacacuuuagaaaacaauuuuagacuuaagacccaaaaugagaagaagcacaugacuucuggcugacagcccugacauccccaauaugaggacaugauucugugccuugcuggaccuccugacugcccagccagccagggcugcuccugugucuguccagccccaagaccagccugauggaaaccgcuuccuguaaugccuaauauagcacaguccacucacaauaugggucuaaaaccagacuuuuaucuugggagggaaaaaauaauauauguaacaaaaauguaauccaugguaauauuacucauuaaauucaccauaugauuagguuuuugaguuuuuaguaauccacugacaucuucucccugucuuugugaugaguccagagccugcaccuuugacucuguuugccugggugguacuccgacaucuucgauagggaggguaaugagaccguucugccaguagggcacauggccacauagacuguuuaaaucaugaaaucucuuggaaauacccauccaagggauggaugugaacucucgguguucccgugagagccagcagggguaggugccauuggcuagagagacggcugaaaauaacccuucauucagagccuuguguagaaaguuggguugcugugcucauguccucuugacccaaaauuguuaacaugguuggaugaaaugcuguuccuagaggggaacaaaaguggcuaucacaauuaacauggcccuguuugacaccugauccuaaaagugauuuuuguaaauuagaguuugaagcaugugguggcauugguggugcuuuuucugaauguuguucacuuagguuuuccaguuacacgaauuguuuucggggagcuuacacaccuguucccauccucuggggugggcuaguugcuauguuaugaaccuuaaccuuugcauauaccucuguuuuauucaugggaggucacaacuugguaauucugucuaguauucaagcagauuauuacaagugcuuagaagacuaauauaguuagcauuugauuugaaagggacaaagaccaguuaauaguuuucuguaacuauacuuaauauuucaucaggcaaguaagguugcugccacuuaguuaacugggaugccaaggaauugcuaaaaaaaaucaaauuaauacacauuauuacacauauuuacacacauugaacuauuucaaaccaguauugcuggaauaaagacaaaauaauacuguguauuuacauaacaccauaacaccuuucaucagaaaaaucucaagccuucgcagacuaacuaagcugcacaacaccgugugagguguguaggaaguaagauaggacaauaaacaagaagucgauggagggaaaaggcaggcaggcaggcaagcaugcuugcauagggugagugagacuccuuccugcuggaugacccacuggcauucaaguccuggucaccccaucgugaggauaccuagauugaaagcuccaguacaugucacaggugauuacagacuugaguauucuucuguguguuguuuuuccauucuaaugucuguauuuuaauugaaucgacuggacaaagauacagcauuccaccucuacuggacuguaacagugacucccagugugaucaaucauuugaucauuguuucacuuucccuagggccaacuaaauacaguuuccuuuauuuuuccuuagcuagaauuuuuuuacuaaagugugacaguuuauucucuagaaaugccuagagauggcuggguacaugcuaguccauggaaaaggcaugggugagucauggucucuuuugggagggucggggcuggugggaacaaauuccugcccaagccugcuucaguggcugccaugcccaacaccucccaugauaggccuggccuggcacugugagcagagagagcugaccaggccuucuguggagcaucugagacaggccuggagcuggaggcaguagcgagccaggagaaccagcgugaagaacacaggaacagcaacaggccaaugggagucgugaauuuggcuuuucgaauuuuggaagagcauacauuaacaucuuuaaaucaauuuugaauguacuauguucuauuggauauucaaaaaguuuaguccugaaacuuaguacucauucaguuaucccaugcaaaggauuuauucaccucauccuuugagaaaaaagaauuuucuguauguuagucuuucacacagccucuguuucggcuuaaccuuucagauuuucagauaauuuaggugucacagauacccaugauaggaucguuuuucagacacuauaauuuaaaugucucugaaauguaauaaacagagcuuugucuggguuuuggaaaugauguuuucuucccaaacagcuguucauuuguauuaacacuuuuuucugucucuaacagaaaggcagcauuucuuuuuuauguauaaucucaucggccuuuucaucauguuaacuguguccagcguauuguugugguauuauuuuuaauauccugguguaccacaggcagaugacuagcaugaccucagggcuuucugaagagaagauaccgcucauuuuuccauagccuauucuagggcagacucucacucucuaucuuaguggggcuggcuaauuucauuaccuauucaauucaucugagaccauuuugguaaaagcguugaaauagcaaugcgcuaugagcuagucuuugcuccuguauucaacuggcaaagcaaaggacuuugguuuucauuuugggggccccaguuaacacccaaaggauggcaauuuaugaggcccugaugaagauggugagaacuggcauuugauauauaucaauauuugauuuauuugauauaugugaucuucuaacaaccuugugauguauauaggagaaguauuguuaaaauuaaauuuuacuuugaaggaauucaggccuagagaggcuaaaugucacagauucccauggcugguaggcugggccucauacccuuuccuacuuaaugccucugagauucacuagagagaagaguaguuaacagugcagguucugaacucagacaguuuaaguucaaauccugucucuacuauuucugugcuaugcgauuuuagggcaagcuacuuaacaugggaguaaacuucuucaucuguaaaauuaugacagucgugcuaccugugucacagucuucucucaaggauugaaugaguuauuacacagaaauguuaagaacagugcagggcacauaguaaguacucaacaaacauuagcuaggugaauuguuuaaaguguccagcacaggaagcagccuguaauaggaaaugagccuguauuaugccugggaggugauguuacacagguccuaucgagaguagacaagcugacuaaggaaggugcucaaguccagcagggaaaguucauucugcccguacuguuaccaaaguuagaauaugacaauacuucuguuuuugcgguacaacccgggacuauugcagccuauuaaauuaaugagaggcagauaauugacagugucucccacuggggaaccaggucucacucuggguggagcaguuaauaugcaggucuccacucuggagggauaggagugcugcuuccucaugcugcauuccagaauccuuucuagaugccuucaagauuuauacccuuaaaguuggaaaccuggggggcaccuugugcccaaacagcgcuaaauuccagguaacacaucuccauucacaaccuauugugcguagacccuccuggacacugcuauugaccguugacugauuaugugaucaaagauugaugaaucuggaagcacuggagggauagcaaaggcuuucauuuuuuuguuugucuuuuuaaauccuguuccauguuccacuuugaacuggauugaagucagcagugaaaucaggaguguggaagcugugguaccagaggagagaaccagugagagagacuuggcuuauagcaaucaguccagcuccagucagauaaaggagacaccagugagggagugaacagaaugguagagaacaacccagcugagauuccagcauccuuuucuucuaucaucagauacaagaggagaguucacaagagaagcccaguggcuuuauucggagagaguugucugguuaagcacauaugugcaccgcaaauccacauuugagauccacccguuuacauuucuucauaucagcaucugaucaggaaccuccaaauguucuagcauccuuugcaaauaauuuugauuuggaaggcuucucuggauaguucauuuuuacugaaagacuauucucuugauaagaaauuucugacaauuuuaguuauguuaaaucagauuccacauauauaaugacagcuuuguugguguguauuugugugugaagcauugaaacgcaugucacguccugccaucuuauaaagaacacugccuuaauuuuuaacuaugcuguagggagcacccaguguucauacacauguaugaguguaugucaacauacauaggaugauugaaccaugaacucuguaaaguuugguagcauacacagaaauuugguaaggacaaggauuuuugugcuacaaaacuuccuuaucaaaugcccaguagcucuacgugaguuccacccaaggaccuuguuguauggacaaaagggcacaggauuuuccagccguugcugcaauaauagguuuagaagacagaccugggauuguguuccagcuuuaccacuuacuaccccugugaacuuaggcaagauauuguagcaucucuuagccucaguuucccuguccauaaaaugaggaucauaauauuaucaauaauaccuucuucaaagguuuuuuuuuuuuuuugagacggagucagcugugucacccaggcugaagugcaguggcaugaucuuggcucacugcaaccuccgccucccggguucaagcaauucucuugucucagugucccgaguagcugggacuacagacguccaccaucaugccuggcuaauuuuuguauuuuuaguagagaugggguuucaccauauuggucaggcuggucucgaacuccugaccucaggugauccacccgccucagccucccaaaguccugggauuacaggcaugagccaccguaccuggccugauguuaagauuuuaaaaugcggccaggugcaauggcucauaccuguaaacucggugcuuugggagaccaaggugggaggaucacuugagcccaggaguuugaggcugcagugagcugugaucaugccagugcacuccagccugcaugacagaggaagacccugucucuaaaagaauuaauuaauaaaaauaaaauggcugacaaagcauuuaguacaguaacugcacauagaaagagcucaauacauauuguuuauugcuuuugcuauuuuuauuauugaaucacaauuaccucauucauuagauagaagaaauacuuccuacauaacagagcuggguuucagaguugacugagcuaacguaugugaaaaguacuucguauaugcucugaagcacccugugaaaauaauaaugauuguauguuuauuuacugaggaucuacuaagcaccagucacuuuauauacucuccaauucucauaacaaucuugugagagacauaguaugauuuuauagagcaaaugaaaggauaggcuuacaaggauuugcuuaggaucaugcucagauuucgacccagaucuauuuuaaauucagauuuauccuucuacaaagccacauaucaaugaugauaaccuugagaauugcuaauaauaguuucuugacuuuauuaacggucgaauuggacucauauuaucuaguuuaggcugauuugucauuuuuuugaguaguauagcauccauggcaugcuuuuuuuguuaaaauguaugauuuugaugaaaugcacuuaauacauccucacucacaaacuuguauauguagcuaccuacaaaagauauuuguaccacuaagcccuuggcuaugaaggcaguuccaaauaaaagaacaugucagcagaguccuaggcaauggcagugugguugaaauauacaugcuguccucaaggugaauaauuugaagggcauacuuuuuugaguggauaaauucugauuuuuauuauaauuuucagugcuuuuucagucacuccucauguuuuuacauuucaguuacaugaauuuucauucauauuguggauuacaaguaaacugaauuuacaauuugaugccccugccugcauacuaaugauaacuagcuuauugcucaccagcucacagugaucugcucagauuggcauauuggacccugggcauauucaugagguaauguaucugccugcgagugcaugugugcaucuggaaccuagcguauuguaaggagauaggcauggccuuuucaguuuggucccuuccuagcuacagggcuuugcgaaaguguugguuuuuuuuuuuuuuuuuuuuuagucuucuaagccucagucuccucaucuauuaaacuggaauaauaauaccuaucucucagaguuucuuggcaaguaaagggguacuucagauaacaugccccauacucaaaauauguaacuccccuuuccacccuucuuuguuaccaaaaaaaaaaaaguauagcaacaguagaauauuugcuuuguuuuuucacuggaucauaguuccacacacaagaaaaaccaugucugguuaacaacacaaggucuaaacagauuuacaaggagaucagaugcuucgccuuucaccugacugagaugaagccaccaacgaggcugucccaugugugcagugccuucugcccagauguggcgcaagugcuccagcugccccgacggggcuggggccucagaaucccccucacuccgccuuuuggguuuuugcuccuaaagcauccuggccgucaucacucacaugugcucaccagguuucguuucuaguucagaggaaacccauacuuuucaccugugucuuuugaucccuggccugauggaauauuuuucuaaugcccccacuuuucccaacugcucuaaguuacaaauggccagauuucagucauuaggagaguagaauuuuuuuuuccuuuuccuuuuuuuuuuuuucuuuuuuuugcagccugucucacugggggcuggauuccaaggaagcagcccgugcacucacaggccaggggagccaggauuucaacggugucaacaaucuuugcucaucacaccaaaaaagcccugugucggugccgacucauuagcauacagccgugcugugcuugcuaacaaagcaggcucuggguaucugcuaguuucucagcuugucugucuuccuugaccgaaaagaagagaagaaauagauucaggcaagggugcugucccccuccuguggcaagacagcaucacaaggauucccagagagagcgagcuuugaagugauuuuaaagucaccauccuugggagaaaggagacuguccacccuuuguuuuucucaucuucuucuauagcaucaacaagcaaaagaaaaaucgcuauguucucuaguuaaaaaugaucgagcccugaauacuuccuggucaucucuuucauaguuguuguuguuagagugcauaagaagaaauaucuguauaggcagagguacacaagcaugcucuccccucagucugucucucgaucccucuuuuguugggggauggagggaagaagaaacguacaagcagaugugcugcuagaucuacaggcuucugccaaccauauggcaucuuaaggaaagaugguuggagcgucuggauuagcagagucgggaugggaagccaugugucguguugguacaggcaguuguuugagcucucucuaaauggcuucaggagauuguguaauggaacaaaugguccugcgagcccaggaacagccuugccgcugcuggagaggcaauuggcccucgggcggguacugcuucccuuuuuucccccaguauuauguauucuucauuuaauguucuucgaacucugagacuugacucggaacuuuucaacuuauuacgcucguggguucugucugccucugugucugccugaacucuacucugucccuaaucugguaauuaauaaugccccaguccucuucuguguccucucccucggcccuccacgggggguccaggcucagcaggccagcuuuucgugccucuugacaaaggccuuuucggaggaggcugcccugcuaucagggguugggggguggagggaggaugauguauccacccaucagaauucccagaagccucaggagauggaaaaucuuucauuucuuaaugaguuaacugggaguuuuacgucguccuagguguuaagcacaugagaaauauguagcaucacuauuuuggaccucauguguggcauuaaaaaaaauuauucuaauuucauacuagugaaagcauuggacuauuaggucacaggugccauuuacucagcaauuugagaccucaggauucuacucucuaauacauaauuuaaauacuguaugaauauacuguaaauuggagaacugaaacacugugaggcuggcaacacaugggcaguauuucaacuguggucagguucucaggccauucuuauuuugggaggcuggaggcgggagaagcagugagaccucacaacuagaacagaucuggugaguuucuucucauaggaaggcucuuuggacauuucagcugccuuuuagggcaaacagaucuuguuuuguugauguuucagggucauggcacaugcagugcagugucuuuagcugcugauauaguuaggucugccuccucucugggguagauaacaaagccugaggcuccaggugugucauacauugugcuuaauggaagauaaaauggcuaguugauucagucaaagaaccuguccauuuaucugacuaaaucaucaaaccaguuugaauuaagucaucagcuugagucccugagaguagcuggucaguaccuggugggcauuuuuguuuguuugucuguuucuaaguccagggcuggagaaagaggucaguaccuggucugugcugcacaccaugggggcagagugcccuuccuccuuucucacaggcaaugaccccaaaaacggaagcaaguaagaaaugcagcauccagguuaaaaaugaauucacuuauggucagcuguguccaggcugaaaaugagucaccuauggucaacugugggaaauaggaagcugucaugccuacugcagcuucccucaaagguacuucgagcaaugaaaauacauucuaauuuauuugcuguggaacaaugcaaaggcuuccucaaaaaaagaaaugaaaccuggagaaugugugacugaacuccagcaggagaacaggacacaagucuagaaaucucaagugucuucaaacuguuauuauuuuuauggauuugugacuccagcaaacaacuuuuacuaucuuaaacaaggucaucugaaaaucacuugaagauuguuaccaaauuccuucauaaauauuuucuacaaacauaaauguccaccagaaauuucagauaaaguacuauuucuccugugucaauucuuuguauuuaaaauuuaucucauauaccuagguuuuaaaacacguuuuuaaauuuucagaacucauuucaugcugaacauguuaagugcuaggauauucuuacuuugucuuccgaguuuaggaucucugcggggguguggggggugugucuguagaaagcauaauuuugauuguuauccaccaauuggaagaaaucccuacuuuaaucucuuuuaccuuccaaguguacauggucccaaauuugucagucuuagaauuucuugaaacaaugcaauuaaacugcaacauauuuccuaacauucuuaauuaagacagugacugaaaaauguagauuaacagaaguuacuguuuuuaucaacauauuuucucucucuuucccgccaccaucacaucccccucccccuaccccuucuugcuuuaaaugucugaugucaguuucauccacauguacauuaugcacauggcacugaagaaacaaaguaaaaaauucucuuuuaauucugagcugcaugcccagcgccacaugcacugucuguuacaugucgcuucuuaugagguucaugcugggaaguuucuuuuuaaaggcgaaguguuucugaaggaaagaguucagguugggcagauuguguuagaaaaaucucacugucuccgaguggaauuaauauacugauuauucugugcaggcucaaacuggcagcgugugcaaaaguucaagagugucugggaauugaaauauggaggagaaagcgggagagugagcagagacaaagaauuggaaguagggcucagaagugaaacuaaacgguaacuuuguaaagagaggaagggaauucaagucugaacaacugucaugaagcaguacuuacugaaaauauuuuuauggaaucaggaagcuccauuuuccauggcacuuuuuaggaggggucuuacaaaugaguuugguuauuggaggagaguugccggcgggggggggggggggggccgggggaguacuucuuugaguucucaagauccuugccaguuucaauuaagucacaugagaagcuuaaucacuaacauagaaauguaaacggguugcaguauuucuuuggccuauuagccaagauuuuuuuuuuccuguuuauuaaaauuugaguccuucaugaucacugacaaacaaugauucauugguuuacaaauaaggaauuaaaagguaagaaaagcaaaugcaaucacgcagcaccuuucccaucgcggggaaaucaaccuuuuuacucauugccucucaggggaaagaacuugggacgugagcauggaguuaaugaagcuuucacccaucuccuccucucaaccgucaucccgguuuaauccucuccuucugccaaaguccagaggcccugcgagcccccguggagucgccugagccagaugcuccgcacccagccuccccaagccccggccggcugcccuccaggugcgggcuccaggcccucucgcgcggcuucgggacucggccgagcccgggccuaguauccagagucgaagcagccgccgggaggucugggugggcagggaggccgagaggacggugcaccgcccggcagcgcugagaccuggccgccuaggccacccugcccggcgagggagaggggugucuccugccuggagcgcuccgcgguggcccgagagcaggugcuggcgugcgggaggcgcacguggagcccugcggucuguuccaccugcagaggcacaauugcccagcgugggguggaaggcaggcugggagcucccgggacgcggcguggcagcgcagggcucggcuagaugcgcuccuccucggacugguugaguaagggaggaggcucguccugaacgugcacagccgcuccuaacuccgucaacggaauuucacucaacuccgagacugaagcauuuuauuggcagcauuuagaaucggggaaaaaucuaccuucuguuuagcaguugcucuuuucugaagcagaaaauuaucucuagggaugacuuaguaauaggguaccccauugccaugugggucagggauugggggaauguccggauccugccaaugcaccucuguaaaagguggcauucagccugggaggagaggagcuggcagggcaggccgcccccagacacgcacaggcccaagcucuguccugcagccccucccggacacgcacaggcccugagcccuguccuacagccccucuccuguugucauuugcuaucagggcaguucuaccgccgccacuaagcuuugcuucucccaacacaaccaagagacggacauauagcagugaauacugucuggaugguuuagcaugucuggggcgggggucuuucuauugccugcagggguuuccgagucuacccagcaggugcucaccaggagugggggcugugacugggacccauggccuguggugugaggggugaggggccacuguguacuguaaccgggagcagccuggaagaaggccccugcucccccuucccuccggcgccucuuacucaggaaaucuuaaugugggaaggauguguauggggcuccauaagcaacacugacccaguccuggggagagacaaaccccucguccgcucucagaucauccucagagauccucuggggccucugaguugaaucccaggcucuccccugcuuucgcgaggacccaaggcuuaugcacacagaggguuucugguuggaacaccuaaaaguugauugaugacagagagauggugcuaaacuggcauauugcaaagcaaucuugguauuuguucuuugucaccuuccucaaggcucaaggugcuuuuugggcuaaaauggggcauucugugaacgugugcuacuuuugaaaaauagaggaagggguguuggaagccuagacugguucucuugccacuccucaaaaagcaaaauuuugcagcccaaauauuaaaaauugacuccgcguauuccuucucccccacaguggcacacaacugggcaggcuccaucucgucugcugcuggaacccacuagaaaccaaaugagcccuccagcaggccuaaucacucugaucugucauggaccuucuagcuggaagaguuaugccaucauauuaucccaacacucaucaguguguggaggacccccuuuuacugaaugauuuauugcucuuugcagaauuccuuuggcugcagauuuuauuucugagucacucuguucagcucaauuggucgccuucaguuaccguggcaaccagcagaugggguucuuugacaagggucagcggggaggcugccuugguuuggacagaagaggagcuaaauaaaaagcuuucagcauugacgguuccguagcggacggccaggaguuguuaucaaauuacuugcauuaaaaccuaauuaagaugugugccaauaagugggcuguagugauugaaucugguuacuuagcugcugugggcccaaucuuaugccaucacaccucuguggcuaguuugacuaucccaagaauggucaaauaugaaggaaauugaggaagaccucaccacaguguggaacgugacauacucugggaccacaccaggaggguuuuagucucugggagcaccagaaaguccccauucaaacagaaacuuccugaaaacacagcagugugccccccaaacccaagauggcaacugaacaggaccuccaugcgucugauaguuccaugucuuccguuaagacuauugguaauucaguugcaaauagcauucaacaaaauaaaacuggcuuguaaucacucuggguuaaagaagucuaaauagagacaugccaacuaaguaugaaggaucuuuucuggagugggaagaaaggaacauuauugggccagucaacaagauuagaauccaauucaguagguuagaugaagcuauuagaucaauaugaaauugacuguaguugguaauauacugugguucuguaagagaaugccuuuauccuuaggaaauacacacuguagcauauaagauaaaagggcaauggugcaugcagcuuacugucaacugguucuguacacacacacacacacacacacacacacacacacagagagaaaggcaggagagcguaaucaaucagauggggcaaaauuauuacaguaggugaauuugaauaaaggguauguugguauucucuguaauauucuugcaacuuuuuauaaguuugacauuauuuccaaauaaacccauuuuuaaggacggcuuuagggugagguaggguacagugugcguggcaguguggguuuuccugcuggugcuucuguauggccuugagccacaugcagcauagauacuacucugcaaagauucugauuuucaacaauuuccauuccucugucccauuuccuuugcacaguggggcuauccucaccauuagucuguucuugcuugagacaaagcugauuaagguaacucuuacuucaggcagauggucuucuagguucuucaaagucuaagauucauaacgugucaacuccuguuucauggugucaggauccuuuauucaugcccagucuuccaaagguauuacaaacucagccuugguucgauagcacuuguauuuuaagaagguuacaagguagugauucaacagaucuaauugcccuaagaugaagcugugccuccuuuuugguagaagcacuguuugaagaaguuggucuuugaagagccucggugauauugucagaggcuuuagguuccugucagaggcagcugugcuggagcuugaagagcugaaaguguccccuuggccaugggcccauucacugggggccaguguggcacugugggcuucccaacauggucuuccaagcuucuggccucuuuugcauccuuugugccaacaccagucuguggaugagaucaauguggcucagagugugguuuccagaguacgguccucaaacuguuacuggucugggaugaggcaagaacugaaauugagucagaaauuuucaaaacaaucaaacacugcuuccuccuuuuuauuguacuccacaaaaccauuagucuacaauagauuggaaauuuuaaaagaauuaaaaucaagucugguucuccucacugagcucauuggggaaucccuggccuagggauuucccucuucucccgcccccaggccucggaaaaugaacuggugucagcugcugcccagaagguuacccagcguguucucucucucaggguccuucccuuaaauucucaaguuugacauggaauagaagaaugucgggcguuucaaaaaaggauuuugagaugcugcaaagcucacuggauuuagagucaagagaugugggcucuagcgccagauuuacuacagacaggcugccugaccuugggcaagucacuuauacuuucuuggcuucaccauaaugggcugaacugaauguucucuaaggugccucucagcccuaacauaauaugauucuuuucaugagaagagcaggacuugauccccccaucacuugggggcauccccaaggagcccccuguucuuccucugcaggcagccaaggcuaauuaggaaucugagagaaugagccaggaaaggggcaguacaggacauacauucucuucauugaaggugguacccccuccccacugcacgauccucaggaagaauuccuuuauugaaaccauuauugaauaggguagauuuaggcacgggaaauguaaacagcaaaccagccacuaaaagugcguuaaugucacgccuguaaucccagcacuuugggaagcugaggugggcggaucaugagaucaagagaucgagaccauccuggccaacgugguuaaaccccaacuccacugaaaauaaaaaaaauuagcugagcgugguggugugugccuguagucccagcuacucgggaggcugaggcaggagaaucauuugaacccgggaggcggagguugcagugggccgagguugugccacugcacuccagccuggccacagagugagacucugucucaaaaaaaaaaaaaaaaaaaaagaaagugccuuaauguucugagcaaggauaaugggcuagagcguguuccggaagccucagcacacugcuuguucucacugauaggaccucguucacgagauggaauuauguaaaaugccgcagcaaugguuaaguguuggaacaaaguaauacagcuuuacauuaacaugguuuauucacuagaauuaaugaccuagagcaguaauugcauuuucaaaacuucagcuugcugacuagguguauugcuauguaaauagcuagcgauauuugaagauaggaacacaguaaaaucuguaaaguaauaggauuguagaaauauggagcuggaggagaauguagucaucuucuagccccgaggcuggcaaacuuuaaaaggucagguaauaaauauuguaggcuccauggccauauguucucugucgcagcuacucggccguuauggugcaaaagcagccauagacaaaacgugaaugaaugggcauggcuggguuucaaugaaaguuuauuuaggggcgcugcaaguugaauuucaugcaguguucacauauuauacuccuuuugauuuuuaaaaaucauuuuaaaauguaaaaaucacucucaauuggcagaucauacagaaacaggcaguggccuguagucugaaguuugccgaccucacuucuaguuuucuccucucauuucacaugugaggaaacugagauucaaagugaucacaggauuuacuuaaguucucaugacugacgccagaguauuuuaggagcagacuaggagaguuuucauguagacaguugguuguuuugaugaugaaaauugaagccacacaaaaauuauucuccagaagaacucauuucguaugugugauuaauacugugaauuagaauguaccagugguucucaugcuuaagaauucaucagagucauccaggggccuuauuaaaacacaugcugcugggccccacccucagaguugaugguucaggucuggagaucuuauuuucuccauuuuacaaauggagaaccugagguugagagagauacucagucucaggcuuaagguaaaauagcuagcuugugaugucccccauuuccaaguucagcacucauaggauuaggauuagagcuauaaguaaucaucaagcagagaggcagggcugcaguuuuguuuagagagauccuucuagucuagcuguugcggggaguauggauuccagggggccguguggaagcacacaacucuaugagaaggcugugcaggaaccuggaugugaagugcuggcagcuggacuucaagagugaaggucauggaauggauggguggauggaugagugggauggauggaugggugggauggauggauggauaggugggauggaugggugggugggauggauggauggguggauggauggauggauaggugggauggaugggugggugggauggguggauggguggaugggugggauggaugaaugggggauggauggauggauggauggauggauggaugggugggauggauggauggauaggugggaugggugggauggauggauggauggguggauggauggauggauaggugggauggaugggugggugggauggauggguggaugggugggauggauggauggaugggugguauggauggaugggugugauggauggauggaugggugggauggauggauggaugggugggauggauggaugggugggauggauggauggauggaugggugggauggaugaaugggggauggauggaugggggauggauggauggaugggugggauggauggaugggugggauggauggauggauggaugggugggauggauggauggauggauggaugggugggguggauggauggguggauggauggaugggugggauggauggaugggugggugggaugggaugggaugggagagguucagaaggccuagagggcucaucuguggaaccaggagacugagcuguggggauggugacuagggguggucccacccacugagagggucacagagagaggagcauuagaaggugacuccagugugucagguggugaguuugaggugggcuuggaaaugcaagagagaggcccgaggcugagaucaagugcucaggauccuuggccucuccacuuggagucaugaguguagauuuuaaaaaucaugcaggcggaacauuuccagucaggagagcacugagcccagcccugggucacaccagcauuugaaggucugauggaggaggaagagggaccaaaggggagugagagaccuguacagagucuaagaaggagagugaugagucgcacugugggccuugcucuguggccuugguggcuuagguaauccuggcucugccuuaccuugugugcgcuugggcaaaugaucgcuucucugcaccuugcuucucucaugcauaaaaugcagaugauaaaguaacguguaguauuguuaugaggauuaaauuagggaauguaaaaugcuuacaauguugggcauuuaguaaaugcucaguaaacauuagaggaggccacugggaggaguagaaaagugagugcauauuuuacaguucauguauuugcaccuuugaaauccauauguuguuugaaaaauguucuucauuuccaugaggaagacgccgcucccagggaaauagugagucuaagcacuuugagaacacuuaucuaagaggaaggacaaucuuagcuguagucagagugaccacagggaggaggcucuggucugaaaacauuucagaacaaaggauuuuaccacuaccaccaaaaccaaacccaaaacaaaaccccaaaacaacaacuaaaaccuuccacuguaguccguagguagcucccagggggaauuguccagugaagcaaaaaacucucauugaaaaacauacacgcauaaggauauaggcccccucuggggaaggaaggggcuggccuggagaagaaauccauugguaguggcccuguggagcuggugcuagguucacaaguguucauuugguuauuauaccucaugacuuauguauacauugcauauauuuuguauguaucacauacaacauaaaaaaauuuaaaucuauguauucacuugcuuucacaguauucauagcaaaugagugucugaagcauaggaccagagcuggcagcuugcaccgcuucuguuuugcauaagauauuuuccccagcccacucagcucuauaaaguuguuuuguauuucaccacuugcuccaucuuaucuugaagccuugcauauuuuuuuaaaugcugguucugaucaugcuugcaggguguggcucagaggaucgcuguuggaccaauggagaucugccugggcccagcacucuuaugaguccccugugauuucaucagcaucugccuuuagaaacccgggcguguuuguucccaugguaacugcugccccugacacgccugaaauuccugggaugcccuugcguggaaggggagcccgugcugcccauucuaccccugcauggggcagcugcuuuucucccucaggguccccaguccuacccaggcagggguggcaguuguucaucugcagauccugaaggacauggacccugugccugagauuaggacggccgcaccagccugggugcaggcucccucaaguguccuuccucauggacccgcggacccuacgcugugcugugagggccggggagcacaggggcuuccugggaggaggacuggcuuccugccccugauggggccuggccacagcucccagggcuccaugacagcacagugaagauagcaaccacauccugggggcccuggaugcaaucccugccuguugcaaagaugagauaaaggcgcgggaaagaagggucugaauuagggguugagcucugaaaucggacgauucuguguuuccugccgcauggagggcgugugugguucgcaggcuguggggggcuucuugcagcgggggcugcugccuaaacagacuccgcgggccccaugauggcaaacccccucgccccguucaugacuuaaugccuccuagaagaaaaggcuaaaaacaagacacacagaacaagaaauugcacucucucaaaacgacagucgcccugaaacggacgcuggaagagguuuccaggcccguggcgacggugaggggggugaaggucgcagguggagggcacggggcggcggcugcggagcccggggaggaggcggcgggcgcccgggucuuccucggagcgcgcccccugggcugggcggcgugucccugccucccgccggcgcccucguccccgcagcagcguccccgccgccaccccgcugccucgucgccuuucucgcaaacagcggugcccucuacgugggggauccuggaggcugcugagcacgagcgcccuccgcgacccgccccugcucccgccuccacucuugccucggggggagggucucagucuucugccuaaggcgcccuccucccuugggaaguccgccguccucugccgugaagauugccccucucuccuccagugccuccuccccagcggcuucgguggcucccacccuccgcaccccgucucgcgaccuccccgccagcccagccccucaccagaagaggcuuucucuuccagccccugaaaucuggcuucugccccagccaggaggcuccgcagggcgcuccgccaccagguggcauuucccacaaaccggccacuccgcccugaccccucuccucccuggaccuccgucucccaguuuuccucccuccaggaucccacucucagugucuugccggauuccaguccacugccagccauugaaggcggagguuccuuaaccccuauccuggggcgagcccuucccucucacugcagaagagcuucucagcuaggggggucgugcgggcccggagagcugcauuuuuaacaaacuccccacacugacaaucuuugccaacccuucccaggcaaaucuugcccccacguucauggucucgccucccagcagguuuggcccacccagcuagagcuccagcucggcccuuccuaagccccaaguugcauagcugccuggugggugcguguuccacagguaccucggacucgcccugaccccagaacgucucuucuacgccaggccgaucccuccugccauccucugucuguuaaauggcacugccauugccugcaggacgaaguccauauuugcugguuuggcuacagaguccagcgucgccuuccucugagcagccugcagccucuggugcagccacacugcacagcuugcaguuuccagacacgcauuggccuuugcagugcggccccgaagugggaaggccccgccccuggcccuggccagaaaagcacccacucauccuuucccaucccagcuugcccgcugagugacuuugaaucaaugauucauguugucugugccucaguuuccuuaaccuuaaaguggcauaauaauuaguuccugccucauggaauugugagugcuaaauaaacaguaagucuagugcccgacauaaaagugcucagcauacgacgaucaugagccaugucuaagcaggcgcaagcccucccaggcuucucaucugcaauauuggccauuucucuucaugccucaguguccuguuugaguugagcauguuuuuuuuacaagugagucucuccuccauuggccgggaaccgcccgagagccgggagcauuugucauucuugauggacccccaggucuuaaaucaguacuugacccuuaagagguguuggccgggcgcgguggcucacgccuguaaucccagcacuuugggaggccaaggcgggcagaucacgaggucaggaguuagagaccagccuggccaacaucgugaaaccccaucucuacuaaaaauacaaaaauuagacaggugugguggugcgcgccuauagucccagcuaccugggaggcugaggcaggagaauuucuugaacccaggaggcagagguugcagugagccaagauuaugccacugcacuccagccugggcaacagagcaagacuccaucucaaaaaaaaaaaaagaagaagaagcagaagaagagagguguuuagcaaggcuugguucguuuggugaauuaacucagugaguuaaccaccauuaacgaugguuaaggacacuugggcgcuggcucgauuugacuccgagcuuuaccgauuacuugugugacuuugugcaaguuaauuaacaucucagcuuguuuucucaucugugaaauggggaugauacuagcauguaccuccuaggacuauagugaacuuuuaauuaagauaauuauugaauuuaacagguaguuuauuaaugaaauuuacauagguaauuguggcgcagugagcccaggggcucaagguguuagcagucaucaacagugcuauuugaaacuguggguggaugaagaggugaacucaacaccacaaauaugacagagcaguaaccaccauggaaaagaaaagagagcuuaugugucuaggacaccccaagaaaucucuucugaaugaaugauggcaaugaaauagccauuaacagaggguaggcugguuugugcaggguuggaggcuuuuccaaaaauaaauaacuuucaaaaaaucucagccaggcgcgguggcucaugccuguaaucccagcacuuugggaggcugaggugggugaaucaugaggucaggaguucaagacaagccuggccaagauggugaaacccugucucuacgaaaaauauaaaaauuagcugggcacgguggcaggagccuauaaucccagcuacggcaggagaaucgcuugaacccaggaggcggagguugcagugagcugacauagcaccgcugcacccuagccugggcaacaaagcaagacuucguaucaagaaaaaaaaaaaaaucaaucucgggccgggcgugguggcucacgccuguaaucccagcacuuugggaggcugaggcgaguggaucacuugaggucaggaguuugagaccagccugaccaacauggagaaaccccgucucuacuaaaaauacaaaauuagccgccguuguggcacaugccuguaauuccagcuacucuacucgggaggcugagacaggagaauuguuugaacccggaggcggagguugcggugagccgagaucgcaccauuguacuccagccugggcaacaagagcaaaacucugccuccaaaaaaaaaaaaaaaaaaaaaaaaaaaaucucuuuucccaauauuuguaauacugggaguguucaaguugauuuaaaaauugagucaauuggaauccauccucagcucuuagcugugaagggagagcugccccuucuuagggaucucacuucucacagcaggggugcuucuguguguggacauccuggucagcugguccccugcugucuuguggggcucacacccaggcacuugauucagcggggucuggguggugucuccuuccuccuucccaccccaguaaucgcuauagccuucccaggcccccagguugcaaagcacucuggacuaaaccuccuccagguucugagggcuccauaggaggaaggucuaggccagaaccggccccaucgcugaagguggagccaggguggccggccgugaccgguguuuaugcugugagagcggcuuuggcccugcccauugcccuggaugggcugccaucccuuuucaggaguucaaaaccacauacugagcccaucgguccaaaggaccaucaucucauuugauccaagcacagggcaagggaccacauggacaauggcugcucguggcaccuucuugccaugcagccaugucauggugucacuugucacguuuccuggcaccuucuugccaugcagcaaugucaugaugucauuugucacguuucuguuccauucuuuucgagcaagcaggaagccacggggcuaccucaguugcucuuagccaguagcucucuccacagguaggccuucaucggaggggaaaagccaccuuaggguuccagagcucaagggcgaaugaugcuuuccacccacuaauuuaaauacggaagcaucagauugucugcuucucaaggaaaagagcuguuaccaucucugucucuucaaugggacccacuccugggccccacagcagggcaggugcucagaugaaugguggccgccugccugugucagagggucggccuaggcagguuccccaguccgcuggcccgggacguccuccucucucccggccgcucacuguucaggacagcccgggccccccccuggggccuugcaggagagcuucugugauccacuggguggcuuugaggguagcucccaggaaaggcugccucagccccagcgugauggggacggguaggggccgaugaggcuucccagagcagcgauggccuuagguauugccagaaggaaaccuacuuuuccuccaagaucagagggaaggaugaggugggguguuggagcaucaccauauauauacaucacacacacagggaaacacuccuacuuggauggaggaucuuugcuguucuguugaggccagccugauccuggaggcagggcagggccuggcuguugcccaggcuccaaagaggcgccagggcgucccuuaguccuuacacuuucuccagaaccugcgggcagcaggaggcccuugucgggacaggcaaggggggcgguggugcggaauugugggcguggcagucggaggugccaagcccggggaggcggggcuuccugggagcaugcguagugccggcucugccugggcgggguccuaggcugcugcucccgccucccccggcacagguagggcgccccgcagacccggacaacgcuggguguggcugaaaacagggagucauggugcguucuggggaagggucagggcugggggcucgggccccuggaccaaagacucuagccaaauccaucggaggcugagcagggcgauggggcagggccgggggagccguggggaaaugggagggugugggccgagcagcgccggaggcagguaccgaccaucgccggguuucccagagggcagugguaccugugcccacaugugcggccuuuuuuguaaaggaaccuaucccaacccgaaggcccaaacguguggccguguaaguuuaguugugcccggagucccaggagagcccggacugagggcagccagaggccgguguccgcagaacggcccacgaggccuucggcucaguagccuggaguuugaaaugcaccuugagcuuuaauggccuuuuccuugugagaauucgaguuaacgugccugcuggugcuuuugaugggugaggacggugaggcaggccacacaucucgcuucuuuccagaacacuucuggguagucguucaauuccacauuuaauccaaagccaacaguuccaugggugacugugcugcuggcuguaggaagccgacuguggacagaugaggauaauggucugagugaauuagcaagucuggagaggagcgcccaucagcagaaugacaaauuuaggaucuuuaaagacaucuggucagcgaugccggagcucgugauugacugagugauuaauaauggaaaacccuuacuucaguguuuccacggcccucacccacuuccccagccggggcggccgucugcucagccugccagagaccuuuccagcugaacaauggcggcauuuaggccccucaucuuugaccucugcuugggaguucaaagcuuccuuuuccuucuacuuaccccacuuaucugcguguuuucuaauugauaguguacugagauggcucccaguucccacgcacauuugcuagaauguuaccuucacacagugcguaccaaggaccuagugccagccagagccuggcaccucagggucacccuaggcguccugcucaugguucccuaucaggggcuucccucagauacacacagccccugggccuguugaaaggcugacguuaucccucuuuaauucugcgguggauuuuucuccaggcuaaggcagcuggauaagcacagccaggccacagcccagcagcuggugcagcuccucagcaagcagaaccagcuucuccuggagaggcagagccugucggaagagguggaccggcugcggacccagguacugugcagaacgcggcgcaggugggaguccuugggcgggcgucuacagguggaucuuuuaugcaccucaacaggccggcuuucucacggaucacaucgguuagcaguaagcugggagggaggucccgaagacugugcugggcacagugcaggacccagagaagcggagccaugggcccguccuggugagggaguuaaaguccgugcaggugaacagaccccggcccgcgaaucaacgaaccacaccgagugccaaguugcgccgugcaggcugcggagggugcgagagcagggagaagcgggaggacggccgugggcggcagaacaggcuuuuuggaggaugguggccuugagcugccucugaaggucguguaugguuugaauugguugaggaaagagguguucccaauuagcaaagucgucuugaauggaaggcaggcaucucauccuaaauuagcugacugauuacugggcuaauaucuggagugcuugcagagcacccggcaguguuacacacagaacaugcauuaauucccuuuacccuugaacaagcaggcgaugcugacuuuauugucuucaugguuuagauagggaaacuaaggcccagacaagcauuacagcuggcaaguagggacaccgcaaacggaggcuaagccugacuccacagcccaggcuuuccccauucagguuagauccggggccaccagcagggaaaagggaggaaggaaagugucccggugaauuuggaacacaguaugaaaccucguuugcuaaaucgcuucucuuccugucagagaggcugugcauuuugccccgucaagcaguuuguuaggauaaugaggugguccgugggcugaccaaggccuccgccuuuaauuaggauugcacccaggugcucugugagugcccuggggacuucaggcaguaagugcuuggaaugauuaauaugaaaaaugcaucuggaaaugaaaacgaagaggagucucauucuccucacaaaaugacccugugcucaaggaaccuguaaguacugacuuuucccacucgguccaaaaucccucugccaaacauguguucacagacaguaaaugagcacacccaggcgccacggagcuaaggccuggagguggaaaugccucuacuguccccaugcuucugagacugcucccagggacugugggggagcgggccgcucaaaguccgagccacagccgcacugccacagcuaaucuaggaggcgaggccucaccuggcacgcuccauggcagggcccuggaaccugaauuuugccaagcuguugggaugauucuggacgacacuacauuuugaaaaccucugaaguguuuggagcuggaaagaacagagaauuauuccagguugugucacugugcugaauccccugcccccgcuucggacaaguaacuuaagccuuuuuccagccucaguuucuccucugcacagugggcauggugcacgccuggcuucacgggcuacugggagugcugagugcaggcgggaugccccacgggcccuugggcacacaggcugaggacgugugaggguguuuccuuucucccucaucuucagaggguccugggagagguucagggaaggcagaggccugcagagcagcagcugugggaccagugccacuccccuccccucugcuuucaggaugacccccucauccuccaccagacccagcccagaacccagcccugugggcagguccccagggagggccccagcagcaccugcuuuaggccuggccagccaaagaucaggaccacuggagccacuaggucuccuggcaggugacuaggcucuugucacauaggagggagggaccgugacuccuggcaugagugaaucuucagccucuaaagccaagaacucugucagaccucagguuguggggagucuuccguggaagcuggagcacacggcagcuuccuuugggcucuggacuagaucaggagaacgugggcuuugccuuuuaacuccccaucugccugcuuuacagcacacuuagaucuuaacauggaucaccgaugcuuagaagcuucuuccagggcuuuaaaaaucuggcuauugccaaaugaguugcaaaauuuucacaaaacgcauuaaaaaaaccccaaaccucaaaaaauccucagaaaaacuagcaggucuuucuuucuucuuuugccugaagcaacagcaaugauuugcccauuccugugcuaucugauacuggcccaucuggcucaucucuaaagcggccuuucagauucaaauauuacacuuggaguuauuuuaauaugaacaugacaaaagaaauuugguagagggaauguuggcuuucaguugcaaauacuaguggucagagaggaggcagggauccagguuugcaagcucucugcugaauaucuaaacccagagccugcuuuuucuggcuaagccuggccuucaccucuagguaggggcugucagugggcuucagccucugcgaugccuucuugucauggaaucagcuugaguugugaguuaggcuucugcugagccaugaugugggcgaggcugcuguagguucgagcagguauuuuggaugcggugccgccugagggcuccggagugcucagccacccucucuguuuuccuggaguggccuguggguccagaucuugggcagcugaggguuagagcuguccucauguccggguuagagaugguuuaacuaaaggcuuccguuuucucagccuggaugaguuaagcuuaacuuaauuuugcaugucaaacucuaaacaucucuguccacuuaauacccagaagagaaugggucgggcaaugguuccaaagcaaaguccaccccuuuccuucccucccuguccuggguccugagccccgcugccccuggugguggggcucaggcuggccuguggccuccaacaggaagugucuagccuguuggcaggcuucauuauucuaauuguuucugcuugaauucugaaacacucacaacaacauggcuggcagagggagccccugguagugguagcugccacauggaugcuuuuggccacgagaacccccauccuccccgcuccccggcgcugucugcggugggcaggacucagggcacuggcucaagcucucggcucguuucuuggcuuuuuuuuuuuuuuuuuuuuuuuugagacggagucuugcuccgucacccggacuggaguacaguggugcaaucucugcucacugcaaccuccgccucccggcuucaagugauucuccugccucaggcucccaaguagcugggauuacaggcacccaccaccacaccuagcuaauuuuuuuguauuuuuaauagaaacgggguuucgccauguuggccaggcuggucuugaacuccugaccucaaaugauccgcccaccuuagccuccuaaagugcugggauuacaggcgugagccacugcgcccagcuguuuuuuuuuuuuuuuuuuuuuuugaugaguuuuguucuugucgcccaggcuggaguacaauggcauggucuuggccuacugcaaccucugccuccuggguucaagcaauucuccugccucagccucccaaguagcugggauuacaggugccugccaccacgccuggcuaauuuuguauuuuuaguagagacuggguuucuccacguaggccaggcuggucucgaacuccugaccucaggugaucugcccaccuuggccucccaaagugcuggcauuacaggcaugagcuuugcccggccucuuggcuuguucuuaguuuagggugacuacaaauaauggcauuauugaucuccugccucaccuggguucggaaacaacuucaagaaaauagcuuuuaaaugucaugaaauggcucuuacuuguccuuguggagaaacagacacugaagcacuagcccagcuuugccuagaugcaguuccccacacucuguauuccgggagggucagggccuccagacacacacccuggccugucuuuuguuugagacugggcuggguagucgcacucucgcccucuugagaggcaggcccuggcugggggaggcugaaaccuuggugguggggguggggggagggggauucggggugaggguggugggucucaggggaguuugggcagggccugacagcuuggagcagggucaggggucugcggcccagagccugggggcucuaacaucuggcuaggaagguuggagccagcuggugaggaaacaugagucuuggggagaauggcaucugggacaggggaaaacagaaauuaucuguccacuuagaggauggucucaaccaucaagaugauuuucugugucugcuuucuuauuugguaaugaauacgguuuuggcugacuugcauuuucugguagccgucguauccugagcaggcugcuugguucugucugcaguguucaaucuggggagugauucccuuuuaguccccucauaugaaucacuuacaguuuagaaaacagagucggaaacugacuugucagugguuaaucaguuggcccuaugacuuuuaagcauucuuggcagugaauuuacuuucuaauuugauuuaaacuugugcauggauccagcagccauaugugauuauauucaagaucaucgacauuaucucauuauaccaaaggacucauagaagagagccgaaaacaagcaggggacacagagacacagaagaugaugaagggaggaaaggcccauugcaacuggaagcaaagggagaagggagguucuagaaaagugacagcucucagggagcaagacucccugccgagggaggccuggcugcaaggcggagcugcugcaggcugcccauguuaggccuuggaggugucaccuaauuuacugugguccuuccaggagcccugggggccucgcccagcugacuuaggagcuaccacaaaguuagcuaccuguaagacagauggcgcuugaauagaacagcaaauacauugaauaaaauaaauuaaaaagccuccuccugaaccaagauuuuuuggaaagaauucuaaauagaugaaaacaaacaauuugauuucaaccaaauuguuguuuuuuuguuuuuauccugauuuucacccgaauugucagucucaaaaauaaacacugauacauucccagaaaauauuuuucaaauaaaaacugacucuguuaaaguuugcccugauucuuucaaaacuguguacaagacacugucaaccaaagugacuugcauauuuuuuuaaauaaacuugaacauaugcagcuaaaaugucauuaacucccugcugccugaguguuuuuaaaaaaugacacaagacccugggugcugcaugucuaacauaagcaucucgcgaccuucggagaaacuuccccaaacaccuccaacagcagacaguuaaacuuuuuguuuuuugacugagcgccccguguauaauuaauauugaaaagcgcauagggcuucauuuuagccagacuugcucuuccguuaacaguucacuuuguccaagagugaguacuuucagaauaagaaucaugggagaaaagucaauugaauuuuauauuccuucagauacauucacucuacuuauugcuuccugagucagacauuacauuucacaauauaaauucacaaucaagauuuuaaagggagcuaaauauuuuaauccaauuagacaagugaacaaaacacugaauauugcauguaguguagauaagugguucuugccuuuaaaagacuguaauuccgucacauuacaaccccaaaugucaguguugucuuuauuuuuaacacuuucaaacaugaggcagccagaggcuccacucucugcuguuggugacacugucuguccuuugggaauucuuaaaaucuauuuaccauggaaacaugguucauauaaaacacagaccugccuguguguagaggaaguucucaugacucaggggacuugagaaagcuggaagaugacaaacucagaccccacgguugggaaggaacccuugggcuugggugcgcccuggggaggacagguggcaccgcagagccagggccuccaccccggccucaugugugcuggggccucccuggccugugcggggccgccucccucuccccgccaaguccagcucgagaugcugucuuacggaacgucccacuucaugucugcaaggcggccuucucuguggauaccuuuccauuccucugguuucugcggcccuguuccuuucucggagcccagaagcagcaaagccaagcccugcgguggaagggaaggagggcuuugaacucugacugcgguguggaggcuguuaucaggggcccagccgggcagccaggagggaagaauggccgcugcccugcgauggccuuaaccgugagcccccgccugcuuugcagcuggcagagccagguuccuggaaaggccugacccggaggggacgaggccccucagugagaacuucagucgcugugcuggggacagcagggccgcaggggccugaggguggcugacugccccucggcucuguagaggagugcucccuucugacaggugggcgguccugcucgaaggccgcguuuccccgacguucugcccagcaugcugagggcaccucucuccucagugcguugguggcgagccagagcucacguggcuuauuucauccagguugccuucccaauuuggcagcuuaauuccguagauaucaaacuggcugccccucaucugccagagcaagcaggagagccucgcaugggagagucuggacuuugaggucaaacugccuggauucgaaucucagcucugcguugcuucagagacauguguuagcuuucaugucacuugauuucuggcagagaaaaagaaagaaccagcuucccuuuaaaaggaagugccucauauuacccagagcccagcacagaugauuaugaaaccaacaggauuagugcugagaucauugugggcuugaaagggccauuugagauaaauaaccauuuuguacagauagaaaaauaaggcccagagaaaugaagugaauggaauugggaaguggcugggcagggaaaugaacuucuucucaggccacaggauguguggaugggggcagguacccgagcgggugcgggcggagccgggccuggcuggaacagcugccgagcccuggccccggugcccagaacacgaggcggaggcgggaggcgagccaccaagcgaggcaggggcugcccuggagcucugucaacucagggccagcuuugaaaugccccagauggagguagggggaggggccugcccucuccaguuacaaauggaugcuuuauugccagacacacaaggaacaggaccacguuuugacuuggccaaacagagacagcgugccagugagcagagcggacagcagggggggaagggguuguuaccuucagaaggguuggcuagagccacccacggagacagugaagugcgaagcccgggcaggucuccugugagcaggggcgaggggugccaccaucuccccgggcugccacuucuggcugguuugggaacaaagcagcagcaaaggcuggcuggaccccacagugugguugccuggggaacaguucaggucacccagagcaacugauuucuuacacucagaacuuaacaaacuuuagaaauaaaugaggcaggguuuguggagagaugacuccgauaggauuuaaaaugagaacaaagaaaauggguuagcagcugugugccugcagaugggggcacguuuccaccaccuguggacagcacggcaggggagcaguggccagggcgcccugucgccccccucugagcugcaggacagccacaggagggccacagcaagggccaugaugacaaauggaagggcagaaggacgggagacacuggcugagggcucaugucccacuggcauacgcacgcucuacucuccuggacgagaccaugaucacugugguguugaugacaggacuuccuggaaauaagcaucguggauaucccuaauggcagacaagccagaugugggcaguaacuaaggcuucugucucggucagagaaauguguguuaccaaagagucagcaaauggaggcgacaaaacggugaccuccuaggacaaauuauccagcccuccagugcugacugaacgcucaccaugggucaggcacggcuguaggcacgggugggggggggggcguugagcagugaacgguaaguucaacagugugaaaguggggauggauauggggcuucucaccugaaccgcaggaaauacaaagcccauagagauggccauggcugaucugccgcaggaaggaaucaggcugacuuuugauugguuccuggugaggcccguacaucugugucacccccaugcaggcccacggaaucaggaggucacccguuucuggaacagcuccgauagugauaaauugcuagguggccugggagcccacaggcauuauguagacucaucaugagaaaugccuguuuccuggagcuuaucaaaaaauuccgcaacacauuuuacuuuuacuucaggucuuuacgccuauucuguauuguguguacguggguguguucucuacccaaaauucaucacugcagccuugaauucugggcuacagcaauucuccuacaucagccuuuugagucgcugggacuacaggggugcgccaccacacauggcuaauuuuuacaauuuuuuuuguagagaugaggucucacuauguugcccaggcuggucucgaacuccuggacucaagcgauccuauugccccagccucccaaagcacugggauuacaggugugagccacuguuggguuguuuuucuuuugaaguguuaucuguugggauuuaugcuuaucccuuuuguauucagucauccuagcauuucuaaaguuaggaagccacugugucaagagcgaggccaccaggccaccugccuuauguggccaauccauggagcagggguggagggccauucaaaccagucauuuagcaggacugugcugggucaguucgaucaccuggccuggagggcacgucagcuuggugcaaacccugcguuugacaaucagaucguguugguggcagucuccgugcugucaguaucccacugaggacagaagggaguccccucugcaauggcagggcucuagggcauagugcaugggguggacuccucaugggccacucagacagggccuggagaacaaagcaucccgugggcccaggaaauuguccaccuggcuccacgggccugggagggcugugugcaugggauggcagguuuacgaggaggagugaggccuccugccggagccccaccugcauucagccugaggccaggccccccaccuacucuaacuacccugcugagaccaccccacuacucacagaccuguucaagaaaaaguuguccucagggucucucacacacugggaaaucuacuugaaauguaaacauuacuuuuucucauuuuucauaaaaggcaacaggcugauguucauauauuucucuugaaugcggauucaguuucacucauugcccugucuuggaaauccccauguuaaugauggcuuaaauuagguugauagaguccucccuuggaguccagcuuggaaaauccucacuggagaggggcaggcccacuucucuuuuuggaagaugguuccuaacuaaagaaagagggaccagauugggccccuggcccugcagugcgucccaauuuaucugacguagaaaccgggauuuggaaaauaccauccuggcuuuucucuggacuucacaaucuagagggcgaggacuguggcccagucaccuucccacacagugcacaguagaaacuccagacaugcuuuguggaguggaaacauuuccaguggcuucugacucuaguuccugaugugguuuaaacuaauuugggcagccauggcagcagaggccaggaacaguauucaauacuuucugaacuugugauucucccccaaccugaucugcaugaagcuacuuuggaacauuuguaucugcguaaaacuaagagaccucaguacacccaauccccucuuccaacacaugugagguuuccaugugaaaguacuuuuucauagguuacaauaaauugcuugcaguuacaaauuuggagguguuucagcuuguauuguuucacgaggaauuucuuaggggcacuuggccuacacccuguuuuuguucuagaauuaccugccguuaaggucagauaaauuuucaguaaacagauuauggcacaaaucaauguguccuuucccggacagaagagauggcucucuggccauguccuaacaccagacuguccuuauuuaagaggcaggcgugucuuuugucuagguugucuucaaauuuaacccauuaaaccaguuaaccuuauuucauaugugaagggcuuugauguggacaagaugaggcacaaacuuuucauauaauuuccacauuuuuagcaacagguuuuuuucuccaacaacaguuuucaucauaaaaggugacuaaaccagcaaaugagaagacaaauaacauugaagaacaugagcuauugaaacuuacuuuuuauuauuuuuuccaguuacccagcaugccacaaucugauugcugaccuggauggaacagagugaaauaaaugauuuacaaagagauauuuacauucaucugguuuagacuuaauaugccacaacgcaccacgaccuucccagggugacaccgccucagccugcaguggggcugguccucaucaacgcgggcgcuguccccgcacgcagucgggcuggagcuggagucugacucuagcugagcagagcuccugguguauguuuucagaaauggcuugaaguuauguguuuaaaucugcucauucguaugcuagguuauacauaugauuuucaauaaaugaacuuuuuaaaga
